United States Patent 9,238,822 (COMPOSITIONS AND METHODS FOR CONTROL OF INSECT INFESTATIONS IN PLANTS) - sequence listing, part 8

SEQ ID NO: 25831 - protein, 111 aa, Diabrotica virgifera
  misc_feature: Coding regions on vcDNA: vcDNA=SeqID_5528; Strand=+; Position=6-338
  misc_feature: Homolog annotation: Hit_ID=CAH04314.1; Match level="QueryCoverage =100%, HitCoverage=46%, E-value=9e-33, Identity=67%"; Hit description= S3e ribosomal protein [Carabus granulatus]
  misc_feature: Gene Ontology Annotation: Molecular function=structural constituent of ribosome; Cellular component=cytosolic small ribosomal subunit (sensu Eukarya); Biological process=protein biosynthesis
  misc_feature (34)..(34): Xaa can be any naturally occurring amino acid
  misc_feature (47)..(47): Xaa can be any naturally occurring amino acid
  misc_feature (87)..(87): Xaa can be any naturally occurring amino acid
  misc_feature (99)..(99): Xaa can be any naturally occurring amino acid
MASSLTKWRKFVGDGVVIAELSEFLTRELAEHGXSGVEVHVTPSRTXSTIMATRYDKVLGENTRKIRELTSVVHHRFSLPPDSVILXGEKVSNRGLCAXAQAESVKFKLIG

SEQ ID NO: 25832 - protein, 103 aa, Diabrotica virgifera
  misc_feature: Coding regions on vcDNA: vcDNA=SeqID_5529; Strand=+; Position=83-391
  misc_feature: Homolog annotation: Hit_ID=XP_391876.1; Match level="QueryCoverage =99%, HitCoverage=56%, E-value=2e-42, Identity=79%"; Hit description =similar to dynactin 4 [Apis mellifera]
MELRDINYDKGEYVETASGNKVCRQTVLCGSQNIVLQGKVIVQSDAIIRGDLANVKTGRYCIISKEAVLRPPYKKFSKGVAFFPLSIGDHVYIGEKSLVNAAT

SEQ ID NO: 25833 - protein, 108 aa, Diabrotica virgifera
  misc_feature: Coding regions on vcDNA: vcDNA=SeqID_5530; Strand=+; Position=41-364
ACYRLTGENEYSDDLEYFLCQDKGGILRVERHRNSRPELLSSSGSEVQYIFSSKSNPGDVECVEIHSISTEKLKTSSFTTNLDTIFIVHGWNDSQDAYVNSHVRQYIL

SEQ ID NO: 25834 - protein, 36 aa, Diabrotica virgifera
  misc_feature: Coding regions on vcDNA: vcDNA=SeqID_5531; Strand=-; Position=1-108
  misc_feature (30)..(36): Xaa can be any naturally occurring amino acid
YVLLLMEEFVDVYVICQLSFLFMLLLLIKXXXXXXX

SEQ ID NO: 25835 - protein, 48 aa, Diabrotica virgifera
  misc_feature: Coding regions on vcDNA: vcDNA=SeqID_5532; Strand=-; Position=1-144
  misc_feature (4)..(13): Xaa can be any naturally occurring amino acid
  misc_feature (16)..(23): Xaa can be any naturally occurring amino acid
  misc_feature (26)..(45): Xaa can be any naturally occurring amino acid
NLNXXXXXXXXXXTNXXXXXXXXTYXXXXXXXXXXXXXXXXXXXXVCL

SEQ ID NO: 25836 - protein, 104 aa, Diabrotica virgifera
  misc_feature: Coding regions on vcDNA: vcDNA=SeqID_5533; Strand=+; Position=66-377
YGSSAALEHEPQCYGDDDPTSKPSNAPSTRQAMSLLTLYDRMVTLSMQYALPVIYVLRIPSVHVLSRMTVSMSPLVPVLSLDQRNAYQQICTYIRIPLVTKGAN

SEQ ID NO: 25837 - protein, 47 aa, Diabrotica virgifera
  misc_feature: Coding regions on vcDNA: vcDNA=SeqID_5534; Strand=+; Position=53-196
VYLTDRSLLLSQNTLFLAVIHVTFLYLAYQGRLLRQSIFSIYVLTGA

SEQ ID NO: 25838 - protein, 18 aa, Diabrotica virgifera
  misc_feature: Coding regions on vcDNA: vcDNA=SeqID_5535; Strand=-; Position=2-55
  misc_feature (4)..(10): Xaa can be any naturally occurring amino acid
FSLXXXXXXXNTVYAYVT

SEQ ID NO: 25839 - protein, 89 aa, Diabrotica virgifera
  misc_feature: Coding regions on vcDNA: vcDNA=SeqID_5536; Strand=+; Position=2-268
  misc_feature (70)..(77): Xaa can be any naturally occurring amino acid
NGLKNMIAQVLFISTIGAIAQAGLLHRGLDLGGSSYIGSHSIAVASEPVVEYFAPPKYEFKYGVQDWHTXXXXXXXXSTVGDLIQSDYS

SEQ ID NO: 25840 - protein, 33 aa, Diabrotica virgifera
  misc_feature: Coding regions on vcDNA: vcDNA=SeqID_5537; Strand=-; Position=2-100
QKLPEYCTIAHYSKLVGRSHDTSNVIRLSLGRC

SEQ ID NO: 25841 - protein, 127 aa, Diabrotica virgifera
  misc_feature: Coding regions on vcDNA: vcDNA=SeqID_5538; Strand=+; Position=1-381
  misc_feature (51)..(59): Xaa can be any naturally occurring amino acid
NKPNLEALLIQKNVYVAMLSETWFKPEKFYNFSGYNCFRSDRPDGYGGTAXXXXXXXXXEEINLLDNYNFTYTCMAVKISCIKKPIHIISVYKEPGIRVTVEEWVNFFQNIPSPFIIGGDFNAHNMA

SEQ ID NO: 25842 - protein, 41 aa, Diabrotica virgifera
  misc_feature: Coding regions on vcDNA: vcDNA=SeqID_5539; Strand=+; Position=3-125
RQSGDDDDDDDDDDDDDLDLGSPYFGGFLDDILGGDDEPSQ

SEQ ID NO: 25843 - protein, 57 aa, Diabrotica virgifera
  misc_feature: Coding regions on vcDNA: vcDNA=SeqID_5540; Strand=+; Position=35-208
ESFRPLSSLSFSLSSLSCMNHVNSIDEVCSRCTLARVNIYRLESHTRVYRITTVLRV

SEQ ID NO: 25844 - protein, 51 aa, Diabrotica virgifera
  misc_feature: Coding regions on vcDNA: vcDNA=SeqID_5541; Strand=+; Position=231-386
  misc_feature (17)..(26): Xaa can be any naturally occurring amino acid
NCFQLVLDMGNFNSVEXXXXXXXXXXKLEYSCLCKTYLKYRYFYLREKHNS

SEQ ID NO: 25845 - protein, 87 aa, Diabrotica virgifera
  misc_feature: Coding regions on vcDNA: vcDNA=SeqID_5542; Strand=+; Position=74-334
  misc_feature: Homolog annotation: Hit_ID=CAA27067.1; Match level="QueryCoverage =97%, HitCoverage=19%, E-value=4e-24, Identity=65%"; Hit description =unnamed protein product [Rattus norvegicus] sp|P04691|TBB1_RAT TUBULIN BETA CHAIN (T BETA-15)
  misc_feature: Gene Ontology Annotation: Molecular function=structural constituent of cytoskeleton; Cellular component=cytoskeleton; Biological process= microtubule-based process
  misc_feature (79)..(79): Xaa can be any naturally occurring amino acid
ITLREIVHIQARLCGNQFGPIFWESITDEYCIDPTGAYHEHTDRQREIISVYYNEVYRRQYVLGAIIVDLECGTMHSVXSGHFGQIF

SEQ ID NO: 25846 - protein, 133 aa, Diabrotica virgifera
  misc_feature: Coding regions on vcDNA: vcDNA=SeqID_5543; Strand=+; Position=3-401
  misc_feature: Homolog annotation: Hit_ID=BAC15603.1; Match level="QueryCoverage =99%, HitCoverage=19%, E-value=3e-53, Identity=75%"; Hit description =prophenoloxidase-II [Holotrichia diomphalia]
  misc_feature: Pfam annotation: Pfam_ID=Hemocyanin_M; Match level="Score=-66.9, E -value=0.00013, Copies=1"; Pfam description=Hemocyanin, copper containing domain
KLSNLKREQVQITMDIDDLERWRDRIFEAIQSGRVQGRNGETILLTENEGIDVLGNMIESSVLSPNRDIYGDLHNMGHVFLSYIHDPDHRHLESFGVMGDSATAMRDPVFYRWHAYIDYMFQTYKSALPRYTV

SEQ ID NO: 25847 - protein, 51 aa, Diabrotica virgifera
  misc_feature: Coding regions on vcDNA: vcDNA=SeqID_5544; Strand=-; Position=1-153
  misc_feature (16)..(21): Xaa can be any naturally occurring amino acid
YIDALISYYTPNFQKXXXXXXLRVFIKTLCSRNTFKKICAPASKLFTRRLM

SEQ ID NO: 25848 - protein, 36 aa, Diabrotica virgifera
  misc_feature: Coding regions on vcDNA: vcDNA=SeqID_5545; Strand=+; Position=40-147
CNTSTDISTSTNIFHRLTSSCTCYRTQHVIQQISYC

SEQ ID NO: 25849 - protein, 87 aa, Diabrotica virgifera
  misc_feature: Coding regions on vcDNA: vcDNA=SeqID_5546; Strand=-; Position=0-260
MAFTISFTNCEIVSYTIQVQRERAMFWYEWRDSAKIATDMYLIYNLQIAEIEDGNDMIDSYVKYLCENGAKTETYTDAINVGLKFGR

SEQ ID NO: 25850 - protein, 66 aa, Diabrotica virgifera
  misc_feature: Coding regions on vcDNA: vcDNA=SeqID_5547; Strand=-; Position=101-301
RLLNIIKLINLKMNFITNQIKSLKYSSNHSFQNSIAKLMTMLLSHGLNTAATRNTQCAGETLNLLQ

SEQ ID NO: 25851 - protein, 107 aa, Diabrotica virgifera
  misc_feature: Coding regions on vcDNA: vcDNA=SeqID_5548; Strand=-; Position=100-423
WIFGEVRQENLEEKHYILFMMKFRITEAKCTQEPNNALFVVNFFHYVMVENFVPRNQPFNIIQKTQVFSKIFSIYRKNREAVQISRHSEITNKEKSSSRIFCKIKVS

SEQ ID NO: 25852 - protein, 71 aa, Diabrotica virgifera
  misc_feature: Coding regions on vcDNA: vcDNA=SeqID_5549; Strand=-; Position=2-214
  misc_feature (11)..(22): Xaa can be any naturally occurring amino acid
  misc_feature (42)..(51): Xaa can be any naturally occurring amino acid
LLEIDIFNITXXXXXXXXXXXXNCRKAVRGAADPRPRFSHLXXXXXXXXXXSIFLFVLNLILNAFHPLQNL

SEQ ID NO: 25853 - protein, 69 aa, Diabrotica virgifera
  misc_feature: Coding regions on vcDNA: vcDNA=SeqID_5550; Strand=+; Position=2-211
  misc_feature (4)..(11): Xaa can be any naturally occurring amino acid
  misc_feature (55)..(66): Xaa can be any naturally occurring amino acid
RYNXXXXXXXXGMRLELNLIRINKWTELRNQLLAKIGERNDVWGQLHRAPPYDSXXXXXXXXXXXXLLC

SEQ ID NO: 25854 - protein, 97 aa, Diabrotica virgifera
  misc_feature: Coding regions on vcDNA: vcDNA=SeqID_5551; Strand=-; Position=2-292
  misc_feature (40)..(57): Xaa can be any naturally occurring amino acid
  misc_feature (91)..(97): Xaa can be any naturally occurring amino acid
HQFSRPSQNYPQCFRSFFLSLSLWSMSLLGFHRSFYFSGXXXXXXXXXXXXXXXXXXFPLHHLYQRFVVSITSLIIILFILLRHHRLPSKXXXXXXX

SEQ ID NO: 25855 - protein, 137 aa, Diabrotica virgifera
  misc_feature: Coding regions on vcDNA: vcDNA=SeqID_5552; Strand=+; Position=2-412
  misc_feature (40)..(49): Xaa can be any naturally occurring amino acid
TKGLKRTRETTEKKKSKHKKKKSSYSSSSDSQSSSDEGYXXXXXXXXXXYEYSSSSDSSDGDRSSKYKRSSYRSRSRSPPYKSNMESQESKLQKQESSAQREEWMNIQTKFLTSSNSDRKKERDEQKRLEREKQQYD

SEQ ID NO: 25856 - protein, 130 aa, Diabrotica virgifera
  misc_feature: Coding regions on vcDNA: vcDNA=SeqID_5553; Strand=+; Position=3-392
  misc_feature: Homolog annotation: Hit_ID=NP_788365.1; Match level="QueryCoverage =91%, HitCoverage=24%, E-value=1e-12, Identity=36%"; Hit description =CG8421-PE, isoform E [Drosophila melanogaster] ref|NP_725526.1| CG8421-PD, isoform D [Drosophila
DEGQDLDDKDGDEEEQEDDDQASNENDDTADTDDAKETEQDEDDGTDDNVKAADTTKEVKKPKKAEQKQEPEAEGEEKDNEGTVDSSGMAVKIGVGVALLVVAHLVLIKKWRNAEDEILPTEKAPPNIQD

SEQ ID NO: 25857 - protein, 62 aa, Diabrotica virgifera
  misc_feature: Coding regions on vcDNA: vcDNA=SeqID_5554; Strand=+; Position=156-341
  misc_feature (5)..(10): Xaa can be any naturally occurring amino acid
LNASXXXXXXFIKVYIGNESFMCYSEILAVAVYPSNRFFLSSEVFTFFLLVGTCRVKNLAYS

SEQ ID NO: 25858 - protein, 142 aa, Diabrotica virgifera
  misc_feature: Coding regions on vcDNA: vcDNA=SeqID_5555; Strand=+; Position=3-428
  misc_feature: Homolog annotation: Hit_ID=XP_394722.1; Match level="QueryCoverage =92%, HitCoverage=27%, E-value=1e-10, Identity=31%"; Hit description =similar to CG6379-PA [Apis mellifera]
  misc_feature (107)..(117): Xaa can be any naturally occurring amino acid
KIAAFCQNPTLVECRQEECRRKCLEFWNLPDKSKTALPQLSALQLVNLVLDKPEILLVQPRKVDHIEAFNELISDVEDWYYFPLYSSQKTNNCNFYAGVSGKVYRLXXXXXXXXXXXQLCRGTLLYGEFVKEKCLTTEGSKE

SEQ ID NO: 25859 - protein, 61 aa, Diabrotica virgifera
  misc_feature: Coding regions on vcDNA: vcDNA=SeqID_5556; Strand=+; Position=2-184
  misc_feature: Homolog annotation: Hit_ID=AAM28342.1; Match level="QueryCoverage =93%, HitCoverage=14%, E-value=1e-20, Identity=78%"; Hit description =LAR [Culicoides sonorensis]
  misc_feature: Gene Ontology Annotation: Molecular function=protein tyrosine phosphatase activity; Cellular component=integral to plasma membrane; Biological process=motor axon guidance
PRVREFKKLSNIKTDSSRFATANLPCNKHKNRLVHILPFETTKVCPTPLRNIESSDYINAN

SEQ ID NO: 25860 - protein, 101 aa, Diabrotica virgifera
  misc_feature: Coding regions on vcDNA: vcDNA=SeqID_5557; Strand=+; Position=39-344
FPCTFLTCGGSFRISRYILFLLLWNQKSLKNTACFFDNFEIVFIYRKFCLICCLGFLVTTIYVHLFLIDLKANFPGTSFKKDNFFCISGALYNCVDIVSKT

SEQ ID NO: 25861 - protein, 71 aa, Diabrotica virgifera
  misc_feature: Coding regions on vcDNA: vcDNA=SeqID_5558; Strand=+; Position=191-403
GATLIYRVIYNPFTYTLLDNGYECKHNLVIFTKKLVKFYISQGPIKVQCVSECILIKFDPLLKFLPLLLLH

SEQ ID NO: 25862 - protein, 103 aa, Diabrotica virgifera
  misc_feature: Coding regions on vcDNA: vcDNA=SeqID_5559; Strand=+; Position=89-398
  misc_feature: Homolog annotation: Hit_ID=XP_396673.1; Match level="QueryCoverage =93%, HitCoverage=90%, E-value=1e-36, Identity=75%"; Hit description =similar to ENSANGP00000015128 [Apis mellifera]
  misc_feature: Pfam annotation: Pfam_ID=UPF0139; Match level="Score=205.2, E-value =1.3e-58, Copies=1"; Pfam description=Uncharacterised protein family (UPF013
  misc_feature (72)..(72): Xaa can be any naturally occurring amino acid
HLISIEMNADPRRPEKVSRYVPKATNGTGQEDLTPDYMNILGMIFSMCGLMMRLKWCAWVALYCSCISFANXITDDTKQILSSFMLSISAIVMSYLQNRQPMT

SEQ ID NO: 25863 - protein, 31 aa, Diabrotica virgifera
  misc_feature: Coding regions on vcDNA: vcDNA=SeqID_5560; Strand=-; Position=136-231
AHLTLCIVNVCMTIWPNNCYVNIPQIISSCL

SEQ ID NO: 25864 - protein, 119 aa, Diabrotica virgifera
  misc_feature: Coding regions on vcDNA: vcDNA=SeqID_5561; Strand=+; Position=50-406
  misc_feature (2)..(10): Xaa can be any naturally occurring amino acid
  misc_feature (33)..(38): Xaa can be any naturally occurring amino acid
LXXXXXXXXXDKSVDVEIILTEYNSNTTKKSIXXXXXXYLKNKIFRPNSVINFERENTNILHGVVKTVIIGEIAGYDKSFVDFNNLNINWFVYKLDAEGPLLQNEEDGEEEVTISTQLM

SEQ ID NO: 25865 - protein, 110 aa, Diabrotica virgifera
  misc_feature: Coding regions on vcDNA: vcDNA=SeqID_5562; Strand=-; Position=0-329
  misc_feature (3)..(54): Xaa can be any naturally occurring amino acid
  misc_feature (63)..(100): Xaa can be any naturally occurring amino acid
LKXXXXXXXXXXXXXXXXXXXXXXXXXXXXXXXXXXXXXXXXXXXXXXXXXXXXLVIFKNDYXXXXXXXXXXXXXXXXXXXXXXXXXXXXXXXXXXXXXXDAWSDVWLAP

SEQ ID NO: 25866 - protein, 131 aa, Diabrotica virgifera
  misc_feature: Coding regions on vcDNA: vcDNA=SeqID_5563; Strand=+; Position=2-394
  misc_feature: Homolog annotation: Hit_ID=XP_314902.1; Match level="QueryCoverage =100%, HitCoverage=48%, E-value=2e-13, Identity=28%"; Hit description= ENSANGP00000024025 [Anopheles gambiae]
VNDIRSQINSKFLQFAEDLMIYIIIESVSYCEILQNDIKKIMAWCNWNQMSINVGKCHFISFCRRINNLFYNYKLTEEPLKAVSTVRDLGVQLHSKLNFCAHFDYVNNQAFNHVSFSITTSRCLHNINSIR

SEQ ID NO: 25867 - protein, 95 aa, Diabrotica virgifera
  misc_feature: Coding regions on vcDNA: vcDNA=SeqID_5564; Strand=+; Position=2-289
  misc_feature (65)..(70): Xaa can be any naturally occurring amino acid
  misc_feature (76)..(89): Xaa can be any naturally occurring amino acid
LLTWHFAKINAQDEECCNAYSHADAKEMENFLKQQGCTELSMKPVLANRTKFILSKPSASNESGXXXXXXQPLPPXXXXXXXXXXXXXXFSLSSF

SEQ ID NO: 25868 - protein, 48 aa, Diabrotica virgifera
  misc_feature: Coding regions on vcDNA: vcDNA=SeqID_5565; Strand=+; Position=188-334
  misc_feature (22)..(31): Xaa can be any naturally occurring amino acid
IYNKKYSRTIYKKWLNITKIIXXXXXXXXXXQHILPILYLFSLCYILC

SEQ ID NO: 25869 - protein, 125 aa, Diabrotica virgifera
  misc_feature: Coding regions on vcDNA: vcDNA=SeqID_5566; Strand=+; Position=2-376
  misc_feature: Homolog annotation: Hit_ID=XP_319555.1; Match level="QueryCoverage =92%, HitCoverage=26%, E-value=2e-14, Identity=33%"; Hit description =ENSANGP00000017837 [Anopheles gambiae]
PVKIRPFYSEVTKGWVMPFAGHDRKIMQETQKYFYEKESQRPINGQVLMSVTSIFTLIYINIVLLTLFALAQFSFTRNWLIEYPQIFSFGYVKKEEHPSEEVKAGGRYRLTLYGEGWKEKLANVN

SEQ ID NO: 25870 - protein, 47 aa, Diabrotica virgifera
  misc_feature: Coding regions on vcDNA: vcDNA=SeqID_5567; Strand=-; Position=2-142
  misc_feature (35)..(41): Xaa can be any naturally occurring amino acid
MFQSIKSSRMIWIDTCTVHILCMSIQSLNTSSEMXXXXXXXFCMWSN

SEQ ID NO: 25871 - protein, 33 aa, Diabrotica virgifera
  misc_feature: Coding regions on vcDNA: vcDNA=SeqID_5568; Strand=+; Position=1-102
IKRHCLTDIALRTNLIVEVVNNLIQRYFDNFVQ

SEQ ID NO: 25872 - protein, 40 aa, Diabrotica virgifera
  misc_feature: Coding regions on vcDNA: vcDNA=SeqID_5569; Strand=-; Position=152-274
  misc_feature: Homolog annotation: Hit_ID=NP_569933.2; Match level="QueryCoverage =95%, HitCoverage=6%, E-value=3e-10, Identity=71%"; Hit description =CG3095-PA [Drosophila melanogaster] gb|AAF45654.3| CG3095-PA [Drosophila melanogaster]
FLLVSLLTKVFCGYWVFMTAGYLPWPGGKFPKLPWDWLCG

SEQ ID NO: 25873 - protein, 66 aa, Diabrotica virgifera
  misc_feature: Coding regions on vcDNA: vcDNA=SeqID_5570; Strand=+; Position=53-253
IIINKSSFCISQQLTAIILYKALPNSTFQGRCREGRQRVSGKLSFGLHGPILRTLNRMSEIRCRIE

SEQ ID NO: 25874 - protein, 94 aa, Diabrotica virgifera
  misc_feature: Coding regions on vcDNA: vcDNA=SeqID_5571; Strand=+; Position=22-306
  misc_feature: Homolog annotation: Hit_ID=XP_396248.1; Match level="QueryCoverage =96%, HitCoverage=5%, E-value=4e-13, Identity=40%"; Hit description =similar to CG31009-PA [Apis mellifera]
  misc_feature: Gene Ontology Annotation: Molecular function=calcium-dependent cell adhesion molecule activity; Cellular component=integral to plasma membrane; Biological process=calcium-dependent cell-cell adhesion
  misc_feature (23)..(23): Xaa can be any naturally occurring amino acid
  misc_feature (57)..(57): Xaa can be any naturally occurring amino acid
LAFTVRVYINVADISETSPEIVXDPYHLTVRECLCRTPVGFVQATDAYERVTAQVTXFIPSHLPFEIDNDSGKITTNTPLDYDKLRDYQLVVTA

SEQ ID NO: 25875 - protein, 93 aa, Diabrotica virgifera
  misc_feature: Coding regions on vcDNA: vcDNA=SeqID_5572; Strand=+; Position=149-427
  misc_feature: Homolog annotation: Hit_ID=XP_393066.1; Match level="QueryCoverage =91%, HitCoverage=65%, E-value=3e-17, Identity=54%"; Hit description =similar to poly(A) binding protein II [Apis mellifera]
  misc_feature: Gene Ontology Annotation: Molecular function=RNA binding; Cellular component=nucleus; Biological process=muscle contraction
  misc_feature (36)..(43): Xaa can be any naturally occurring amino acid
MADNEDLGLGEDHIDSFEDANGMHDENLLNDTDGDXXXXXXXXLEAIKARVLEMEQHAEKLKQLQNEVDKQMHMGSPPGLTSTLNKSLEEKME

SEQ ID NO: 25876 - protein, 89 aa, Diabrotica virgifera
  misc_feature: Coding regions on vcDNA: vcDNA=SeqID_5573; Strand=-; Position=2-268
SSNKKDSLILKRVNELKMYKHSQFLCKTKMQQLHNILVKAESAGRVYTGFGDLFPLISKPISSSLRFNHLPQLRAFPNCKERNVTDELG

SEQ ID NO: 25877 - protein, 119 aa, Diabrotica virgifera
  misc_feature: Coding regions on vcDNA: vcDNA=SeqID_5574; Strand=+; Position=32-388
  misc_feature: Homolog annotation: Hit_ID=CAC51706.1; Match level="QueryCoverage =99%, HitCoverage=20%, E-value=4e-19, Identity=44%"; Hit description =NADH dehydrogenase subunit 5 [Tribolium castaneum] ref|NP _203162.1|ND5_15766 NADH dehydrogenase subunit 5
  misc_feature (85)..(85): Xaa can be any naturally occurring amino acid
  misc_feature (93)..(93): Xaa can be any naturally occurring amino acid
VYVIGYLVLIFNSRFFTIVILLALNIFMDLYQFDLVIASAQAYNSDEYIISDLINDRFSLRLVIFVFSVLVLTITPNLISILLSXHGSRLVSXCLVIYYQGISTFNAGKSTASSNRLGD

SEQ ID NO: 25878 - protein, 51 aa, Diabrotica virgifera
  misc_feature: Coding regions on vcDNA: vcDNA=SeqID_5575; Strand=-; Position=179-334
  misc_feature (4)..(16): Xaa can be any naturally occurring amino acid
  misc_feature (39)..(50): Xaa can be any naturally occurring amino acid
AHPXXXXXXXXXXXXXLSILILNKLNLLRQKLDISKNDXXXXXXXXXXXXR

SEQ ID NO: 25879 - protein, 52 aa, Diabrotica virgifera
  misc_feature: Coding regions on vcDNA: vcDNA=SeqID_5576; Strand=-; Position=58-216
KFCLNVLNFLYRFQIRKKNGIKMVMYLSSYIKVFKIGCQMTEQSIFKMRDAM

SEQ ID NO: 25880 - protein, 81 aa, Diabrotica virgifera
  misc_feature: Coding regions on vcDNA: vcDNA=SeqID_5577; Strand=+; Position=118-360
PIAIFTAILPICAHDIYSMQLSALITSRLMRHRHRRVSHSPDILPAYGADRYKNAFSIGCNCHTTRLPMTTWRNQICSGRH

SEQ ID NO: 25881 - protein, 106 aa, Diabrotica virgifera
  misc_feature: Coding regions on vcDNA: vcDNA=SeqID_5578; Strand=+; Position=100-417
RSRFPSTSRTPLRQSIIDQPIILTDITEHLHPITDDIHYQHHLINQQIHFLIDQLTYHHNLSTREFEQYIVKGQVVPQELVSHQRLIYHHLHDVIEPLTSQQIFIN

SEQ ID NO: 25882 - protein, 128 aa, Diabrotica virgifera
  misc_feature: Coding regions on vcDNA: vcDNA=SeqID_5579; Strand=+; Position=1-384
RTRGLNYDNVQYVADNNIDQGAGQQHYNPQQYYYLQQQYQAPTTSIQAVVDPKGGLQYIMYIPTYVSNQGSQQQSTDQTQNYENVVYSDNDQTYQQPQSSPQYTTYTEKQPLLKLARAHTMLKLQTSL

SEQ ID NO: 25883 - protein, 28 aa, Diabrotica virgifera
  misc_feature: Coding regions on vcDNA: vcDNA=SeqID_5580; Strand=-; Position=1-84
  misc_feature (18)..(25): Xaa can be any naturally occurring amino acid
VRPFDQSHCLVRTARSHXXXXXXXXCCN

SEQ ID NO: 25884 - protein, 94 aa, Diabrotica virgifera
  misc_feature: Coding regions on vcDNA: vcDNA=SeqID_5581; Strand=+; Position=3-287
  misc_feature (9)..(15): Xaa can be any naturally occurring amino acid
  misc_feature (33)..(75): Xaa can be any naturally occurring amino acid
SRHASDMSXXXXXXXYCFFFCTLCIFVELGLPXXXXXXXXXXXXXXXXXXXXXXXXXXXXXXXXXXXXXXXXXXXVTELKVKGRRFTKSRLENP

SEQ ID NO: 25885 - protein, 116 aa, Diabrotica virgifera
  misc_feature: Coding regions on vcDNA: vcDNA=SeqID_5582; Strand=+; Position=49-396
  misc_feature: Homolog annotation: Hit_ID=EAL34303.1; Match level="QueryCoverage =82%, HitCoverage=28%, E-value=1e-26, Identity=57%"; Hit description =GA19730-PA [Drosophila pseudoobscura]
  misc_feature: Gene Ontology Annotation: Molecular function=protein serine/threonine kinase activity; Cellular component=midbody; Biological process =establishment and/or maintenance of chromatin architecture
MSSNKENRINKQVEQYVSKLKIPKQIDQDMRNLVKSMISHDAFGNTNYKWSINDFELGGRLGRGKFGRVYIAREKKTGFVVALKTLFKKEIVKGRVERQTLREIEIQSHLKHPNIL

SEQ ID NO: 25886 - protein, 45 aa, Diabrotica virgifera
  misc_feature: Coding regions on vcDNA: vcDNA=SeqID_5583; Strand=-; Position=25-162
  misc_feature (18)..(24): Xaa can be any naturally occurring amino acid
  misc_feature (31)..(39): Xaa can be any naturally occurring amino acid
AASSSKLEPNTYLVINHXXXXXXXQKLNCPXXXXXXXXXLLLKYH

SEQ ID NO: 25887 - protein, 95 aa, Diabrotica virgifera
  misc_feature: Coding regions on vcDNA: vcDNA=SeqID_5584; Strand=+; Position=69-353
  misc_feature (41)..(47): Xaa can be any naturally occurring amino acid
SVCIQRFGLNMKACDLLLWFCLFIATATSQFINSEHINSTXXXXXXXTSYKCTLPQFPPNGRWIIINGEGYPGDEIEVNTILQIECKDGYRLHPN

SEQ ID NO: 25888 - protein, 109 aa, Diabrotica virgifera
  misc_feature: Coding regions on vcDNA: vcDNA=SeqID_5585; Strand=+; Position=58-384
  misc_feature: Homolog annotation: Hit_ID=XP_396542.1; Match level="QueryCoverage =92%, HitCoverage=12%, E-value=2e-37, Identity=71%"; Hit description =similar to ENSANGP00000016041 [Apis mellifera]
  misc_feature: Gene Ontology Annotation: Molecular function=molecular_function unknown; Cellular component=cellular_component unknown; Biological process=response to arsenate
MGAHTEGQQPPMMSFKAFLATQDDNISDSEAIEKYNDYKLEFQRQQLNEFFVAHKDDEWFRLKYHPEESVKRKEEQKAALKRRVDVFIELLNAGKIECVKVDCAETNKL

SEQ ID NO: 25889 - protein, 97 aa, Diabrotica virgifera
  misc_feature: Coding regions on vcDNA: vcDNA=SeqID_5586; Strand=+; Position=14-304
  misc_feature: Homolog annotation: Hit_ID=AAK17096.1; Match level="QueryCoverage =81%, HitCoverage=85%, E-value=2e-18, Identity=53%"; Hit description =ribosomal protein L37 [Emericella nidulans] gb|AAK17097.1| ribosomal protein L37 [Emericella nidulans] sp|
  misc_feature: Pfam annotation: Pfam_ID=Ribosomal_L37e; Match level="Score=45.2, E -value=1.8e-10, Copies=1"; Pfam description=Ribosomal protein L37e
  misc_feature (40)..(40): Xaa can be any naturally occurring amino acid
MSRSMSGFRLHTATRSVNLTNCIASIGKRYTWMHSQCSRXGLRSYHNHQETCASCGYSISKVRSYNWVETANMRRTTGTGRTVHLRDVERPFHFGFR

SEQ ID NO: 25890 - protein, 65 aa, Diabrotica virgifera
  misc_feature: Coding regions on vcDNA: vcDNA=SeqID_5587; Strand=-; Position=15-212
  misc_feature (59)..(59): Xaa can be any naturally occurring amino acid
  misc_feature (64)..(64): Xaa can be any naturally occurring amino acid
TLYLREYPTIAIEYPHEGRAPRLSALNVNLPHSIGATYLFRDYQIKSRFTALYWLVPLXLVSRXF

SEQ ID NO: 25891 - protein, 97 aa, Diabrotica virgifera
  misc_feature: Coding regions on vcDNA: vcDNA=SeqID_5588; Strand=-; Position=3-293
  misc_feature (5)..(48): Xaa can be any naturally occurring amino acid
PLGGXXXXXXXXXXXXXXXXXXXXXXXXXXXXXXXXXXXXXXXXXXXXYFSRYKNTFHKLHLVLLYLNSIQKCFHHCSYFRYTEIHIKKSHAFIRLS

SEQ ID NO: 25892 - protein, 81 aa, Diabrotica virgifera
  misc_feature: Coding regions on vcDNA: vcDNA=SeqID_5589; Strand=+; Position=2-247
  misc_feature (3)..(9): Xaa can be any naturally occurring amino acid
  misc_feature (27)..(33): Xaa can be any naturally occurring amino acid
  misc_feature (36)..(42): Xaa can be any naturally occurring amino acid
  misc_feature (72)..(81): Xaa can be any naturally occurring amino acid
QHXXXXXXXRPIRIYYISLKTRYNSIXXXXXXXNVXXXXXXXLIVIKVSKLLSIIPVVPSTFNVRLNYYLHXXXXXXXXXX

SEQ ID NO: 25893 - protein, 117 aa, Diabrotica virgifera
  misc_feature: Coding regions on vcDNA: vcDNA=SeqID_5590; Strand=+; Position=1-351
  misc_feature: Homolog annotation: Hit_ID=EAA09199.3; Match level="QueryCoverage =94%, HitCoverage=55%, E-value=2e-14, Identity=39%"; Hit description =ENSANGP00000003674 [Anopheles gambiae str. PEST] ref|XP_562114.1| ENSANGP00000003674 [Anopheles gambiae st
STQDSRKSLNRCVSDGKGQYIKYEFSCAEGTVWDQDALACNYPSAVTGECSQSSQSQSNGDQQGSSNNNQNQQGSGNQNQQGNGNQNQQGSGNQNQQGSHSQNQQNNGHQNQQRSGN

SEQ ID NO: 25894 - protein, 38 aa, Diabrotica virgifera
  misc_feature: Coding regions on vcDNA: vcDNA=SeqID_5591; Strand=+; Position=35-151
VLWMLVTCSAHDLSHIKRIDRRFASCRSLQERGRGSCM

SEQ ID NO: 25895 - protein, 79 aa, Diabrotica virgifera
  misc_feature: Coding regions on vcDNA: vcDNA=SeqID_5592; Strand=+; Position=70-306
LMRNLGMTAERASGAYHGKIPSGRAADTGVTRVQHVRAVWPPELECLYQGFPRIIVGKMLATVFWNEVGDVSFVELFYD

SEQ ID NO: 25896 - protein, 61 aa, Diabrotica virgifera
  misc_feature: Coding regions on vcDNA: vcDNA=SeqID_5593; Strand=-; Position=201-386
  misc_feature (25)..(32): Xaa can be any naturally occurring amino acid
CSFFQSICGESRERLNFLFEKLIDXXXXXXXXQLVFTSHIGYVIRGDHYLQNPSLSRKVKR

SEQ ID NO: 25897 - protein, 69 aa, Diabrotica virgifera
  misc_feature: Coding regions on vcDNA: vcDNA=SeqID_5594; Strand=-; Position=3-209
LYNELYKHQSKSLLLLHHHLSLTVLKIFLLLRLIFENQSMLFIMNLLTSYVSNSWYCCISCINTTLYRE

SEQ ID NO: 25898 - protein, 49 aa, Diabrotica virgifera
  misc_feature: Coding regions on vcDNA: vcDNA=SeqID_5595; Strand=+; Position=3-152
CESQPGICQHGVTRPFETAASDHVVLVGESYLLTVFYDSGRADLIIGES

SEQ ID NO: 25899 - protein, 40 aa, Diabrotica virgifera
  misc_feature: Coding regions on vcDNA: vcDNA=SeqID_5596; Strand=+; Position=93-212
MPRKFDPTVVGGVYMRCVGGEVGATSSLARTVGRLGLYPG

SEQ ID NO: 25900 - protein, 56 aa, Diabrotica virgifera
  misc_feature: Coding regions on vcDNA: vcDNA=SeqID_5597; Strand=+; Position=22-192
LLKDRQIAIASLVVSFYRCYQACPLFCLMVVVIVNLGGYFKGNVAVSWIYQMLIRF

SEQ ID NO: 25901 - protein, 51 aa, Diabrotica virgifera
  misc_feature: Coding regions on vcDNA: vcDNA=SeqID_5598; Strand=+; Position=3-158
PTRPFTPKMQKAQVGTMSPLFLEVSFNHSPIFMKIDGGSTKSEVITHIHLH

SEQ ID NO: 25902 - protein, 35 aa, Diabrotica virgifera
  misc_feature: Coding regions on vcDNA: vcDNA=SeqID_5599; Strand=-; Position=1-105
RSRRRMVRRLTVLTALTTPPARTRYAPPPTELPFG

SEQ ID NO: 25903 - protein, 77 aa, Diabrotica virgifera
  misc_feature: Coding regions on vcDNA: vcDNA=SeqID_5600; Strand=-; Position=2-232
IVSPGKRKCPGLKQSLKRWSDYGEKFKVLHCGNGMCKISKRWLPTHPWKPPLLVCMVQFFMTSFIAVLWSQFVGNAF

SEQ ID NO: 25904 - protein, 51 aa, Diabrotica virgifera
  misc_feature: Coding regions on vcDNA: vcDNA=SeqID_5601; Strand=+; Position=2-157
  misc_feature (4)..(28): Xaa can be any naturally occurring amino acid
SLYXXXXXXXXXXXXXXXXXXXXXXXXXAQQDDSCLIPHGCDIILLQYSQL

SEQ ID NO: 25905 - protein, 35 aa, Diabrotica virgifera
  misc_feature: Coding regions on vcDNA: vcDNA=SeqID_5602; Strand=-; Position=2-106
SVRPRGTKSQICPFLKAEILSQHFSVTIVKEKIPG

SEQ ID NO: 25906 - protein, 115 aa, Diabrotica virgifera
  misc_feature: Coding regions on vcDNA: vcDNA=SeqID_5603; Strand=+; Position=1-345
  misc_feature: Homolog annotation: Hit_ID=EAL25931.1; Match level="QueryCoverage =96%, HitCoverage=18%, E-value=6e-30, Identity=59%"; Hit description =GA20875-PA [Drosophila pseudoobscura]
  misc_feature: Gene Ontology Annotation: Molecular function=polypeptide N -acetylgalactosaminyltransferase activity; Cellular component =integral to membrane; Biological process=O-linked glycosylation
PTRPVILRTVWSVILQTPSHLLEEIILVDDSSTDESLKGLLDYYLETRLANYKIKMVRLKHRLGLIRARLQGARVAQGDVLIFLDAHCEATTSWAEPMLSKIEEDRTAVLVPNID

SEQ ID NO: 25907 - protein, 68 aa, Diabrotica virgifera
  misc_feature: Coding regions on vcDNA: vcDNA=SeqID_5604; Strand=+; Position=3-209
CLKITHYVDYLSLVARGRESSMVELSVSTMFTFQDCYCTWSVSTRTREVDKCDECPACYHEVVYGLAM

SEQ ID NO: 25908 - protein, 22 aa, Diabrotica virgifera
  misc_feature: Coding regions on vcDNA: vcDNA=SeqID_5605; Strand=-; Position=15-83
  misc_feature (21)..(21): Xaa can be any naturally occurring amino acid
LKTRPNSESFKLVLLRVVSRXF

SEQ ID NO: 25909 - protein, 40 aa, Diabrotica virgifera
  misc_feature: Coding regions on vcDNA: vcDNA=SeqID_5606; Strand=-; Position=44-166
LYCVKKSFYYSCENALSRKGKIKSSQKFDWKYHSFKRYRQ

SEQ ID NO: 25910 - protein, 19 aa, Diabrotica virgifera
  misc_feature: Coding regions on vcDNA: vcDNA=SeqID_5607; Strand=-; Position=0-56
  misc_feature (1)..(16): Xaa can be any naturally occurring amino acid
XXXXXXXXXXXXXXXXIKR

SEQ ID NO: 25911 - protein, 59 aa, Diabrotica virgifera
  misc_feature: Coding regions on vcDNA: vcDNA=SeqID_5608; Strand=-; Position=40-219
HNLSILAMYAPMINSEMYHPYYMIHRSVSRRHELVNMVTDKADQTRRKTHSYITIKPQL

SEQ ID NO: 25912 - protein, 61 aa, Diabrotica virgifera
  misc_feature: Coding regions on vcDNA: vcDNA=SeqID_5609; Strand=-; Position=2-184
KGVYLMFITIMDTIPEKVVQVIALIENRFSQRGVARQLYMISATVQIVFQRYEETGFFRRQ

SEQ ID NO: 25913 - protein, 53 aa, Diabrotica virgifera
  misc_feature: Coding regions on vcDNA: vcDNA=SeqID_5610; Strand=+; Position=60-218
LTANLSHESNDHSTTNTSSVAVYEGLACFTGLDAGQLTCAPHVLGIATDCLNM

SEQ ID NO: 25914 - protein, 143 aa, Diabrotica virgifera
  misc_feature: Coding regions on vcDNA: vcDNA=SeqID_5611; Strand=+; Position=2-430
  misc_feature (125)..(125): Xaa can be any naturally occurring amino acid
KNKSERTYVKVKKETTLRSLLSIIQYLTDKCFRTSTPPRAETVVSPRKRFLREMEKDKVPGDDNSQKRSRSKSQANQSISGVPHASLSAPLIGSPVVSNGVEETKPLRNSSYSITSLLAEDRNVXRSPTSSPSHYPLAHPQYC

SEQ ID NO: 25915 - protein, 50 aa, Diabrotica virgifera
  misc_feature: Coding regions on vcDNA: vcDNA=SeqID_5612; Strand=-; Position=23-175
LSGLWNCILNTSMVMLVRNTTNSVQLMINWTTLLNEVLAEVDHIKMLHAS

SEQ ID NO: 25916 - protein, 67 aa, Diabrotica virgifera
  misc_feature: Coding regions on vcDNA: vcDNA=SeqID_5613; Strand=+; Position=85-288
NMNSYAIYTYFCSLYYFHDLCTYIQDIVQSHSGCGCKKFRPFKRFLNAHTKSTYYIMFRFHHVHHHQ

SEQ ID NO: 25917 - protein, 126 aa, Diabrotica virgifera
  misc_feature: Coding regions on vcDNA: vcDNA=SeqID_5614; Strand=+; Position=2-382
LTVKYRLKGMSKIKQIDWGLPKHHRKSPMAAWTWLSISFDPKDGIIRLDLDCDPSRFETIKQKKHLGNFSVPFDSLVYFGQEPGRKKKFLGSIQVAKVLPYILEQRLWSCVQIATNLSPEFRKPVS

SEQ ID NO: 25918 - protein, 50 aa, Diabrotica virgifera
  misc_feature: Coding regions on vcDNA: vcDNA=SeqID_5615; Strand=-; Position=1-150
IVNSVTTINTDSNLEASAVVVNVRKKAKPHLAWMILFNPSSKYLTHGGRL

SEQ ID NO: 25919 - protein, 53 aa, Diabrotica virgifera
  misc_feature: Coding regions on vcDNA: vcDNA=SeqID_5616; Strand=+; Position=22-183
ANQMVPEVKKGILAHDDDSRAALATAGLAEQNSHDPEVRLKDSLVYCLGHSRE

SEQ ID NO: 25920 - protein, 55 aa, Diabrotica virgifera
  misc_feature: Coding regions on vcDNA: vcDNA=SeqID_5617; Strand=-; Position=0-164
  misc_feature (46)..(52): Xaa can be any naturally occurring amino acid
QAGICPCHTMINNSMSGRLILGWNVTPTISMSIHKRYIDSCYNLTXXXXXXXGVV

SEQ ID NO: 25921 - protein, 27 aa, Diabrotica virgifera
  misc_feature: Coding regions on vcDNA: vcDNA=SeqID_5618; Strand=-; Position=25-108
TITIIPVARTSDLRLTHRYKMLCAVTC

SEQ ID NO: 25922 - protein, 69 aa, Diabrotica virgifera
  misc_feature: Coding regions on vcDNA: vcDNA=SeqID_5619; Strand=+; Position=2-211
  misc_feature (31)..(37): Xaa can be any naturally occurring amino acid
  misc_feature (48)..(59): Xaa can be any naturally occurring amino acid
NKSDNIFINTLHFVYNSSNIFCHVLFICSGXXXXXXXFSKFQGLSLKXXXXXXXXXXXXINDHFKDVYR

SEQ ID NO: 25923 - protein, 52 aa, Diabrotica virgifera
  misc_feature: Coding regions on vcDNA: vcDNA=SeqID_5620; Strand=-; Position=2-157
  misc_feature (23)..(30): Xaa can be any naturally occurring amino acid
  misc_feature (40)..(47): Xaa can be any naturally occurring amino acid
NLKVQDFRLINFNIPKNCPFLIXXXXXXXXSKCQCQLLSXXXXXXXXFRVLY

SEQ ID NO: 25924 - protein, 45 aa, Diabrotica virgifera
  misc_feature: Coding regions on vcDNA: vcDNA=SeqID_5621; Strand=+; Position=10-144
ALALTIPGIHIYNVPHIFALRSSMDTFIGMLWLINLNSCAFKVYS

SEQ ID NO: 25925 - protein, 52 aa, Diabrotica virgifera
  misc_feature: Coding regions on vcDNA: vcDNA=SeqID_5622; Strand=-; Position=56-214
EFLLEVWTLQLDEGSIPHVTYFFNRHESIQKMFSNLNWFRKVKFACLLPQVN

SEQ ID NO: 25926 - protein, 60 aa, Diabrotica virgifera
  misc_feature: Coding regions on vcDNA: vcDNA=SeqID_5623; Strand=+; Position=83-265
  misc_feature (37)..(47): Xaa can be any naturally occurring amino acid
LQIHGTKAPTQTLFKYIVLFMLQLISPTWRIDFDIVXXXXXXXXXXXVCFLRMLLCECVS

SEQ ID NO: 25927 - protein, 39 aa, Diabrotica virgifera
  misc_feature: Coding regions on vcDNA: vcDNA=SeqID_5624; Strand=-; Position=187-306
SIEPSGDYIKPTRYNMDALDSVHNINCLYYFNNSHLCTR

SEQ ID NO: 25928 - protein, 83 aa, Diabrotica virgifera
  misc_feature: Coding regions on vcDNA: vcDNA=SeqID_5625; Strand=+; Position=3-254
RVQITLIIVIFFTGTGSIPLEQSDHTNQSNHIITNKDGCLSCKIPNNTPEPPSCGPCQSLVFNKCKNTFNKQCPRNPPARQAN

SEQ ID NO: 25929 - protein, 142 aa, Diabrotica virgifera
  misc_feature: Coding regions on vcDNA: vcDNA=SeqID_5626; Strand=+; Position=1-426
  misc_feature: Homolog annotation: Hit_ID=AAP44994.2; Match level="QueryCoverage =99%, HitCoverage=83%, E-value=4e-17, Identity=42%"; Hit description =x-type HMW glutenin subunit Ee2.1 [Thinopyrum elongatum]
FENQPQGHYNQQPTPISGFYHQNGQYQPAGQYQQTGQYQQTGQYQQPGQYQQPGQYHQSGQIKQVQQPGPLQQGQYYQSSKSQSSGQHQQPGQYQPTDQYQQTGQYQQPGQQVSVQQLTNPNQIDYTGAYSEKQNSYANPTP

SEQ ID NO: 25930 - protein, 59 aa, Diabrotica virgifera
  misc_feature: Coding regions on vcDNA: vcDNA=SeqID_5627; Strand=+; Position=1-180
  misc_feature (5)..(17): Xaa can be any naturally occurring amino acid
NPVNXXXXXXXXXXXXXRAPRLSQESCHNYTGNRREFIAMLIYLQIMSSGRQGSISIYS

SEQ ID NO: 25931 - protein, 95 aa, Diabrotica virgifera
  misc_feature: Coding regions on vcDNA: vcDNA=SeqID_5628; Strand=+; Position=91-375
  misc_feature: Homolog annotation: Hit_ID=EAL29952.1; Match level="QueryCoverage =100%, HitCoverage=24%, E-value=1e-26, Identity=64%"; Hit description= GA21576-PA [Drosophila pseudoobscura]
  misc_feature: Gene Ontology Annotation: Molecular function=acetyl-CoA C -acetyltransferase activity; Cellular component=cytoplasm; Biological process=lipid metabolism
  misc_feature: Pfam annotation: Pfam_ID=Thiolase_N; Match level="Score=-69.4, E -value=9e-07, Copies=1"; Pfam description=Thiolase, N-terminal domain
MSDVYIVAACRTPIGSFQGQFEKHSAVDLGAVVIAEAIKRANLQPEDVHKVIMGQVLTAGQGQNPARQAALAAKIPTTCPALKLDFLCGSGLSTV

SEQ ID NO: 25932 - protein, 88 aa, Diabrotica virgifera
  misc_feature: Coding regions on vcDNA: vcDNA=SeqID_5629; Strand=+; Position=3-269
  misc_feature (73)..(82): Xaa can be any naturally occurring amino acid
DDYNCLVTVTIGQKYPIKKPTVLRSSLYCPESKACSTILPNIPKNPTLKPKVNVEHLIEFLHDAVLMFKNHRXXXXXXXXXXYTVLFE

SEQ ID NO: 25933 - protein, 89 aa, Diabrotica virgifera
  misc_feature: Coding regions on vcDNA: vcDNA=SeqID_5630; Strand=+; Position=1-267
  misc_feature (12)..(27): Xaa can be any naturally occurring amino acid
  misc_feature (34)..(44): Xaa can be any naturally occurring amino acid
  misc_feature (50)..(66): Xaa can be any naturally occurring amino acid
  misc_feature (72)..(89): Xaa can be any naturally occurring amino acid
LRKNLINGNLIXXXXXXXXXXXXXXXXGTWGTRXXXXXXXXXXXPNLKNXXXXXXXXXXXXXXXXXVRKCNXXXXXXXXXXXXXXXXXX

SEQ ID NO: 25934 - protein, 141 aa, Diabrotica virgifera
  misc_feature: Coding regions on vcDNA: vcDNA=SeqID_5631; Strand=-; Position=1-423
  misc_feature (4)..(36): Xaa can be any naturally occurring amino acid
  misc_feature (38)..(44): Xaa can be any naturally occurring amino acid
  misc_feature (60)..(92): Xaa can be any naturally occurring amino acid
  misc_feature (99)..(111): Xaa can be any naturally occurring amino acid
  misc_feature (119)..(137): Xaa can be any naturally occurring amino acid
FYSXXXXXXXXXXXXXXXXXXXXXXXXXXXXXXXXXCXXXXXXXLLKNLVFFKTNTISLXXXXXXXXXXXXXXXXXXXXXXXXXXXXXXXXXPGSPGSXXXXXXXXXXXXXSHYYLPSXXXXXXXXXXXXXXXXXXXERLS

SEQ ID NO: 25935 - protein, 103 aa, Diabrotica virgifera
  misc_feature: Coding regions on vcDNA: vcDNA=SeqID_5632; Strand=+; Position=46-354
  misc_feature (92)..(101): Xaa can be any naturally occurring amino acid
TPKLLREQNNNFPNKLIVKLEGEPGYQCHFNIKRPNDLGLENGNGCYSDGHNIVICKLGTKLDNLTRSISVNFDKLPSPNLNYSTLDIIFEXXXXXXXXXXSD

SEQ ID NO: 25936 - protein, 52 aa, Diabrotica virgifera
  misc_feature: Coding regions on vcDNA: vcDNA=SeqID_5633; Strand=+; Position=3-161
AKTGPTFTNNNLVDNRTGNFLENHYHGQRNLPGKAPNLQRMMEKHGPLGKWL

SEQ ID NO: 25937 - protein, 93 aa, Diabrotica virgifera
  misc_feature: Coding regions on vcDNA: vcDNA=SeqID_5634; Strand=+; Position=3-284
PPTRQVHPAFSISIVDGHCAMLVYPSVGIYVSIQRMIDLQRMSPYTCMVIINAWTSCFSVCYPAVYPICYLIYSVRSTAICSLVTITTSNMYR

SEQ ID NO: 25938 - protein, 36 aa, Diabrotica virgifera
  misc_feature: Coding regions on vcDNA: vcDNA=SeqID_5635; Strand=-; Position=0-107
SYKKASKIRQLHLLICQSTHWHFPICLLTQSILGIS

SEQ ID NO: 25939 - protein, 99 aa, Diabrotica virgifera
  misc_feature: Coding regions on vcDNA: vcDNA=SeqID_5636; Strand=+; Position=3-299
  misc_feature (3)..(84): Xaa can be any naturally occurring amino acid
  misc_feature (87)..(87): Xaa can be any naturally occurring amino acid
  misc_feature (89)..(89): Xaa can be any naturally occurring amino acid
  misc_feature (93)..(93): Xaa can be any naturally occurring amino acid
  misc_feature (95)..(95): Xaa can be any naturally occurring amino acid
MNXXXXXXXXXXXXXXXXXXXXXXXXXXXXXXXXXXXXXXXXXXXXXXXXXXXXXXXXXXXXXXXXXXXXXXXXXXXXXXXXXXNCXLXTCLXVXNIKS

SEQ ID NO: 25940 - protein, 130 aa, Diabrotica virgifera
  misc_feature: Coding regions on vcDNA: vcDNA=SeqID_5637; Strand=+; Position=4-396
RVYIAEGLIEPSNGTTIIRTGWWIKEIKQAVKRKKEMWKRYINTNQEQDRDEYRRQRNIVKELVKDAKKKSWKELGEELNEGFGNNNKQFWNKIRSMKGTKRKQIRGIRNERNELKTNIQDILTIWNKHY

SEQ ID NO: 25941 - protein, 64 aa, Diabrotica virgifera
  misc_feature: Coding regions on vcDNA: vcDNA=SeqID_5638; Strand=-; Position=137-331
  misc_feature (6)..(12): Xaa can be any naturally occurring amino acid
  misc_feature (44)..(50): Xaa can be any naturally occurring amino acid
LITNLXXXXXXXWRKEIENINQYAIFFRNLMLKSFKDADYKHSXXXXXXXKIANSIWRKEIILS

SEQ ID NO: 25942 - protein, 85 aa, Diabrotica virgifera
  misc_feature: Coding regions on vcDNA: vcDNA=SeqID_5639; Strand=-; Position=8-265
YNLTDQSFGTHLGQHVPGSLPNFSPKLPVWGIIQLACHQPVVQLGQENGGPDGNFWAYPLTHSVIFNKFVNIVILNIADEITIFY

SEQ ID NO: 25943 - protein, 44 aa, Diabrotica virgifera
  misc_feature: Coding regions on vcDNA: vcDNA=SeqID_5640; Strand=-; Position=2-133
  misc_feature (28)..(34): Xaa can be any naturally occurring amino acid
FCIISKIVYGLKKSFERLLKTVQISKAXXXXXXXGGRLAGRVAG

SEQ ID NO: 25944 - protein, 143 aa, Diabrotica virgifera
  misc_feature: Coding regions on vcDNA: vcDNA=SeqID_5641; Strand=+; Position=1-429
  misc_feature: Homolog annotation: Hit_ID=EAA10796.3; Match level="QueryCoverage =98%, HitCoverage=25%, E-value=2e-15, Identity=31%"; Hit description =ENSANGP00000004462 [Anopheles gambiae str. PEST] ref|XP_556485.1| ENSANGP00000004462 [Anopheles gambiae st
  misc_feature (95)..(99): Xaa can be any naturally occurring amino acid
ILNHVSDVDGAEFPNENESPVRPPRRKNKSKVSFSSETKTGKTTSNNKINFDPNSFTCALQNILNFSIPEDDSWDLDSDSEMSEYEEDNYVKDQXXXXXKDKNRLQKYMEEMDRELEGTTIGQSFEKKNGDNFEDIENFKPVE

SEQ ID NO: 25945 - protein, 35 aa, Diabrotica virgifera
  misc_feature: Coding regions on vcDNA: vcDNA=SeqID_5642; Strand=+; Position=147-254
  misc_feature (21)..(21): Xaa can be any naturally occurring amino acid
MIRDLFPSFDPTSNLNLPVNXLRTVVGRLIIPARF

SEQ ID NO: 25946 - protein, 94 aa, Diabrotica virgifera
  misc_feature: Coding regions on vcDNA: vcDNA=SeqID_5643; Strand=-; Position=110-394
  misc_feature (1)..(44): Xaa can be any naturally occurring amino acid
  misc_feature (46)..(46): Xaa can be any naturally occurring amino acid
  misc_feature (51)..(68): Xaa can be any naturally occurring amino acid
  misc_feature (71)..(79): Xaa can be any naturally occurring amino acid
  misc_feature (83)..(92): Xaa can be any naturally occurring amino acid
XXXXXXXXXXXXXXXXXXXXXXXXXXXXXXXXXXXXXXXXXXXXLXLKKLXXXXXXXXXXXXXXXXXXIYXXXXXXXXXFLNXXXXXXXXXXFN

SEQ ID NO: 25947 - protein, 20 aa, Diabrotica virgifera
  misc_feature: Coding regions on vcDNA: vcDNA=SeqID_5644; Strand=-; Position=1-60
YCCSNLNTPFNLNGEKLYPL

SEQ ID NO: 25948 - protein, 86 aa, Diabrotica virgifera
  misc_feature: Coding regions on vcDNA: vcDNA=SeqID_5645; Strand=+; Position=78-335
  misc_feature: Homolog annotation: Hit_ID=AAH77769.1; Match level="QueryCoverage =100%, HitCoverage=19%, E-value=8e-16, Identity=50%"; Hit description= Mec-12-prov protein [Xenopus laevis]
  misc_feature: Gene Ontology Annotation: Molecular function=GTP binding; Cellular component=microtubule; Biological process=microtubule-based process
  misc_feature (31)..(31): Xaa can be any naturally occurring amino acid
MRECTSVNVGQSGVLNVCACWDLYCLEHCNXSDRQKRTHTNVQRRYDSIVRCCNDTGTRFHIPTAVCVHVEPTVLDEVGTGIYHQL

SEQ ID NO: 25949 - protein, 18 aa, Diabrotica virgifera
  misc_feature: Coding regions on vcDNA: vcDNA=SeqID_5646; Strand=-; Position=1-54
  misc_feature (9)..(16): Xaa can be any naturally occurring amino acid
FVNRCYICXXXXXXXXVV

SEQ ID NO: 25950 - protein, 86 aa, Diabrotica virgifera
  misc_feature: Coding regions on vcDNA: vcDNA=SeqID_5647; Strand=-; Position=2-259
KLLPFVQTRCILNDAWDVFSHCSFHHFREVVNYHLIFFVSDNFSYNRSTFVLDQIPNSIGIFWLNNQNSSDSAVKGSKKFYLVNSS

SEQ ID NO: 25951 - protein, 99 aa, Diabrotica virgifera
  misc_feature: Coding regions on vcDNA: vcDNA=SeqID_5648; Strand=+; Position=121-417
NNDIILQNSHMKNMQEVEKQKKRKPNTQTVRKYHGLCFTREQKLVATVWYHERSYTGISFDQLCQNFLTRFHVQYPAIRTLHRWEKRLFKEEGDIEKRK

SEQ ID NO: 25952 - protein, 81 aa, Diabrotica virgifera
  misc_feature: Coding regions on vcDNA: vcDNA=SeqID_5649; Strand=+; Position=4-247
  misc_feature: Homolog annotation: Hit_ID=AAV34815.1; Match level="QueryCoverage =81%, HitCoverage=24%, E-value=1e-10, Identity=53%"; Hit description =ribosomal protein L6 [Bombyx mori]
  misc_feature (46)..(46): Xaa can be any naturally occurring amino acid
VVLVVYRGGDAPTKVDNTRVPRDYDLGYGVLIFSKCRMFHSNALYXFGGKKVYTTMKPQKAQILVKPIVGHKNGRTIFVLG

SEQ ID NO: 25953 - protein, 93 aa, Diabrotica virgifera
  misc_feature: Coding regions on vcDNA: vcDNA=SeqID_5650; Strand=+; Position=120-398
  misc_feature: Homolog annotation: Hit_ID=XP_392951.1; Match level="QueryCoverage =100%, HitCoverage=12%, E-value=1e-37, Identity=83%"; Hit description= similar to CG9712-PA [Apis mellifera]
  misc_feature: Gene Ontology Annotation: Molecular function=pre-mRNA splicing factor activity; Cellular component=nucleus; Biological process=mRNA splicing
  misc_feature: Pfam annotation: Pfam_ID=RRM_1; Match level="Score=-0.4, E-value =0.092, Copies=1"; Pfam description=RNA recognition motif. (a.k.a. RRM, RB
  misc_feature (7)..(7): Xaa can be any naturally occurring amino acid
MAVGSTXVVQVTNIAPQATKDKMQILFGYLGKIEDIRLYPTIRDVSCPVQSRICYIKFVDSTTVGIAQHMTNTVFIDRALIVIPISSGEIPDE

SEQ ID NO: 25954 - protein, 49 aa, Diabrotica virgifera
  misc_feature: Coding regions on vcDNA: vcDNA=SeqID_5651; Strand=+; Position=4-153
VVCSQMLAGDAAANVGNPSIRRNYGLGNGVLKFSRSKVFHKKTLYKFVW

SEQ ID NO: 25955 - protein, 134 aa, Diabrotica virgifera
  misc_feature: Coding regions on vcDNA: vcDNA=SeqID_5652; Strand=+; Position=6-407
  misc_feature: Homolog annotation: Hit_ID=XP_316621.1; Match level="QueryCoverage =91%, HitCoverage=22%, E-value=1e-35, Identity=58%"; Hit description =ENSANGP00000010934 [Anopheles gambiae]
  misc_feature: Gene Ontology Annotation: Molecular function=inorganic phosphate transporter activity; Cellular component=integral to membrane; Biological process=phosphate transport
MTINSSEYKSPSIWEFWRARRYVVTFMLFLGFFNTYCLRVNLSVAIVAMTQYYNVTLANGTTIVTRDFDWDTKIQGYLLSSFFYGYIFTQFIGAYMGIRFGGKIVFAVGLGMASILTILTPVAAYINVWLLLPV

SEQ ID NO: 25956 - protein, 70 aa, Diabrotica virgifera
  misc_feature: Coding regions on vcDNA: vcDNA=SeqID_5653; Strand=-; Position=3-212
FLLDITEVYLFYNRYKICYSRCAVVYAGLEAIFNTGFNASWGRFLEDKLQVGNFLVVDRIRVNTTNFRGL

SEQ ID NO: 25957 - protein, 127 aa, Diabrotica virgifera
  misc_feature: Coding regions on vcDNA: vcDNA=SeqID_5654; Strand=+; Position=9-389
  misc_feature: Homolog annotation: Hit_ID=P80681; Match level="QueryCoverage=85%, HitCoverage=63%, E-value=6e-26, Identity=56%"; Hit description =Larval cuticle protein A1A (TM-A1A) (TM-LCP A1A)
  misc_feature: Gene Ontology Annotation: Molecular function=structural constituent of eye lens
  misc_feature: Pfam annotation: Pfam_ID=Chitin_bind_4; Match level="Score=58.6, E -value=1.8e-14, Copies=1"; Pfam description=Insect cuticle protein
  misc_feature (60)..(60): Xaa can be any naturally occurring amino acid
  misc_feature (113)..(113): Xaa can be any naturally occurring amino acid
MAFKFRSFDHSARCRPGRPYWGTLTNSTGSARSSIMHPYLMQLLRISYGAQLAPAIAKVXVAAPVAKAVVAEEYDPNPQYSFGYQVEDALTGDSKSQSETRNGDIVQRIYSLXNPDGTRRTVEYTAD

SEQ ID NO: 25958 - protein, 104 aa, Diabrotica virgifera
  misc_feature: Coding regions on vcDNA: vcDNA=SeqID_5655; Strand=-; Position=36-350
  misc_feature (69)..(79): Xaa can be any naturally occurring amino acid
LLVLLPSPTASISHFVGVFVISTDFFDCLPPILYDNYLLIGITLINYPNLTLSKKFQTNTWLFKNTSNXXXXXXXXXXXYLLSQHSIDKDPKSVEIIFGSTLEQ

SEQ ID NO: 25959 - protein, 101 aa, Diabrotica virgifera
  misc_feature: Coding regions on vcDNA: vcDNA=SeqID_5656; Strand=+; Position=2-304
  misc_feature (32)..(40): Xaa can be any naturally occurring amino acid
EHQSPPLPILKTDQLPFVITLRQMLLLRTTRXXXXXXXXXYKRGRFGTFSYFKHNLVDVSALVTFWGCQSVEFVAVFAELFACCSFFRHKQLCSDLILDWA

SEQ ID NO: 25960 - protein, 75 aa, Diabrotica virgifera
  misc_feature: Coding regions on vcDNA: vcDNA=SeqID_5657; Strand=+; Position=3-227
  misc_feature (31)..(38): Xaa can be any naturally occurring amino acid
LGVRSHGSGALVTGHTYICTSFEFHLHAALXXXXXXXXDDATHGTSCNTLVVIYPGFLIRGEVPYLITKYIPKLK

SEQ ID NO: 25961 - protein, 89 aa, Diabrotica virgifera
  misc_feature: Coding regions on vcDNA: vcDNA=SeqID_5658; Strand=+; Position=1-267
  misc_feature: Homolog annotation: Hit_ID=NP_729447.1; Match level="QueryCoverage =86%, HitCoverage=17%, E-value=3e-09, Identity=46%"; Hit description =CG32031-PB, isoform B [Drosophila melanogaster] gb|AAN11982.1| CG32031-PB, isoform B [Drosophila
  misc_feature (50)..(50): Xaa can be any naturally occurring amino acid
  misc_feature (61)..(61): Xaa can be any naturally occurring amino acid
TFVKCVPFGSRGQILKIRIKATRVDAAILDKLESGLANIKDSTSIWHIQXQLTQKIYDNHXMNKTPTFGCTIQDVNNTGLEHHDSGVRI

SEQ ID NO: 25962 - protein, 52 aa, Diabrotica virgifera
  misc_feature: Coding regions on vcDNA: vcDNA=SeqID_5659; Strand=-; Position=176-334
INGFGVFRGLSVFAINEPFHVGPNSLKTFSWFSQACKKKFVPIKLPCSSPPS

SEQ ID NO: 25963 - protein, 64 aa, Diabrotica virgifera
  misc_feature: Coding regions on vcDNA: vcDNA=SeqID_5660; Strand=-; Position=21-215
  misc_feature (3)..(32): Xaa can be any naturally occurring amino acid
  misc_feature (48)..(60): Xaa can be any naturally occurring amino acid
KFXXXXXXXXXXXXXXXXXXXXXXXXXXXXXXSSHYLFNFHLIKFFLXXXXXXXXXXXXXRRLG

SEQ ID NO: 25964 - protein, 54 aa, Diabrotica virgifera
  misc_feature: Coding regions on vcDNA: vcDNA=SeqID_5661; Strand=-; Position=116-280
PWHYAAQTAKSLCNIYSFTLLTTSSCTYIFFMTFLSDEIPSSSLVSASVMACKL

SEQ ID NO: 25965 - protein, 53 aa, Diabrotica virgifera
  misc_feature: Coding regions on vcDNA: vcDNA=SeqID_5662; Strand=-; Position=232-393
KTVKKTEAERNILIINVGHIGPVVRTLINNDHHQILNYCHQLSMSTLIGLLKT

SEQ ID NO: 25966 - protein, 84 aa, Diabrotica virgifera
  misc_feature: Coding regions on vcDNA: vcDNA=SeqID_5663; Strand=-; Position=62-316
FITYVGISWIERLDDNDCQIYCVYNYVGMLTDTLSRVLLQQFRVLCMTGVWIALLNLEQSNLVSRNLIVLSPEQLDQFANIHRH

SEQ ID NO: 25967 - protein, 58 aa, Diabrotica virgifera
  misc_feature: Coding regions on vcDNA: vcDNA=SeqID_5664; Strand=-; Position=2-175
GFRLKYTSCLHLHIPLSSDYYVPHYIIMLLELLSYTMMNAVAQAVFVFINGSNNLIRL

SEQ ID NO: 25968 - protein, 91 aa, Diabrotica virgifera
  misc_feature: Coding regions on vcDNA: vcDNA=SeqID_5665; Strand=+; Position=82-357
LPSIIQIAKNKTTVLIVQKGYSVLGIDQFNKMYCKKYSNNIRKYNTVRNNYILINSPNLMYLSDKEIYWKHFSDIVKMMIARNRVNEKCAR

SEQ ID NO: 25969 - protein, 114 aa, Diabrotica virgifera
  misc_feature: Coding regions on vcDNA: vcDNA=SeqID_5666; Strand=+; Position=5-346
  misc_feature: Homolog annotation: Hit_ID=AAM44044.1; Match level="QueryCoverage =96%, HitCoverage=50%, E-value=6e-21, Identity=46%"; Hit description =ferritin 2 [Apriona germari]
  misc_feature (90)..(98): Xaa can be any naturally occurring amino acid
MPGIMKAFIVLSIFCVAALASQDTCYNDAVTACDPAAARSVDKLNNCNAKFGGIDSAQSDLQKFVNHNFIRSFEYLLLATNFDNYQRNRXXXXXXXXXLSDKKWNDGIEFIKYL

SEQ ID NO: 25970 - protein, 46 aa, Diabrotica virgifera
  misc_feature: Coding regions on vcDNA: vcDNA=SeqID_5667; Strand=+; Position=3-140
  misc_feature (15)..(15): Xaa can be any naturally occurring amino acid
  misc_feature (18)..(18): Xaa can be any naturally occurring amino acid
RNREQELSYNLTLKXIIXTVIIIKQILIVKNINKYEVSSPQLSNKC

SEQ ID NO: 25971 - protein, 54 aa, Diabrotica virgifera
  misc_feature: Coding regions on vcDNA: vcDNA=SeqID_5668; Strand=-; Position=2-163
PRAYDVSFTSLLSSTRPNIMLLLWNIPPPREYEYSTSQIAVSAFLSPVHLVSCI

SEQ ID NO: 25972 - protein, 99 aa, Diabrotica virgifera
  misc_feature: Coding regions on vcDNA: vcDNA=SeqID_5669; Strand=+; Position=107-403
MHDCLCPSTPTAERRKPITTSSKNTSCFTTSDNNCNNNCSRCDILYNCTNFPDKSISHYTTATGEDCSCPNCVCSEMEIQNQTCDWVTCVCSVWFENGK

SEQ ID NO: 25973 - protein, 116 aa, Diabrotica virgifera
  misc_feature: Coding regions on vcDNA: vcDNA=SeqID_5670; Strand=+; Position=24-374
  misc_feature: Homolog annotation: Hit_ID=S16613; Match level="QueryCoverage=88%, HitCoverage=27%, E-value=1e-22, Identity=59%"; Hit description =opacity protein opaB precursor - Neisseria gonorrhoeae  (strain MS11) (fragments)
RVFRCKCLFYSILFYSILFYSILFYSILFYSILFYSILFYSILFYSILFYSILFYSILFYSILFYSILFYSILFYSILFYSILFYSILFYSILFYSILFYSILFYSVVVLLYYILL

SEQ ID NO: 25974 - protein, 51 aa, Diabrotica virgifera
  misc_feature: Coding regions on vcDNA: vcDNA=SeqID_5671; Strand=+; Position=196-348
RRYNYLANAMYMPALYFIKGSNLNWCCRLSAKSSSLGDVALHATVRSYYDR

SEQ ID NO: 25975 - protein, 131 aa, Diabrotica virgifera
  misc_feature: Coding regions on vcDNA: vcDNA=SeqID_5672; Strand=-; Position=0-392
  misc_feature (1)..(125): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDAWVGP

SEQ ID NO: 25976 - protein, 123 aa, Diabrotica virgifera
  misc_feature: Coding regions on vcDNA: vcDNA=SeqID_5673; Strand=+; Position=63-434
  misc_feature: Homolog annotation: Hit_ID=EAL25370.1; Match level="QueryCoverage =100%, HitCoverage=27%, E-value=3e-35, Identity=58%"; Hit description= GA21466-PA [Drosophila pseudoobscura]
  misc_feature: Gene Ontology Annotation: Molecular function=metalloendopeptidase activity; Cellular component=membrane fraction; Biological process =prenylated protein catabolism
  misc_feature: Pfam annotation: Pfam_ID=Peptidase_M48; Match level="Score=-11.7, E -value=0.00061, Copies=1"; Pfam description=Peptidase family M48
VNLFLLFLGFSVIFKYEPLYEALGFVKVRPVLVGLFVVLQYVMMPYNTVLNFLMTCLSRKFEFQADDFAVNLGKSEALERALVQLNKDNLGFPINDYLYSAWHHSHPPLLERIAVLRESARSQ

SEQ ID NO: 25977 - protein, 59 aa, Diabrotica virgifera
  misc_feature: Coding regions on vcDNA: vcDNA=SeqID_5674; Strand=+; Position=2-178
DSNDSNILLLGLIPRFYLSTFVVHILPSKFFSFVSLSKYLYIEHSFGVYEYVAYVQHKQ

SEQ ID NO: 25978 - protein, 70 aa, Diabrotica virgifera
  misc_feature: Coding regions on vcDNA: vcDNA=SeqID_5675; Strand=+; Position=85-294
  misc_feature (54)..(54): Xaa can be any naturally occurring amino acid
FESIVYTQSTYLTMLINTCAITVFILNVFLLTHVRTNETNDTQTCVQLYEKGLXTYLENRWEGCVIKFEK

SEQ ID NO: 25979 - protein, 37 aa, Diabrotica virgifera
  misc_feature: Coding regions on vcDNA: vcDNA=SeqID_5676; Strand=-; Position=43-156
WVKVYNLSRRYYNKAGWILKFYLNWVLTRFEPVWFQP

SEQ ID NO: 25980 - protein, 69 aa, Diabrotica virgifera
  misc_feature: Coding regions on vcDNA: vcDNA=SeqID_5677; Strand=+; Position=114-323
MAPINHRCCAKNYEGGWWYKSCFTSCLNGKYSTVIVPDAIKYHGINWQGFRTKEYNLSGSRIMIRPIGS

SEQ ID NO: 25981 - protein, 50 aa, Diabrotica virgifera
  misc_feature: Coding regions on vcDNA: vcDNA=SeqID_5678; Strand=-; Position=2-151
HIIPPTHRTKTKLHPPKLIYHLTIITNDHKLKDLETRMKKYVITPNLIRL

SEQ ID NO: 25982 - protein, 63 aa, Diabrotica virgifera
  misc_feature: Coding regions on vcDNA: vcDNA=SeqID_5679; Strand=-; Position=65-256
FDDETEYAIETICQFAMTFGFKAAFRSTILNHVGSSPYYVTFGKDHTKSLCVTENITSIAQLT

SEQ ID NO: 25983 - protein, 84 aa, Diabrotica virgifera
  misc_feature: Coding regions on vcDNA: vcDNA=SeqID_5680; Strand=-; Position=23-277
  misc_feature (28)..(36): Xaa can be any naturally occurring amino acid
  misc_feature (71)..(71): Xaa can be any naturally occurring amino acid
FVLKGTAVLVPDFFRFTNFSVIEGEIFXXXXXXXXXNVLYLGGVLPLQTRNKDETLDEDLKYPLIFFELGXDESDSSADVYVVT

SEQ ID NO: 25984 - protein, 61 aa, Diabrotica virgifera
  misc_feature: Coding regions on vcDNA: vcDNA=SeqID_5681; Strand=+; Position=40-225
LSSSVTEYVRYIHHRFIICTLRTRDYWLRSRYLLISYFKERDPENFQCDLDSSNNSFVLQC

SEQ ID NO: 25985 - protein, 51 aa, Diabrotica virgifera
  misc_feature: Coding regions on vcDNA: vcDNA=SeqID_5682; Strand=-; Position=74-229
PVRNPLKNFREVVCEKRKCQITRHEPLIPGTQGSNNKRLVYMTNIFSHKHS

SEQ ID NO: 25986 - protein, 114 aa, Diabrotica virgifera
  misc_feature: Coding regions on vcDNA: vcDNA=SeqID_5683; Strand=+; Position=12-353
QYSDSYGVYPPQLPVSRPHLYYTDLGFIQPYKIQYYDNAVANRRVSSTSVLFNTDPAKPPRLEMNYACTNISDNVDRDTYNVSGYSTTVYGSSTGKSPNLCPKIYGDSLGASNL

SEQ ID NO: 25987 - protein, 78 aa, Diabrotica virgifera
  misc_feature: Coding regions on vcDNA: vcDNA=SeqID_5684; Strand=+; Position=42-278
RVRIRSTPLHVLGMYKCLPRSCRTGIDITRGALRESTTPLYRHLARNRLHMERLIWHDIGRDIASDDDIMTLSHSGSG

SEQ ID NO: 25988 - protein, 125 aa, Diabrotica virgifera
  misc_feature: Coding regions on vcDNA: vcDNA=SeqID_5685; Strand=+; Position=27-401
  misc_feature: Homolog annotation: Hit_ID=XP_396143.1; Match level="QueryCoverage =98%, HitCoverage=22%, E-value=5e-16, Identity=34%"; Hit description =similar to Hypothetical protein CG1785 [Apis mellifera]
AAKPLKCFSALQPHTNVPDPISRRNRVRTKEERKSTLVTLIEQRNEAKGIVKRRSLQAAENRKLDDLKRKSRPKRGDVSSDLWQDSDKQAIIEKWVDKNAKKHNLRGVSVPVKKTRSSKLATNIP

SEQ ID NO: 25989 - protein, 68 aa, Diabrotica virgifera
  misc_feature: Coding regions on vcDNA: vcDNA=SeqID_5686; Strand=+; Position=1-207
  misc_feature (39)..(39): Xaa can be any naturally occurring amino acid
  misc_feature (52)..(58): Xaa can be any naturally occurring amino acid
WPHCHPRWEGMVMNTEKSERLLIWPTTLGISSKQPKFFXENYWNTNCYSNVXXXXXXXVYLNFIVLYI

SEQ ID NO: 25990 - protein, 69 aa, Diabrotica virgifera
  misc_feature: Coding regions on vcDNA: vcDNA=SeqID_5687; Strand=-; Position=83-292
QPIIISVTVIITFIEVHKIIREFFLSIFLIILLSLVLLLSGSPFLLMVPYNKPHLNLDFCSIFIDATRL

SEQ ID NO: 25991 - protein, 45 aa, Diabrotica virgifera
  misc_feature: Coding regions on vcDNA: vcDNA=SeqID_5688; Strand=-; Position=1-135
LSRHRRVRHKHCLSQRNTSFYYSIVIIFISSIDRRILRHHSTDML

SEQ ID NO: 25992 - protein, 110 aa, Diabrotica virgifera
  misc_feature: Coding regions on vcDNA: vcDNA=SeqID_5689; Strand=+; Position=1-330
  misc_feature: Homolog annotation: Hit_ID=XP_316153.1; Match level="QueryCoverage =90%, HitCoverage=17%, E-value=9e-28, Identity=63%"; Hit description =ENSANGP00000020432 [Anopheles gambiae]
  misc_feature: Gene Ontology Annotation: Molecular function=3-oxoacid CoA -transferase activity; Biological process=succinyl-CoA metabolism
QASKVSRNITVVSYNAGVDTFGSRLLSNQNKVYRMISSYVGDNAEFDRQFLRGELEVQLTPQGTLPERIIGRGTGTPTIFTPEADGTHVHECGALIKYGNEGTTEIPITT

SEQ ID NO: 25993 - protein, 64 aa, Diabrotica virgifera
  misc_feature: Coding regions on vcDNA: vcDNA=SeqID_5690; Strand=+; Position=3-197
  misc_feature (8)..(31): Xaa can be any naturally occurring amino acid
MQASKMSXXXXXXXXXXXXXXXXXXXXXXXXFVKISNFLRSKLYVVINDRFGTKYFYSMNIEYF

SEQ ID NO: 25994 - protein, 43 aa, Diabrotica virgifera
  misc_feature: Coding regions on vcDNA: vcDNA=SeqID_5691; Strand=-; Position=19-150
  misc_feature (31)..(37): Xaa can be any naturally occurring amino acid
SPISSHQLNIIYFSQNQMSLQMTNISSQKNXXXXXXXTKNFQV

SEQ ID NO: 25995 - protein, 24 aa, Diabrotica virgifera
  misc_feature: Coding regions on vcDNA: vcDNA=SeqID_5692; Strand=-; Position=22-96
  misc_feature (14)..(20): Xaa can be any naturally occurring amino acid
MKLKFLRTAYNFLXXXXXXXLIYH

SEQ ID NO: 25996 - protein, 65 aa, Diabrotica virgifera
  misc_feature: Coding regions on vcDNA: vcDNA=SeqID_5693; Strand=+; Position=3-200
  misc_feature (3)..(8): Xaa can be any naturally occurring amino acid
SLXXXXXXLALVEYLVLLTLSINLIIDTILALIMIQHMLKLTDRIWGSIEIDMVFIFLFRPDIEF

SEQ ID NO: 25997 - protein, 62 aa, Diabrotica virgifera
  misc_feature: Coding regions on vcDNA: vcDNA=SeqID_5694; Strand=+; Position=194-382
  misc_feature (18)..(18): Xaa can be any naturally occurring amino acid
VDVFHRKKTIMWQSPEKXKRGRPTQSWNLGVRKAISARNLNEDLTQDRIQWRLGVGQRRKSL

SEQ ID NO: 25998 - protein, 108 aa, Diabrotica virgifera
  misc_feature: Coding regions on vcDNA: vcDNA=SeqID_5695; Strand=+; Position=78-401
  misc_feature: Homolog annotation: Hit_ID=AAH84116.1; Match level="QueryCoverage =96%, HitCoverage=45%, E-value=1e-25, Identity=52%"; Hit description =Unknown (protein for MGC:84789) [Xenopus laevis]
  misc_feature: Gene Ontology Annotation: Molecular function=ubiquitin C-terminal hydrolase activity; Cellular component=cytoplasm; Biological process= protein deubiquitination
  misc_feature: Pfam annotation: Pfam_ID=Peptidase_C12; Match level="Score=-19.3, E -value=3.9e-08, Copies=1"; Pfam description=Ubiquitin carboxyl -terminal hydrolase,
MSLFPLESNPDVMNKFMHVLGVPEKFKVVDVYGLDTDALAWVPRPVIAVILLFPCSEKFYAHAQKQKEEYLNKAPELSPNIWYMKQKVSNACGTNALIHNIANNDERL

SEQ ID NO: 25999 - protein, 37 aa, Diabrotica virgifera
  misc_feature: Coding regions on vcDNA: vcDNA=SeqID_5696; Strand=-; Position=1-111
  misc_feature (21)..(30): Xaa can be any naturally occurring amino acid
  misc_feature (37)..(37): Xaa can be any naturally occurring amino acid
RNLLRTVQKIDKVQHIHFSPXXXXXXXXXXQYLRYNX

SEQ ID NO: 26000 - protein, 77 aa, Diabrotica virgifera
  misc_feature: Coding regions on vcDNA: vcDNA=SeqID_5697; Strand=-; Position=42-275
KSYYCHLYNSPLRDLGGGRYDNCNIICGPPRFFSEIKFPYVNVGNFYSRHFFQLRIDGAIIGKNYLPCYHRQIMETV

SEQ ID NO: 26001 - protein, 99 aa, Diabrotica virgifera
  misc_feature: Coding regions on vcDNA: vcDNA=SeqID_5698; Strand=+; Position=19-318
YEQYLRIPFYGDIQLIVVNTACTTFLILESATEMEISASDIRVRLSLRESECVREKHSETHATAKTVLSGRGTSFHIRYCYTVRCSTTIIYKDKTELYL

SEQ ID NO: 26002 - protein, 66 aa, Diabrotica virgifera
  misc_feature: Coding regions on vcDNA: vcDNA=SeqID_5699; Strand=+; Position=93-293
WWYRLSFIDYISFIRSHKSVCYSIATPEERKSDLSIESYIYCSSEANYETWISTHLRVIEIIDPRI

SEQ ID NO: 26003 - protein, 53 aa, Diabrotica virgifera
  misc_feature: Coding regions on vcDNA: vcDNA=SeqID_5700; Strand=-; Position=125-286
TSSTEIVCKRPHVMVQIVSKCIELPTPLRGLMRIASVLEMCQLICKSPQLPLQ

SEQ ID NO: 26004 - protein, 69 aa, Diabrotica virgifera
  misc_feature: Coding regions on vcDNA: vcDNA=SeqID_5701; Strand=+; Position=123-332
VVEGPRIKIYMMPESAFAVAATPMVEAPFGIKYILILGSWTIHCLFSNFQVCKIDLFCKNCEVLSYYLD

SEQ ID NO: 26005 - protein, 96 aa, Diabrotica virgifera
  misc_feature: Coding regions on vcDNA: vcDNA=SeqID_5702; Strand=+; Position=123-410
WIKMLLVLFLCIARLASNIYSPVLAQNDCGRLCQWFPGLFKVKPVVESATEAVQFQNTRPSRPNNEIDQSNNVQFQQPRPNRPSVESQRPDNVQFQ

SEQ ID NO: 26006 - protein, 37 aa, Diabrotica virgifera
  misc_feature: Coding regions on vcDNA: vcDNA=SeqID_5703; Strand=-; Position=95-208
IWRYICRSATLMRQLSVNTQATRVTCKRPILMPYREA

SEQ ID NO: 26007 - protein, 29 aa, Diabrotica virgifera
  misc_feature: Coding regions on vcDNA: vcDNA=SeqID_5704; Strand=+; Position=165-254
SFNISRNFYTFTMGPFNDLLCNMITDTGA

SEQ ID NO: 26008 - protein, 137 aa, Diabrotica virgifera
  misc_feature: Coding regions on vcDNA: vcDNA=SeqID_5705; Strand=+; Position=3-413
  misc_feature: Homolog annotation: Hit_ID=XP_395969.1; Match level="QueryCoverage =100%, HitCoverage=22%, E-value=3e-32, Identity=47%"; Hit description= similar to ENSANGP00000021733 [Apis mellifera]
RESRKAEAYKCFIKNDTDDSIVGISVTAECNTLISPKESPEVLYLSAVKQNPINEGSLHPASIGGDWIDSVNIDAKVFINQTHIAETDNINGKLLTTDYICQEQRNNIVVMARYSVTGCPNDYVCFEFIKNDDNIIK

SEQ ID NO: 26009 - protein, 136 aa, Diabrotica virgifera
  misc_feature: Coding regions on vcDNA: vcDNA=SeqID_5706; Strand=+; Position=3-410
  misc_feature: Homolog annotation: Hit_ID=XP_317511.1; Match level="QueryCoverage =100%, HitCoverage=4%, E-value=9e-28, Identity=54%"; Hit description =ENSANGP00000009932 [Anopheles gambiae]
LQCRDSDLNVNLRDEWKLNKVNTSRDSFMPTRRPANIFMHGVLGWDQLQMIISKSTTADLLKMFNKLEEFFSQQFNSSKRAFSSFAGSGRPSRVTPQKNRESSVPPQLPAAPTTDARHHRHWQKVLAHVARLQLKT

SEQ ID NO: 26010 - protein, 52 aa, Diabrotica virgifera
  misc_feature: Coding regions on vcDNA: vcDNA=SeqID_5707; Strand=+; Position=1-159
  misc_feature (4)..(10): Xaa can be any naturally occurring amino acid
IQLXXXXXXXTIRFVIELLEEIQMLNTWLVQNRLYVKHYDGRLRVSSITVSR

SEQ ID NO: 26011 - protein, 139 aa, Diabrotica virgifera
  misc_feature: Coding regions on vcDNA: vcDNA=SeqID_5708; Strand=+; Position=1-417
  misc_feature: Homolog annotation: Hit_ID=XP_393387.1; Match level="QueryCoverage =92%, HitCoverage=32%, E-value=2e-22, Identity=39%"; Hit description =similar to alpha amylase, catalytic domain containing protein (73.4 kD) (2O926) [Apis
IQATTDDVVRNAWGVEGFYIKGLEKLQEDSNLVESIKRWKTILGEHRVLIVSDTFISSLKPPALNFILDKVDLVDIRLDVKQGVNSVSRQIKSLQNNTLYSKPGMPWIHWSVGDVNSQRLANILPSGNCTLRGTLLQLM

SEQ ID NO: 26012 - protein, 50 aa, Diabrotica virgifera
  misc_feature: Coding regions on vcDNA: vcDNA=SeqID_5709; Strand=+; Position=1-153
  misc_feature (30)..(38): Xaa can be any naturally occurring amino acid
TTHYSDVVLQPALRVAGCRKKKIQHNSILXXXXXXXXXVVEGTSHSFKEN

SEQ ID NO: 26013 - protein, 52 aa, Diabrotica virgifera
  misc_feature: Coding regions on vcDNA: vcDNA=SeqID_5710; Strand=-; Position=24-182
  misc_feature (36)..(44): Xaa can be any naturally occurring amino acid
NQNLFLFVYNNFTSTIFCWGSGSFFDELNKITSKIXXXXXXXXXEMDTVTLE

SEQ ID NO: 26014 - protein, 58 aa, Diabrotica virgifera
  misc_feature: Coding regions on vcDNA: vcDNA=SeqID_5711; Strand=-; Position=31-207
  misc_feature: Homolog annotation: Hit_ID=CAA55883.1; Match level="QueryCoverage =86%, HitCoverage=12%, E-value=2e-09, Identity=51%"; Hit description =chitinase [Beta vulgaris subsp. vulgaris] emb|CAA56946.1| Chitinase [Beta vulgaris subsp. vulgaris] pir||S
  misc_feature (11)..(11): Xaa can be any naturally occurring amino acid
PPSPSPSPTPXPIPKPSPPSPPIPASPCPPSPSPTLPRPKPRAGTPTTPTAAGATATA

SEQ ID NO: 26015 - protein, 55 aa, Diabrotica virgifera
  misc_feature: Coding regions on vcDNA: vcDNA=SeqID_5712; Strand=+; Position=15-182
SQLDCLPLLVSASSTFTMCSRVMRFFETMSHQMCLAGIGELQSMRIGSSFQAPFA

SEQ ID NO: 26016 - protein, 60 aa, Diabrotica virgifera
  misc_feature: Coding regions on vcDNA: vcDNA=SeqID_5713; Strand=-; Position=63-245
  misc_feature (2)..(12): Xaa can be any naturally occurring amino acid
  misc_feature (45)..(57): Xaa can be any naturally occurring amino acid
TXXXXXXXXXXXPLIYSSLYKFTIEEIIKTIFLIFKVIHFVKLPXXXXXXXXXXXXXQLP

SEQ ID NO: 26017 - protein, 79 aa, Diabrotica virgifera
  misc_feature: Coding regions on vcDNA: vcDNA=SeqID_5714; Strand=+; Position=3-239
GLGRGRDNLHYDQRGGRPGGSRFRSVLLRIQASSIGSLNLISWAAFFKLRMGKTCGVSHFIPLVKSPLFAIGVNTNGAP

SEQ ID NO: 26018 - protein, 83 aa, Diabrotica virgifera
  misc_feature: Coding regions on vcDNA: vcDNA=SeqID_5715; Strand=-; Position=0-248
  misc_feature (2)..(19): Xaa can be any naturally occurring amino acid
  misc_feature (24)..(34): Xaa can be any naturally occurring amino acid
  misc_feature (41)..(54): Xaa can be any naturally occurring amino acid
  misc_feature (61)..(81): Xaa can be any naturally occurring amino acid
YXXXXXXXXXXXXXXXXXXLLIWXXXXXXXXXXXPGTPGSXXXXXXXXXXXXXXHSNLLSXXXXXXXXXXXXXXXXXXXXXRR

SEQ ID NO: 26019 - protein, 68 aa, Diabrotica virgifera
  misc_feature: Coding regions on vcDNA: vcDNA=SeqID_5716; Strand=-; Position=8-214
  misc_feature (23)..(28): Xaa can be any naturally occurring amino acid
  misc_feature (62)..(68): Xaa can be any naturally occurring amino acid
KCLVQCCQTLHVSSLRSCRSLFXXXXXXRLQQVLQLWTTRLQVSCNPNHVPMVNNKDLSLLXXXXXXX

SEQ ID NO: 26020 - protein, 63 aa, Diabrotica virgifera
  misc_feature: Coding regions on vcDNA: vcDNA=SeqID_5717; Strand=+; Position=158-349
IKLYKGTKVTKCTKTGSRVNWNMETRKALSKVPNNKETYKLHNLLPFPIIGEPFLIYNSITWE

SEQ ID NO: 26021 - protein, 112 aa, Diabrotica virgifera
  misc_feature: Coding regions on vcDNA: vcDNA=SeqID_5718; Strand=+; Position=37-371
  misc_feature: Homolog annotation: Hit_ID=XP_312604.1; Match level="QueryCoverage =93%, HitCoverage=35%, E-value=6e-18, Identity=41%"; Hit description =ENSANGP00000024944 [Anopheles gambiae]
  misc_feature: Gene Ontology Annotation: Molecular function=glutamate-ammonia ligase activity
  misc_feature: Pfam annotation: Pfam_ID=Gln-synt_N; Match level="Score=-10.1, E -value=0.019, Copies=1"; Pfam description=Glutamine synthetase, beta -Grasp domai
  misc_feature (57)..(57): Xaa can be any naturally occurring amino acid
  misc_feature (76)..(76): Xaa can be any naturally occurring amino acid
LLKYKEYSSVTDTFLMAKMLDTTPNAALMISLRHHYLTRGIPDRKCHATYIWVDGSXRLCLCKTKTLHFVPTFSQXLPVWNFEGNSPDQATGYISDVFLCPVAMSKGRFLSG

SEQ ID NO: 26022 - protein, 21 aa, Diabrotica virgifera
  misc_feature: Coding regions on vcDNA: vcDNA=SeqID_5719; Strand=+; Position=14-76
IIGYFELLDVCYSFKHKSVWM

SEQ ID NO: 26023 - protein, 131 aa, Diabrotica virgifera
  misc_feature: Coding regions on vcDNA: vcDNA=SeqID_5720; Strand=+; Position=26-418
  misc_feature: Homolog annotation: Hit_ID=XP_312387.1; Match level="QueryCoverage =48%, HitCoverage=10%, E-value=8e-13, Identity=53%"; Hit description =ENSANGP00000012795 [Anopheles gambiae]
MLKSATFLCFVISVCSVDYYTERDVNAYEKLLNEAFESSKTYEPATSSLKYKALKSGPPEDDGGDYDFIVVGSGSTGSLLASRLSEISDWRVLVLEAGKFGNNVTDVTVMSYKATIMSDFNWGYYSIPQNN

SEQ ID NO: 26024 - protein, 67 aa, Diabrotica virgifera
  misc_feature: Coding regions on vcDNA: vcDNA=SeqID_5721; Strand=+; Position=141-340
  misc_feature: Homolog annotation: Hit_ID=NP_647853.1; Match level="QueryCoverage =82%, HitCoverage=12%, E-value=2e-14, Identity=63%"; Hit description =CG1136-PA [Drosophila melanogaster] gb|AAF47829.1| CG1136-PA [Drosophila melanogaster]
  misc_feature (55)..(55): Xaa can be any naturally occurring amino acid
MLGYYLVLLVVYLICIANISAYETPSPHQYHIQTDEGPERYFRYQTDSGQYRKEXRLEDGTVVAHTP

SEQ ID NO: 26025 - protein, 121 aa, Diabrotica virgifera
  misc_feature: Coding regions on vcDNA: vcDNA=SeqID_5722; Strand=+; Position=37-399
  misc_feature: Homolog annotation: Hit_ID=XP_308831.1; Match level="QueryCoverage =100%, HitCoverage=53%, E-value=4e-24, Identity=46%"; Hit description= ENSANGP00000021782 [Anopheles gambiae]
  misc_feature: Pfam annotation: Pfam_ID=Chitin_bind_4; Match level="Score=42.0, E -value=1.8e-09, Copies=1"; Pfam description=Insect cuticle protein
MKFIIAVSALLACAASSPTAYIVPLAEISAPIASQYHSQDSLGQYTYGYANHLSAKSEARAFDGSVLGSYSYLDPSGKIQSVEYAADDQGFRATSSNLPVAPAVPEVPVVAVPVPIQDTPE

SEQ ID NO: 26026 - protein, 134 aa, Diabrotica virgifera
  misc_feature: Coding regions on vcDNA: vcDNA=SeqID_5723; Strand=+; Position=7-408
  misc_feature (83)..(89): Xaa can be any naturally occurring amino acid
VVLTRGAILGRQQSIKAKRSRQNQANEVNLTRSNGIEPQIKVENNIFNQEEVQLTVVEPRAKYERTAVSKREEIGHDSKLAAXXXXXXXAQVEMIYPSEHEEIEKINYAQEREIHIDFQKVGDEIIFPKLTNRT

SEQ ID NO: 26027 - protein, 55 aa, Diabrotica virgifera
  misc_feature: Coding regions on vcDNA: vcDNA=SeqID_5724; Strand=+; Position=56-220
GKFIAQAMARTTQAARKAARGTGRRKELATNAAGYAATASGGVKFRDRYGPGTVA

SEQ ID NO: 26028 - protein, 88 aa, Diabrotica virgifera
  misc_feature: Coding regions on vcDNA: vcDNA=SeqID_5725; Strand=+; Position=31-297
GLSVAREDFISTQERFNSCTVCSKDYYLIITSLLISTLIELDQSYFDRQTYTLNDFFVMTCQSLLYISHFLRNTLCLNIINIFTSTQF

SEQ ID NO: 26029 - protein, 84 aa, Diabrotica virgifera
  misc_feature: Coding regions on vcDNA: vcDNA=SeqID_5726; Strand=-; Position=7-261
  misc_feature (50)..(78): Xaa can be any naturally occurring amino acid
KGNQLKYHESFPNEDVKKDGQEKELQGNPRRDDLIRTTIKENITHRVDAXXXXXXXXXXXXXXXXXXXXXXXXXXXXXKITRGV

SEQ ID NO: 26030 - protein, 68 aa, Diabrotica virgifera
  misc_feature: Coding regions on vcDNA: vcDNA=SeqID_5727; Strand=+; Position=183-386
SSLYEIGKCLKDRDRKIVVLRSKTVNRNILTWKTLSLCHNFPKLRGNSIANWPMEFEKLSYQDFQRCK

SEQ ID NO: 26031 - protein, 131 aa, Diabrotica virgifera
  misc_feature: Coding regions on vcDNA: vcDNA=SeqID_5728; Strand=+; Position=31-423
  misc_feature: Homolog annotation: Hit_ID=EAA16792.1; Match level="QueryCoverage =97%, HitCoverage=18%, E-value=2e-24, Identity=43%"; Hit description =ookinete protein-related [Plasmodium yoelii yoelii]
  misc_feature: Gene Ontology Annotation: Cellular component=nuclear speck
RVGGNGGGNGNGGGNGNGGGNGNGGGNGNGGGNGNGGGNGNGGGNGNGGGNSTSTTEGATKPTTEKATTLKPTTDTDENCDENSSEESNEKSTERNVTDDNSDENCSEESSEESTERNDTDNGNGGGNGNG

SEQ ID NO: 26032 - protein, 51 aa, Diabrotica virgifera
  misc_feature: Coding regions on vcDNA: vcDNA=SeqID_5729; Strand=+; Position=69-221
SNLCECNHTGLHIDTQLRPLSVGSLIRVSRVRLDYVVKRVVVTTLVQADDS

SEQ ID NO: 26033 - protein, 135 aa, Diabrotica virgifera
  misc_feature: Coding regions on vcDNA: vcDNA=SeqID_5730; Strand=+; Position=24-428
  misc_feature: Homolog annotation: Hit_ID=XP_393774.1; Match level="QueryCoverage =93%, HitCoverage=48%, E-value=1e-23, Identity=40%"; Hit description =similar to CG9134-PB [Apis mellifera]
  misc_feature: Pfam annotation: Pfam_ID=Lectin_C; Match level="Score=50.9, E-value =3.7e-12, Copies=1"; Pfam description=Lectin C-type domain
GLECNNGSEFVSPVLHTNKKTPNWFNFAGKTYYVDTVFKANFYKALQFCRQQGMHLLSINSQQENDRIGKFINENGLGYGHYWTSASNQVGDGQWVWLSTGQNMVYSNWYPGEPSGKNSQNNTEHCVEARHWAQP

SEQ ID NO: 26034 - protein, 119 aa, Diabrotica virgifera
  misc_feature: Coding regions on vcDNA: vcDNA=SeqID_5731; Strand=-; Position=3-359
  misc_feature (84)..(89): Xaa can be any naturally occurring amino acid
KFRRREVAVSFYACAFTSTSIKKKDKGQYDNIRQFLRFFEQLKCSRSFKNAANVLNFIHNKIRNKMYTKLLKKNIKTSFKNILXXXXXXSTTRVSNRVPKTYPRNMVSVFVFEDLLIEH

SEQ ID NO: 26035 - protein, 88 aa, Diabrotica virgifera
  misc_feature: Coding regions on vcDNA: vcDNA=SeqID_5732; Strand=-; Position=142-408
  misc_feature (3)..(22): Xaa can be any naturally occurring amino acid
  misc_feature (42)..(53): Xaa can be any naturally occurring amino acid
KLXXXXXXXXXXXXXXXXXXXXFTRVIFRTIYNIKGVCFDMXXXXXXXXXXXXLSIPSNNLGISDALLISYENIKIGKIIFKTKRGTL

SEQ ID NO: 26036 - protein, 98 aa, Diabrotica virgifera
  misc_feature: Coding regions on vcDNA: vcDNA=SeqID_5733; Strand=-; Position=54-350
AFTCTFIRKKANAMYDNSEQFLRIVMQLNCFRSIKNAANVINFNANKIRNKMYMTFLKMNIKTRCKNIISLMNELSTTILSNRILKTYHRNTVPCFCI

SEQ ID NO: 26037 - protein, 90 aa, Diabrotica virgifera
  misc_feature: Coding regions on vcDNA: vcDNA=SeqID_5734; Strand=+; Position=50-322
NCSIITIICVLSRKYYRSILVLVSLYLVNGTTILVYLGRIQTFGGFNVQRSTTVISFLCKYMKAEAKSRLKLAFRKITISHKCFNNIVFN

SEQ ID NO: 26038 - protein, 70 aa, Diabrotica virgifera
  misc_feature: Coding regions on vcDNA: vcDNA=SeqID_5735; Strand=+; Position=1-213
  misc_feature (8)..(21): Xaa can be any naturally occurring amino acid
  misc_feature (40)..(65): Xaa can be any naturally occurring amino acid
GNETFYLXXXXXXXXXXXXXXKGKIYFWYLVYQGLLIKNXXXXXXXXXXXXXXXXXXXXXXXXXXFGKER

SEQ ID NO: 26039 - protein, 90 aa, Diabrotica virgifera
  misc_feature: Coding regions on vcDNA: vcDNA=SeqID_5736; Strand=-; Position=122-394
NPANGSIVITCLSVLMLCLMIVEYTVLSFCVAVSFVKVLSSILIYKLAQSFVLKNILNGTKNCFQNYHCKQIHTKTYTFHTNCSNFESEK

SEQ ID NO: 26040 - protein, 131 aa, Diabrotica virgifera
  misc_feature: Coding regions on vcDNA: vcDNA=SeqID_5737; Strand=+; Position=2-394
  misc_feature (67)..(73): Xaa can be any naturally occurring amino acid
KRPATRPPTRPLLTRRDELFPLARQVVKDSGCYYSETQLSTVYMNKPGNMGHDREVDTSARASPRLXXXXXXXSISKRPKMEATSDSDDRQDYDEALVVRTSIHSLFQHNSKNHHSSARCNTSRRSSVGAD

SEQ ID NO: 26041 - protein, 102 aa, Diabrotica virgifera
  misc_feature: Coding regions on vcDNA: vcDNA=SeqID_5738; Strand=+; Position=3-311
  misc_feature: Homolog annotation: Hit_ID=CAF93504.1; Match level="QueryCoverage =82%, HitCoverage=18%, E-value=5e-13, Identity=41%"; Hit description =unnamed protein product [Tetraodon nigroviridis]
  misc_feature: Gene Ontology Annotation: Molecular function=proteasome endopeptidase activity; Cellular component=proteasome regulatory particle (sensu Eukarya); Biological process=proteolysis and peptidolysis
  misc_feature (4)..(9): Xaa can be any naturally occurring amino acid
  misc_feature (85)..(90): Xaa can be any naturally occurring amino acid
NTLXXXXXXSYTRIIIYRISDVRDVSHGETEEFLSQMVVSTTIKATTDTSAGVVHFHHSKDPSDVMNEWAHDVTQLTQHVNIITXXXXXXECVHKHLQSTSA

SEQ ID NO: 26042 - protein, 33 aa, Diabrotica virgifera
  misc_feature: Coding regions on vcDNA: vcDNA=SeqID_5739; Strand=+; Position=1-102
RVRLKIRFDCNLIFKYKLGLAIFRFYSHFIMYA

SEQ ID NO: 26043 - protein, 70 aa, Diabrotica virgifera
  misc_feature: Coding regions on vcDNA: vcDNA=SeqID_5740; Strand=-; Position=63-275
  misc_feature (17)..(25): Xaa can be any naturally occurring amino acid
  misc_feature (46)..(55): Xaa can be any naturally occurring amino acid
LNLSINKKFLTSRHYNXXXXXXXXXEICKCLIIIYMYKLNINQILXXXXXXXXXXLTNVKIFHYIYSDNK

SEQ ID NO: 26044 - protein, 121 aa, Diabrotica virgifera
  misc_feature: Coding regions on vcDNA: vcDNA=SeqID_5741; Strand=+; Position=44-406
  misc_feature: Homolog annotation: Hit_ID=XP_418226.1; Match level="QueryCoverage =52%, HitCoverage=49%, E-value=3e-19, Identity=66%"; Hit description =PREDICTED: similar to Serine/threonine-protein kinase 11 (Serine/threonine-protein
  misc_feature: Gene Ontology Annotation: Molecular function=protein serine/threonine kinase activity; Biological process=protein amino acid phosphorylation
  misc_feature (51)..(58): Xaa can be any naturally occurring amino acid
MRKVSNCKIVNSESIDIAEQEKELGNFIYSAENESDPVESEEAQDICINEXXXXXXXXDLENVNIAIFFHRVDSDQIIYQKKKRKLKLVGKYVMGDLLGEGAYGKVKEMLDSETLCRRAVK

SEQ ID NO: 26045 - protein, 31 aa, Diabrotica virgifera
  misc_feature: Coding regions on vcDNA: vcDNA=SeqID_5742; Strand=+; Position=40-132
  misc_feature (3)..(3): Xaa can be any naturally occurring amino acid
TTXADAAPAGGRGGFRGGFGGGGRGGGRGGP

SEQ ID NO: 26046 - protein, 41 aa, Diabrotica virgifera
  misc_feature: Coding regions on vcDNA: vcDNA=SeqID_5743; Strand=+; Position=2-127
TRPINMSPLHIHNHSRSLNCIEIITSCMMTQNMHLSPGFTI

SEQ ID NO: 26047 - protein, 106 aa, Diabrotica virgifera
  misc_feature: Coding regions on vcDNA: vcDNA=SeqID_5744; Strand=+; Position=20-340
  misc_feature: Homolog annotation: Hit_ID=YP_034724.1; Match level="QueryCoverage =100%, HitCoverage=69%, E-value=5e-18, Identity=40%"; Hit description= surface protein, pentapeptide repeat domain [Bacillus thuringiensis serovar konkukian str.
  misc_feature (27)..(27): Xaa can be any naturally occurring amino acid
  misc_feature (55)..(55): Xaa can be any naturally occurring amino acid
GSGGKGIGENGNGGTGNGNSGEGIDNXDDDCDDKDNGNGNGRRGNNNGRDGIEEXGSTDKGDGDKRIGGNRTGEQGAGWHGTGENGNGGQHSADTGISDAGEGVGN

SEQ ID NO: 26048 - protein, 152 aa, Diabrotica virgifera
  misc_feature: Coding regions on vcDNA: vcDNA=SeqID_5745; Strand=+; Position=2-457
  misc_feature: Homolog annotation: Hit_ID=AAO43606.1; Match level="QueryCoverage =91%, HitCoverage=78%, E-value=6e-13, Identity=30%"; Hit description =serum lectin isoform 2 precursor [Salmo salar]
  misc_feature: Gene Ontology Annotation: Cellular component=integral to membrane
  misc_feature: Pfam annotation: Pfam_ID=Lectin_C; Match level="Score=84.8, E-value =2.3e-22, Copies=1"; Pfam description=Lectin C-type domain
STQDSKISLTKSQGDTCPAQSPKNVYYLGDKQVTWSDAIIACQAVGMSLVSIQSQAKQDEIINYLEVRKVNYTGLDNSIWISGNRRLDKVKWFWLAVEPIIYTNFLPGEPNNSGGNEECLTVVYSGRPGWNDIACSSKFYPLCEKENCCAGC

SEQ ID NO: 26049 - protein, 81 aa, Diabrotica virgifera
  misc_feature: Coding regions on vcDNA: vcDNA=SeqID_5746; Strand=+; Position=15-257
  misc_feature (60)..(60): Xaa can be any naturally occurring amino acid
VIFLSVNNFGKILATGNILIGGRTGFIGKSLYNLVKYIWCGVTLISRMLGIHRISCNELXISSLPDDILSLVNLAGLNVMD

SEQ ID NO: 26050 - protein, 52 aa, Diabrotica virgifera
  misc_feature: Coding regions on vcDNA: vcDNA=SeqID_5747; Strand=-; Position=79-237
FQYFIHVVLVENDFIESLCFPIFNLIYSFYRSFCIESEVLGQISHHYYNLGY

SEQ ID NO: 26051 - protein, 88 aa, Diabrotica virgifera
  misc_feature: Coding regions on vcDNA: vcDNA=SeqID_5748; Strand=+; Position=1-266
  misc_feature: Homolog annotation: Hit_ID=NP_536731.1; Match level="QueryCoverage =98%, HitCoverage=17%, E-value=7e-14, Identity=48%"; Hit description =CG6871-PA [Drosophila melanogaster] gb|AAF49228.1| CG6871-PA [Drosophila melanogaster]
  misc_feature: Gene Ontology Annotation: Molecular function=catalase activity; Cellular component=cytoplasm; Biological process=response to hydrogen peroxide
  misc_feature (30)..(30): Xaa can be any naturally occurring amino acid
  misc_feature (57)..(57): Xaa can be any naturally occurring amino acid
  misc_feature (71)..(71): Xaa can be any naturally occurring amino acid
KDSSTNQLLIYKNVTHGGESVSTGYGNPVXQFASLNVWPRCPILVVDQSLVDELSHXNKERRPDRVVHAKXLVLSRYFECTNDITQYS

SEQ ID NO: 26052 - protein, 79 aa, Diabrotica virgifera
  misc_feature: Coding regions on vcDNA: vcDNA=SeqID_5749; Strand=+; Position=2-241
CIIRSAQMPYHHLIRCRHVIQFRQKGHTGTIRVSIFRSSIYSCQISRLYSRKSSVHIRKTAEFVKRWHNLITLNRTINI

SEQ ID NO: 26053 - protein, 53 aa, Diabrotica virgifera
  misc_feature: Coding regions on vcDNA: vcDNA=SeqID_5750; Strand=+; Position=78-239
  misc_feature (23)..(23): Xaa can be any naturally occurring amino acid
  misc_feature (31)..(31): Xaa can be any naturally occurring amino acid
RVFGVDIGFGICRAGFAVDDAVXAVSPWIIXFPIHHGVIVGLGLLESYVSHHT

SEQ ID NO: 26054 - protein, 54 aa, Diabrotica virgifera
  misc_feature: Coding regions on vcDNA: vcDNA=SeqID_5751; Strand=-; Position=86-250
TWLSQLMAFPVSHFLNRNCSSRDSNVLYQPLSLVSLQNFLNVLNLVDPLHSSIK

SEQ ID NO: 26055 - protein, 58 aa, Diabrotica virgifera
  misc_feature: Coding regions on vcDNA: vcDNA=SeqID_5752; Strand=+; Position=3-179
PKPLESVVILIGTLLDFALCGIAAIARKALMTGLITHHLSVIIGLKAINHRHKATRNR

SEQ ID NO: 26056 - protein, 56 aa, Diabrotica virgifera
  misc_feature: Coding regions on vcDNA: vcDNA=SeqID_5753; Strand=+; Position=3-170
  misc_feature (22)..(28): Xaa can be any naturally occurring amino acid
EHYNLEALRSYDKDRKTQAVRXXXXXXXQRIHLVHHRLREARVPQLDVSRSHVVKV

SEQ ID NO: 26057 - protein, 102 aa, Diabrotica virgifera
  misc_feature: Coding regions on vcDNA: vcDNA=SeqID_5754; Strand=+; Position=59-367
  misc_feature: Homolog annotation: Hit_ID=XP_309801.1; Match level="QueryCoverage =96%, HitCoverage=18%, E-value=2e-23, Identity=56%"; Hit description =ENSANGP00000018236 [Anopheles gambiae]
  misc_feature: Gene Ontology Annotation: Biological process=ubiquitin-dependent protein catabolism
  misc_feature (81)..(81): Xaa can be any naturally occurring amino acid
MIIDDDMIFDDSGNETSGDDVHFGIDADSGCSSTEFQSFEEEYQYDVLSTEEIVVHMNDCIQDVNVVVQVPATVTRIHLNXFTWDTEKLMEKFFDGNQDEVF

SEQ ID NO: 26058 - protein, 54 aa, Diabrotica virgifera
  misc_feature: Coding regions on vcDNA: vcDNA=SeqID_5755; Strand=-; Position=159-323
GQNTAAIRCMQWSGAKTYLIRKDMLVVYRWKQCCRIQMLKPIHLRLLYKVRLLI

SEQ ID NO: 26059 - protein, 44 aa, Diabrotica virgifera
  misc_feature: Coding regions on vcDNA: vcDNA=SeqID_5756; Strand=-; Position=185-319
YHWVNTMLIKLCWLLVFCRYASFYRDVVSRLIYLHRNVMRVLFL

SEQ ID NO: 26060 - protein, 128 aa, Diabrotica virgifera
  misc_feature: Coding regions on vcDNA: vcDNA=SeqID_5757; Strand=-; Position=1-384
  misc_feature (1)..(122): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLEACID

SEQ ID NO: 26061 - protein, 50 aa, Diabrotica virgifera
  misc_feature: Coding regions on vcDNA: vcDNA=SeqID_5758; Strand=+; Position=120-269
LFIRILGGRSRDDPQCNLSFILPVFRSSDIVSLYKFASIWSHLFISLGFT

SEQ ID NO: 26062 - protein, 100 aa, Diabrotica virgifera
  misc_feature: Coding regions on vcDNA: vcDNA=SeqID_5759; Strand=+; Position=77-376
  misc_feature: Homolog annotation: Hit_ID=NP_955920.2; Match level="QueryCoverage =90%, HitCoverage=7%, E-value=8e-27, Identity=54%"; Hit description =Unknown (protein for MGC:63684) [Danio rerio] gb|AAT68061.1| foie gras [Danio rerio]
MQSNIIQNSIELPPEVTVKPLALVGVSGLDIVNNAVHKSIWETFSSNRRIERAPVLFKLIDNAHEFPVIKPRRTSYDWYIPKGILKKNWMNKHLYEVPAV

SEQ ID NO: 26063 - protein, 31 aa, Diabrotica virgifera
  misc_feature: Coding regions on vcDNA: vcDNA=SeqID_5760; Strand=-; Position=10-105
NLTHYRQANHPNSNTKRCTTTYGLRASAPLT

SEQ ID NO: 26064 - protein, 144 aa, Diabrotica virgifera
  misc_feature: Coding regions on vcDNA: vcDNA=SeqID_5761; Strand=+; Position=1-432
  misc_feature: Homolog annotation: Hit_ID=XP_395435.1; Match level="QueryCoverage =99%, HitCoverage=26%, E-value=1e-62, Identity=51%"; Hit description =similar to kelch-like 10 [Apis mellifera]
  misc_feature: Gene Ontology Annotation: Molecular function=actin binding; Cellular component=cytoplasm; Biological process=actin cytoskeleton organization and biogenesis
  misc_feature: Pfam annotation: Pfam_ID=Kelch_1; Match level="Score=156.6, E-value =5.6e-44, Copies=3"; Pfam description=Kelch motif
PTRPVGFKIYVIGGFDGMDYFNSCRCFDAVTKTWKEVAPMHSRRCYVSTSVLKGTIYAMGGYDGHSRKNSAEKYDHRTNQWSLIAPMNMQRSDASACNLDGKIYITGGFNGQECMHSAEVYDPELNQWSLISPMRSRRSGVSCI

SEQ ID NO: 26065 - protein, 41 aa, Diabrotica virgifera
  misc_feature: Coding regions on vcDNA: vcDNA=SeqID_5762; Strand=-; Position=0-122
  misc_feature (26)..(37): Xaa can be any naturally occurring amino acid
TGERKCVRIPLVNLYIFTKSTTVYYXXXXXXXXXXXXIDIL

SEQ ID NO: 26066 - protein, 113 aa, Diabrotica virgifera
  misc_feature: Coding regions on vcDNA: vcDNA=SeqID_5763; Strand=+; Position=62-400
  misc_feature: Homolog annotation: Hit_ID=EAL31609.1; Match level="QueryCoverage =81%, HitCoverage=18%, E-value=2e-10, Identity=37%"; Hit description =GA10806-PA [Drosophila pseudoobscura]
MNKINYTVLKNDKIGRYLVASRDIKGGEVIISEKPLLIGPPISGLLICFNCCKEIKRIAYVLCASCGTAILCNAKCTGKFHTKEECEIFASKQINGRCIADNCQIIFPLRCLI

SEQ ID NO: 26067 - protein, 143 aa, Diabrotica virgifera
  misc_feature: Coding regions on vcDNA: vcDNA=SeqID_5764; Strand=+; Position=1-429
  misc_feature: Homolog annotation: Hit_ID=EAA08647.2; Match level="QueryCoverage =82%, HitCoverage=41%, E-value=2e-28, Identity=49%"; Hit description =ENSANGP00000013329 [Anopheles gambiae str. PEST] ref|XP_562754.1| ENSANGP00000013329 [Anopheles gambiae st
  misc_feature: Pfam annotation: Pfam_ID=Lactamase_B; Match level="Score=21.6, E -value=0.0024, Copies=1"; Pfam description=Metallo-beta-lactamase superfamily
TTRPHFCALNKCELSSSDDLKSRKLKRILIDTGDEGIPQYINHLKSVLTYEGIDLAHIFITHWHHDHIGGLNDILTELREKTKHCQVWKYPSLKDDINKNELIESFKDGQEFAVEGATLRVVHTPGHTDDHIVLHLLKDNVIF

SEQ ID NO: 26068 - protein, 136 aa, Diabrotica virgifera
  misc_feature: Coding regions on vcDNA: vcDNA=SeqID_5765; Strand=+; Position=3-410
RSSSTPPSQQQPQINTANAGGVPHIVSVNAGRGRPASVEVEHPSAAMQSQPCNDFIVPCPNPGIQAVTRRQRLPPGVVYGDVSVESPIQNYTIIGGDGNVMVDHPGAAMQSQLISQQQQEQPSQAPPLVQKPVTNP

SEQ ID NO: 26069 - protein, 53 aa, Diabrotica virgifera
  misc_feature: Coding regions on vcDNA: vcDNA=SeqID_5766; Strand=+; Position=112-270
RLHYIIHLHTSYHTLEQHHYGLLTPSGVFTAPSNCKVLTSLCLRNIDLHLVLG

SEQ ID NO: 26070 - protein, 71 aa, Diabrotica virgifera
  misc_feature: Coding regions on vcDNA: vcDNA=SeqID_5767; Strand=+; Position=212-424
  misc_feature (17)..(17): Xaa can be any naturally occurring amino acid
MITVRSLATKMGSDIKXEGKLGQLTPQERQRQSQIVKEKLFGLDQFKDARNISIYLSLDTEIDTEPIVRKI

SEQ ID NO: 26071 - protein, 142 aa, Diabrotica virgifera
  misc_feature: Coding regions on vcDNA: vcDNA=SeqID_5768; Strand=+; Position=3-428
  misc_feature: Homolog annotation: Hit_ID=XP_393911.1; Match level="QueryCoverage =99%, HitCoverage=34%, E-value=3e-22, Identity=32%"; Hit description =similar to ENSANGP00000015265 [Apis mellifera]
  misc_feature: Gene Ontology Annotation: Molecular function=protein binding; Cellular component=extracellular space; Biological process =development
  misc_feature: Pfam annotation: Pfam_ID=LRR_1; Match level="Score=59.5, E-value=9.1e- 15, Copies=6"; Pfam description=Leucine Rich Repeat
  misc_feature (136)..(136): Xaa can be any naturally occurring amino acid
HASVTNLREIKLSKNFIQILEGNSFGNLKNLKSIYLDENDIMLVEQNFVKMLPSLKMLKLQKNKLEELAIHTFNTLLSLQNLDLQENILKIIDPNAFNLVPQLLTLNLSHNEISKIEDAGLQNLRSLELLDMSFNXIYTMSP

SEQ ID NO: 26072 - protein, 55 aa, Diabrotica virgifera
  misc_feature: Coding regions on vcDNA: vcDNA=SeqID_5769; Strand=-; Position=85-252
VKMQIKDPLHIFKWNTLYFILPSKSSLTTPAYLLNTPYTQSDYFSRYSSLFVDNS

SEQ ID NO: 26073 - protein, 22 aa, Diabrotica virgifera
  misc_feature: Coding regions on vcDNA: vcDNA=SeqID_5770; Strand=-; Position=0-65
SNYILIYSHILLNNTTHFRDVV

SEQ ID NO: 26074 - protein, 98 aa, Diabrotica virgifera
  misc_feature: Coding regions on vcDNA: vcDNA=SeqID_5771; Strand=-; Position=0-293
  misc_feature (94)..(94): Xaa can be any naturally occurring amino acid
  misc_feature (96)..(96): Xaa can be any naturally occurring amino acid
QNDLSTVRHGTCYSAELQYEATGIHMGCMDTHMRLCVPYQPGDPRALGARRLRGRRHPVRHRRRSQPATQRRQRQRQEPQDHAHTETTPRTTTXHXTG

SEQ ID NO: 26075 - protein, 66 aa, Diabrotica virgifera
  misc_feature: Coding regions on vcDNA: vcDNA=SeqID_5772; Strand=+; Position=12-212
VVVYFGVFLYPITIVLSGSVDVFFPGVLLTDLDVGYCAFRFIFCYADVVFDFMSFWKQAPQSISHL

SEQ ID NO: 26076 - protein, 47 aa, Diabrotica virgifera
  misc_feature: Coding regions on vcDNA: vcDNA=SeqID_5773; Strand=+; Position=172-315
CFDGYNLSRVVLKLISCEFLYQLLYFVSNLFEIVPKIPIKQIIITRK

SEQ ID NO: 26077 - protein, 138 aa, Diabrotica virgifera
  misc_feature: Coding regions on vcDNA: vcDNA=SeqID_5774; Strand=+; Position=41-454
  misc_feature: Homolog annotation: Hit_ID=XP_318737.1; Match level="QueryCoverage =97%, HitCoverage=66%, E-value=6e-54, Identity=69%"; Hit description =ENSANGP00000016579 [Anopheles gambiae]
  misc_feature: Pfam annotation: Pfam_ID=DUF667; Match level="Score=218.8, E-value =1.1e-62, Copies=1"; Pfam description=Protein of unknown function (DUF667)
HQFLKMFANSYQSGFISIFYSVGSNPLALWDKQVKNGHIRRIMDDDVKSLVLEISGTNVATTYITCPIKPRASLGIRLPFLIMIIKNMKKYFTFEIQILDDKDMRRRFRISNFQSSTKVRPFCTTMPMGLSSGWNQVQ

SEQ ID NO: 26078 - protein, 46 aa, Diabrotica virgifera
  misc_feature: Coding regions on vcDNA: vcDNA=SeqID_5775; Strand=+; Position=60-200
  misc_feature (30)..(37): Xaa can be any naturally occurring amino acid
FYIQNNTVDQVVLNSANTYLVMPKWLLNGXXXXXXXXITIQFTTIC

SEQ ID NO: 26079 - protein, 102 aa, Diabrotica virgifera
  misc_feature: Coding regions on vcDNA: vcDNA=SeqID_5776; Strand=+; Position=119-424
  misc_feature: Homolog annotation: Hit_ID=NP_001002874.1; Match level="QueryCoverage= 100%, HitCoverage=49%, E-value=2e-15, Identity=36%"; Hit description =hypothetical protein FLJ13912 [Danio rerio] gb|AAT68050.1| FLJ13912 -like [Danio rerio]
MPLPASYTPNYFSMEDILATQERTPCKIVQTIPNMGHLNSSAAEKDLQPGTSHEFPLWLVSEISFSRQPLVQPDLPKIYKEAYREILKADACAVDLHKFNLY

SEQ ID NO: 26080 - protein, 48 aa, Diabrotica virgifera
  misc_feature: Coding regions on vcDNA: vcDNA=SeqID_5777; Strand=-; Position=0-143
  misc_feature (11)..(44): Xaa can be any naturally occurring amino acid
GLPDEAFFFIXXXXXXXXXXXXXXXXXXXXXXXXXXXXXXXXXXANSL

SEQ ID NO: 26081 - protein, 80 aa, Diabrotica virgifera
  misc_feature: Coding regions on vcDNA: vcDNA=SeqID_5778; Strand=+; Position=14-256
  misc_feature (3)..(3): Xaa can be any naturally occurring amino acid
TWXLLCRARMGGSAAGIRVQLCPDQEVPVDLVHRRGHVVQQLAELHEDVKPSLRIMESEEVMNNMEAMRDSHALITYLSL

SEQ ID NO: 26082 - protein, 54 aa, Diabrotica virgifera
  misc_feature: Coding regions on vcDNA: vcDNA=SeqID_5779; Strand=+; Position=150-314
IVAEPGVTYWGCIQNVNIYCDLETLYPYVVLIGVSAFCYIEVTISHITFTYVQY

SEQ ID NO: 26083 - protein, 95 aa, Diabrotica virgifera
  misc_feature: Coding regions on vcDNA: vcDNA=SeqID_5780; Strand=+; Position=103-387
  misc_feature: Homolog annotation: Hit_ID=XP_316443.1; Match level="QueryCoverage =66%, HitCoverage=22%, E-value=6e-17, Identity=65%"; Hit description =ENSANGP00000021022 [Anopheles gambiae]
MHVLVIATILLAIEANSIPVTKSDDEAFKFPITFENGRIGVNFLGFHASAGLGGLLTGNSADGGLHAEAGTPFGQRAWAGLGGDINGASRSGGGL

SEQ ID NO: 26084 - protein, 68 aa, Diabrotica virgifera
  misc_feature: Coding regions on vcDNA: vcDNA=SeqID_5781; Strand=+; Position=87-293
ERHQRSSERIDKPTLCHMSTMTVDIELNFSIPKKNTRIFIFPKVYNSIKTESYRSKKCSRFILTMDKY

SEQ ID NO: 26085 - protein, 39 aa, Diabrotica virgifera
  misc_feature: Coding regions on vcDNA: vcDNA=SeqID_5782; Strand=-; Position=252-371
GRNCCCSQATRIVQECHQWLSQWYVMAGPQTLVEHHHET

SEQ ID NO: 26086 - protein, 59 aa, Diabrotica virgifera
  misc_feature: Coding regions on vcDNA: vcDNA=SeqID_5783; Strand=-; Position=154-333
  misc_feature (28)..(34): Xaa can be any naturally occurring amino acid
FVRIWLLIKGIIYRKKLVIFKTEYHCMXXXXXXXVDIHIKILITVALLRFVHIKCINIH

SEQ ID NO: 26087 - protein, 64 aa, Diabrotica virgifera
  misc_feature: Coding regions on vcDNA: vcDNA=SeqID_5784; Strand=+; Position=162-353
  misc_feature (47)..(47): Xaa can be any naturally occurring amino acid
PFNVKAHTFYKCMQDVSRTLGPQFEPKPINPTTFDVPHSPYYNSPIXVRRLHELNFQIGENAQA

SEQ ID NO: 26088 - protein, 75 aa, Diabrotica virgifera
  misc_feature: Coding regions on vcDNA: vcDNA=SeqID_5785; Strand=+; Position=51-278
PCRRTVDRRVHYLLVLDYKTRLHVARIVNVYLDEIQFKNYIAHHIASIGVKSDRAFYDTLKHRIRKITNLRHGQG

SEQ ID NO: 26089 - protein, 77 aa, Diabrotica virgifera
  misc_feature: Coding regions on vcDNA: vcDNA=SeqID_5786; Strand=+; Position=3-236
KRTSKRQRLDTAINRSNLSISIELFQSIVVCKRYIAAIYRNWSWIGVGIGLHQFIVTIELFQFIFNRDNILQRLNSF

SEQ ID NO: 26090 - protein, 130 aa, Diabrotica virgifera
  misc_feature: Coding regions on vcDNA: vcDNA=SeqID_5787; Strand=-; Position=1-390
  misc_feature (65)..(78): Xaa can be any naturally occurring amino acid
  misc_feature (97)..(103): Xaa can be any naturally occurring amino acid
RLWYCNWIRLWHWNSNGLWNWYTYWSRNGYRYWTIYYNRVRSGNFNRLSNWNWNLLKNRMNKHGXXXXXXXXXXXXXXFLSILTTYLNWSGDWNFDXXXXXXXNWSIDSNWIRLRYRNRYCSVYGSGRVG

SEQ ID NO: 26091 - protein, 60 aa, Diabrotica virgifera
  misc_feature: Coding regions on vcDNA: vcDNA=SeqID_5788; Strand=+; Position=124-306
HMTTISYKHDESFPATRGHIRYDLVDIPHELPASHDAVSDPSLLKNFSIIPQYAVYRFES

SEQ ID NO: 26092 - protein, 54 aa, Diabrotica virgifera
  misc_feature: Coding regions on vcDNA: vcDNA=SeqID_5789; Strand=+; Position=168-332
  misc_feature (26)..(30): Xaa can be any naturally occurring amino acid
SLVNTHRPGNGDQYLAKMWCDTNALXXXXXLLIILRSKVFIPTFVKNFMVINDL

SEQ ID NO: 26093 - protein, 58 aa, Diabrotica virgifera
  misc_feature: Coding regions on vcDNA: vcDNA=SeqID_5790; Strand=-; Position=153-329
CLESPIDWIDLVGDGVPVSVACDLSLEVHSHLRIRLRTCCVSTSFWSPTDPMNWRPQT

SEQ ID NO: 26094 - protein, 24 aa, Diabrotica virgifera
  misc_feature: Coding regions on vcDNA: vcDNA=SeqID_5791; Strand=-; Position=37-111
LNVMLEMGAMVEKMNRLNGKYGYK

SEQ ID NO: 26095 - protein, 107 aa, Diabrotica virgifera
  misc_feature: Coding regions on vcDNA: vcDNA=SeqID_5792; Strand=+; Position=58-378
VNKMHSVISVLSRIKNIVPELQNALPNLTFHEVSNAELDKQFKESHIIVADYDLLTPHMYSLPQAKWVQGTWAGVNDLMAKVTQPPPFSLSRFTGRHFGALMSEYVV

SEQ ID NO: 26096 - protein, 79 aa, Diabrotica virgifera
  misc_feature: Coding regions on vcDNA: vcDNA=SeqID_5793; Strand=-; Position=2-238
  misc_feature (4)..(12): Xaa can be any naturally occurring amino acid
  misc_feature (67)..(76): Xaa can be any naturally occurring amino acid
LATXXXXXXXXXGSLPAIVDPIADDHLSEEAMSGIVGWPLAHEGLKPHTYTVNTLFGVTTNSSTLEXXXXXXXXXXTRP

SEQ ID NO: 26097 - protein, 81 aa, Diabrotica virgifera
  misc_feature: Coding regions on vcDNA: vcDNA=SeqID_5794; Strand=-; Position=130-375
  misc_feature (29)..(37): Xaa can be any naturally occurring amino acid
  misc_feature (43)..(48): Xaa can be any naturally occurring amino acid
YVIWYVKNYKKQWVPPLYPQTVGYNFVLXXXXXXXXXITFFYXXXXXXALAIIFFRSLDHSKQKRYFVIFLKLVVFELKTT

SEQ ID NO: 26098 - protein, 57 aa, Diabrotica virgifera
  misc_feature: Coding regions on vcDNA: vcDNA=SeqID_5795; Strand=+; Position=223-396
LKKYAFKLISSYNKFYLKFISLSNFLVTFNKVIFTPRGGGIHPQDRGASWHYVTFVP

SEQ ID NO: 26099 - protein, 142 aa, Diabrotica virgifera
  misc_feature: Coding regions on vcDNA: vcDNA=SeqID_5796; Strand=+; Position=3-428
  misc_feature: Homolog annotation: Hit_ID=EAL29194.1; Match level="QueryCoverage =100%, HitCoverage=25%, E-value=6e-24, Identity=42%"; Hit description= GA20294-PA [Drosophila pseudoobscura]
TTTPSVGLGGLATTQAKVVTAQKDVTPKDQPLPNELLQTVEAFKGFVKQQKVYSSDISKCSARDFKKVEQDIKQLTALLKNVEHQLQINRQLAENLKYDTAKCLQDVEIAQRTQDTPPGLQYENTEPLKFFLNPADKFEKDM

SEQ ID NO: 26100 - protein, 19 aa, Diabrotica virgifera
  misc_feature: Coding regions on vcDNA: vcDNA=SeqID_5797; Strand=-; Position=1-57
YLILNILLITKSNVSPKKL

SEQ ID NO: 26101 - protein, 75 aa, Diabrotica virgifera
  misc_feature: Coding regions on vcDNA: vcDNA=SeqID_5798; Strand=-; Position=125-352
FANFPFSHDPCSLDFIFVIVEVHVGQWCISDLVVVVVGIWHGSCSPSSCTPMVATMRCMSREDVLNTEPVDPVCG

SEQ ID NO: 26102 - protein, 75 aa, Diabrotica virgifera
  misc_feature: Coding regions on vcDNA: vcDNA=SeqID_5799; Strand=+; Position=87-314
  misc_feature: Homolog annotation: Hit_ID=NP_511073.1; Match level="QueryCoverage =98%, HitCoverage=29%, E-value=5e-23, Identity=70%"; Hit description =CG10944-PB, isoform B [Drosophila melanogaster] gb|AAN09218.1| CG10944-PB, isoform B [Drosophila
  misc_feature: Gene Ontology Annotation: Cellular component=cytosolic ribosome (sensu Eukarya); Biological process=reproduction
  misc_feature: Pfam annotation: Pfam_ID=Ribosomal_S6e; Match level="Score=37.2, E -value=4.9e-08, Copies=1"; Pfam description=Ribosomal protein S6e
  misc_feature (58)..(58): Xaa can be any naturally occurring amino acid
MKLNVAYPATGSQTLFEVVDEHRIRIVHDKRMGQEVEADAHGDEGMGYISKISGGNDXQRFTMTQGVLTHGRVRR

SEQ ID NO: 26103 - protein, 86 aa, Diabrotica virgifera
  misc_feature: Coding regions on vcDNA: vcDNA=SeqID_5800; Strand=-; Position=2-259
LAKLQHAYPLRSHHPPHPPLFQEHPEGLLLPSESGTIIYDAATYGPVDSCAYIETTTLFITAPFTILRGVYFVVVMGVVWIDCSSD

SEQ ID NO: 26104 - protein, 108 aa, Diabrotica virgifera
  misc_feature: Coding regions on vcDNA: vcDNA=SeqID_5801; Strand=+; Position=98-421
  misc_feature (43)..(66): Xaa can be any naturally occurring amino acid
STKKSNIGILYSFTFSIICLVYNSCSRVPFPGSNPHCSAISGXXXXXXXXXXXXXXXXXXXXXXXXIRIKVDSYHSSGYSPAIHFMLHISSITSTPTPISSIAFRVSA

SEQ ID NO: 26105 - protein, 55 aa, Diabrotica virgifera
  misc_feature: Coding regions on vcDNA: vcDNA=SeqID_5802; Strand=-; Position=0-164
NLICQVSLSILNVSEISHALYLYLSTCFFFYACLTCIYHLDYVYLLDHPSLIRLT

SEQ ID NO: 26106 - protein, 80 aa, Diabrotica virgifera
  misc_feature: Coding regions on vcDNA: vcDNA=SeqID_5803; Strand=-; Position=112-354
  misc_feature (31)..(37): Xaa can be any naturally occurring amino acid
IFRINFCINFLKLFITSLSILLIKSTSLNCXXXXXXXLCTKYKTNCKLFLRGYEKLLKQYLRVNSYSFFLQFRFIFHVNN

SEQ ID NO: 26107 - protein, 74 aa, Diabrotica virgifera
  misc_feature: Coding regions on vcDNA: vcDNA=SeqID_5804; Strand=+; Position=3-224
  misc_feature: Homolog annotation: Hit_ID=AAN10050.1; Match level="QueryCoverage =90%, HitCoverage=21%, E-value=3e-17, Identity=61%"; Hit description =Y-box protein Ct-p50 [Chironomus tentans]
  misc_feature: Gene Ontology Annotation: Molecular function=DNA binding; Cellular component=nucleus; Biological process=negative regulation of transcription from Pol II promoter
  misc_feature: Pfam annotation: Pfam_ID=CSD; Match level="Score=18.8, E-value=5.1e -05, Copies=1"; Pfam description='Cold-shock' DNA-binding domain
  misc_feature (48)..(48): Xaa can be any naturally occurring amino acid
AEQDYTAPEQPRAVALENELLATNVTGTVKWFIVKTGYGFITRNEIQXDVFVHQASIIKSIPKRAVRSVGDCEV

SEQ ID NO: 26108 - protein, 131 aa, Diabrotica virgifera
  misc_feature: Coding regions on vcDNA: vcDNA=SeqID_5805; Strand=+; Position=39-431
  misc_feature: Homolog annotation: Hit_ID=XP_315224.1; Match level="QueryCoverage =88%, HitCoverage=90%, E-value=4e-31, Identity=56%"; Hit description =ENSANGP00000023080 [Anopheles gambiae]
  misc_feature: Pfam annotation: Pfam_ID=Reeler; Match level="Score=-12.3, E-value =0.0051, Copies=1"; Pfam description=Reeler domain
MYRIGLMDVFSLVMGANCFPDGAPVDACVKPRVNQPYHGQARPQSPETNPFEVLQSEADYGPGTQITVTIQGVSNFKGFLIQARDVASNEWIGSWIETPNTKIHSECSAITHSDPNPKQSATLVRQASHNT

SEQ ID NO: 26109 - protein, 82 aa, Diabrotica virgifera
  misc_feature: Coding regions on vcDNA: vcDNA=SeqID_5806; Strand=+; Position=3-251
RGPTQASTVTRVKNDDEREKTGNGRTGLSKKSVSDIHILDHIPIEEIKSKTGRIYNTVDTIEFKQPLLFKNFNIANDWKTIQ

SEQ ID NO: 26110 - protein, 46 aa, Diabrotica virgifera
  misc_feature: Coding regions on vcDNA: vcDNA=SeqID_5807; Strand=-; Position=0-137
  misc_feature (2)..(37): Xaa can be any naturally occurring amino acid
PXXXXXXXXXXXXXXXXXXXXXXXXXXXXXXXXXXXXGRQYRGLYR

SEQ ID NO: 26111 - protein, 81 aa, Diabrotica virgifera
  misc_feature: Coding regions on vcDNA: vcDNA=SeqID_5808; Strand=+; Position=3-248
  misc_feature: Homolog annotation: Hit_ID=AAD46501.1; Match level="QueryCoverage =100%, HitCoverage=7%, E-value=2e-09, Identity=34%"; Hit description =latent nuclear antigen [Human herpesvirus 8]
NGDISIDEKIDKLVGSGTGEEESKENEVPNDQEAKEDKDSEDKKEGSVEKEEATKDDDVDENEEEDDKEDEKETSPEKSDE

SEQ ID NO: 26112 - protein, 71 aa, Diabrotica virgifera
  misc_feature: Coding regions on vcDNA: vcDNA=SeqID_5809; Strand=+; Position=155-367
  misc_feature: Homolog annotation: Hit_ID=EAL30184.1; Match level="QueryCoverage =66%, HitCoverage=9%, E-value=1e-11, Identity=63%"; Hit description =GA21198-PA [Drosophila pseudoobscura]
IEGGPNIQEKDDEPVAPRGFFNFLCHPLGSGHRFIALIFMCFLSFGSYFCYDNPAALQDKIKENLDLSEVQ

SEQ ID NO: 26113 - protein, 69 aa, Diabrotica virgifera
  misc_feature: Coding regions on vcDNA: vcDNA=SeqID_5810; Strand=-; Position=41-250
IRYKTKTRDILHFNSFREDQKRPYVNFTLIRDRQKGIYGQIPEEGISLYSLNNLYQGEIKNIILTMKQM

SEQ ID NO: 26114 - protein, 114 aa, Diabrotica virgifera
  misc_feature: Coding regions on vcDNA: vcDNA=SeqID_5811; Strand=+; Position=1-342
  misc_feature: Homolog annotation: Hit_ID=XP_485924.1; Match level="QueryCoverage =100%, HitCoverage=49%, E-value=9e-31, Identity=47%"; Hit description= similar to Zinc finger protein 267 (Zinc finger protein HZF2) [Mus musculus]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=66.3, E-value =8.7e-17, Copies=2"; Pfam description=Zinc finger, C2H2 type
  misc_feature (68)..(74): Xaa can be any naturally occurring amino acid
  misc_feature (97)..(103): Xaa can be any naturally occurring amino acid
QHMRVHTGEKLYKCELCFKQFSDSSSLKKHLTVHTAEKPYKCEICFKQFVQSSDLKKHLRVHTGEKPXXXXXXXKQFTQAENLKCHLRIHTGEKPYXXXXXXXQFSDSSSLKKH

SEQ ID NO: 26115 - protein, 115 aa, Diabrotica virgifera
  misc_feature: Coding regions on vcDNA: vcDNA=SeqID_5812; Strand=+; Position=42-386
NMSHKIIFAVFTIVLLTLPFKAISACGGIKNVLIEVKDSESERSNITFSGCLERKNFGGKTITEIHIRNQNIPNIGWEYITHLVRLDVLELNNCKIKNIARGALKNLPRIRVVEV

SEQ ID NO: 26116 - protein, 81 aa, Diabrotica virgifera
  misc_feature: Coding regions on vcDNA: vcDNA=SeqID_5813; Strand=+; Position=12-257
  misc_feature (55)..(60): Xaa can be any naturally occurring amino acid
DSRVDTRLYRHSGERVGPSCVFSPYLEGTHYFPEHPLLMNHPIQGVILPAGFLTXXXXXXEIHTLFVDPTKAYDTILVRKL

SEQ ID NO: 26117 - protein, 63 aa, Diabrotica virgifera
  misc_feature: Coding regions on vcDNA: vcDNA=SeqID_5814; Strand=-; Position=3-191
ADYFRPYFYFVHACVESIIYHTERTQEFLNSCELPTYFSNIFFCRNILCKILSIVYTQDFLCM

SEQ ID NO: 26118 - protein, 47 aa, Diabrotica virgifera
  misc_feature: Coding regions on vcDNA: vcDNA=SeqID_5815; Strand=-; Position=180-323
VPTGNKSTQRSVFINPKRVFCIKNNHVFITKILKLRFVILNAKKVQT

SEQ ID NO: 26119 - protein, 112 aa, Diabrotica virgifera
  misc_feature: Coding regions on vcDNA: vcDNA=SeqID_5816; Strand=+; Position=27-365
  misc_feature: Homolog annotation: Hit_ID=XP_310764.1; Match level="QueryCoverage =96%, HitCoverage=64%, E-value=7e-31, Identity=59%"; Hit description =ENSANGP00000014840 [Anopheles gambiae]
  misc_feature: Gene Ontology Annotation: Molecular function=molecular_function unknown; Cellular component=intermediate filament; Biological process=epidermal differentiation
SESYDLVKKPEEGPEITIPTAAPTQPSKPEVYFIRYKTQKTAGGGTGFGGGSGIGGGIGGGIGGGIGGGIGGGIGGGIGGGGIGGGIGGGIGGGSGGGISSSYGPPGKSGPY

SEQ ID NO: 26120 - protein, 105 aa, Diabrotica virgifera
  misc_feature: Coding regions on vcDNA: vcDNA=SeqID_5817; Strand=+; Position=62-376
  misc_feature: Homolog annotation: Hit_ID=NP_724431.1; Match level="QueryCoverage =97%, HitCoverage=20%, E-value=2e-23, Identity=52%"; Hit description =CG11163-PD, isoform D [Drosophila melanogaster] ref|NP_724430.1| CG11163-PC, isoform C [Drosophila
  misc_feature: Gene Ontology Annotation: Molecular function=zinc porter activity; Cellular component=integral to membrane; Biological process=transport
  misc_feature (16)..(16): Xaa can be any naturally occurring amino acid
  misc_feature (77)..(85): Xaa can be any naturally occurring amino acid
GSVICNSKLICAIYKXYLAGSLAVMTDAAHLFSDLIGFLISLLAIWVGKKPPTKRMTFGYYRAEVIGALLSVLTIWXXXXXXXXXAIERIYTKDYEIQANTMMNI

SEQ ID NO: 26121 - protein, 49 aa, Diabrotica virgifera
  misc_feature: Coding regions on vcDNA: vcDNA=SeqID_5818; Strand=+; Position=103-252
  misc_feature (3)..(11): Xaa can be any naturally occurring amino acid
SIXXXXXXXXXLQGVPKHSVSTNIKDFNLDFQSHLSYFAHISINLYSQY

SEQ ID NO: 26122 - protein, 64 aa, Diabrotica virgifera
  misc_feature: Coding regions on vcDNA: vcDNA=SeqID_5819; Strand=+; Position=3-197
MISNYFVIYKMSMLSTLLILTICVRVYAQRWRIEGCPPGPSFSCRREVECDLLKCGRLPPWAVG

SEQ ID NO: 26123 - protein, 57 aa, Diabrotica virgifera
  misc_feature: Coding regions on vcDNA: vcDNA=SeqID_5820; Strand=+; Position=3-173
  misc_feature: Homolog annotation: Hit_ID=AAP37725.1; Match level="QueryCoverage =98%, HitCoverage=9%, E-value=6e-22, Identity=82%"; Hit description =At3g47000 [Arabidopsis thaliana] gb|AAM13073.1| beta-D-glucan exohydrolase-like protein [Arabidopsis thalia
  misc_feature (43)..(43): Xaa can be any naturally occurring amino acid
VEYPNGYPFVARSNKVVACAKHFVGDGGTDNGVNEGNTIASYXDLEKIHIPPYRKCL

SEQ ID NO: 26124 - protein, 49 aa, Diabrotica virgifera
  misc_feature: Coding regions on vcDNA: vcDNA=SeqID_5821; Strand=-; Position=33-182
FVQTKEHIKTFLILHLCPRLIPLLCIFIKLNLYIHLIEQFIPELGVNDD

SEQ ID NO: 26125 - protein, 96 aa, Diabrotica virgifera
  misc_feature: Coding regions on vcDNA: vcDNA=SeqID_5822; Strand=+; Position=3-293
  misc_feature (11)..(19): Xaa can be any naturally occurring amino acid
  misc_feature (21)..(35): Xaa can be any naturally occurring amino acid
  misc_feature (47)..(58): Xaa can be any naturally occurring amino acid
  misc_feature (67)..(77): Xaa can be any naturally occurring amino acid
PTSQRTRGYLXXXXXXXXXFXXXXXXXXXXXXXXXILLKFNFQITTXXXXXXXXXXXXIYFYILLLXXXXXXXXXXXLTLSKFSNHDNISINKLYI

SEQ ID NO: 26126 - protein, 63 aa, Diabrotica virgifera
  misc_feature: Coding regions on vcDNA: vcDNA=SeqID_5823; Strand=+; Position=1-192
SRAHARRLELWQLPRTINRKIPSQSYLKGHIILRELHSAVIAQVPIQRNATHLSQYPTPVWHS

SEQ ID NO: 26127 - protein, 81 aa, Diabrotica virgifera
  misc_feature: Coding regions on vcDNA: vcDNA=SeqID_5824; Strand=+; Position=172-415
  misc_feature: Homolog annotation: Hit_ID=EAL25033.1; Match level="QueryCoverage =79%, HitCoverage=15%, E-value=1e-23, Identity=73%"; Hit description =GA20753-PA [Drosophila pseudoobscura]
  misc_feature: Gene Ontology Annotation: Molecular function=alpha-N -acetylgalactosaminidase activity; Cellular component=lysosome
  misc_feature (65)..(65): Xaa can be any naturally occurring amino acid
MVSRLVLALVGLISTVNGLDNGLARTPPMGWMDWQRFRCLTNCTLYPDECISEKLFRDMADRMAXDGYLAAGYEYIMIDDC

SEQ ID NO: 26128 - protein, 59 aa, Diabrotica virgifera
  misc_feature: Coding regions on vcDNA: vcDNA=SeqID_5825; Strand=+; Position=132-308
FNFLWVCASFSSLLFKILVHTALGCLFRVCAVRAFANPGRSGSAQFDIWWQHLTGHHFF

SEQ ID NO: 26129 - protein, 125 aa, Diabrotica virgifera
  misc_feature: Coding regions on vcDNA: vcDNA=SeqID_5826; Strand=+; Position=3-377
  misc_feature (95)..(103): Xaa can be any naturally occurring amino acid
GRHTNPRPRRKKLWEKTGLKSFRVNMPVKGIEQNCANIRDSVNLTVRSKCDSFQMDSCFLSIDKISDGLPSHSMDLGNTFKISENITLAGTEICXXXXXXXXXWSTVFWDLLCQGRFRLNKVGPF

SEQ ID NO: 26130 - protein, 95 aa, Diabrotica virgifera
  misc_feature: Coding regions on vcDNA: vcDNA=SeqID_5827; Strand=+; Position=3-290
  misc_feature: Homolog annotation: Hit_ID=A35540; Match level="QueryCoverage=87%, HitCoverage=16%, E-value=2e-38, Identity=97%"; Hit description =cruciferin 1 precursor - rape
  misc_feature (90)..(90): Xaa can be any naturally occurring amino acid
GRPTRPITHGFAYVVQSHQNNFEWISFKTNANAMVSTLAGRTSALRALPLEVITNAFQISLEEARRIKFNTLETTLTRARGGQPQLIEEXTWLLL

SEQ ID NO: 26131 - protein, 66 aa, Diabrotica virgifera
  misc_feature: Coding regions on vcDNA: vcDNA=SeqID_5828; Strand=+; Position=210-407
PTEFYKTVNKQHQSLIDTNFLSLKTITKIRSGTGPYLGKSNGVEKWNSTSLIIAMNHYRNPHHKNL

SEQ ID NO: 26132 - protein, 36 aa, Diabrotica virgifera
  misc_feature: Coding regions on vcDNA: vcDNA=SeqID_5829; Strand=-; Position=36-146
QYYSFSIVHPIGMITYTLVLVIIYRGIVIMYLRYMM

SEQ ID NO: 26133 - protein, 95 aa, Diabrotica virgifera
  misc_feature: Coding regions on vcDNA: vcDNA=SeqID_5830; Strand=-; Position=104-391
EVFTSIGSFFWALPDVEAAAPLFPPAALLPPLAVEAVEVDGSQLEVIFLSSFDARETTLEFDVESNLSNQDIRDNKSEIPQNNKPEKHRPGSRTK

SEQ ID NO: 26134 - protein, 40 aa, Diabrotica virgifera
  misc_feature: Coding regions on vcDNA: vcDNA=SeqID_5831; Strand=-; Position=42-164
ASGHCVLMPLMQRLDHNTIWHRLEFGHSEDTVHLDTMMGL

SEQ ID NO: 26135 - protein, 85 aa, Diabrotica virgifera
  misc_feature: Coding regions on vcDNA: vcDNA=SeqID_5832; Strand=-; Position=118-375
DYQRIGTCAPRIIIVVARTGERTLPDKSKIFRQFSTTPYNLKVKKFGLYLNILLQEINAPPQKRIIFDVSNLPNLLFDPNDFFNM

SEQ ID NO: 26136 - protein, 104 aa, Diabrotica virgifera
  misc_feature: Coding regions on vcDNA: vcDNA=SeqID_5833; Strand=+; Position=67-379
  misc_feature: Homolog annotation: Hit_ID=XP_318439.1; Match level="QueryCoverage =94%, HitCoverage=16%, E-value=6e-16, Identity=40%"; Hit description =ENSANGP00000014231 [Anopheles gambiae] gb|AAP47148.1| ammonium transport-like protein
  misc_feature (18)..(18): Xaa can be any naturally occurring amino acid
  misc_feature (55)..(55): Xaa can be any naturally occurring amino acid
YNYNWSFGMQESGCVSIXHQVVLMMSPVVEIMLSRLTQCMLGYSRSYSSSEYNSXVIALSDIINDPSVMDHLTGYIYTAMNMQTAIANTDSTILSGATGKGCNF

SEQ ID NO: 26137 - protein, 83 aa, Diabrotica virgifera
  misc_feature: Coding regions on vcDNA: vcDNA=SeqID_5834; Strand=-; Position=110-361
  misc_feature (17)..(23): Xaa can be any naturally occurring amino acid
NNEFTPNFCIKLYNTLXXXXXXXFRLSHLVFHIICIMLSFQNSARCRNYLNIHQGNKAKIYHVRNTCVARFQMGFFGYYILYT

SEQ ID NO: 26138 - protein, 121 aa, Diabrotica virgifera
  misc_feature: Coding regions on vcDNA: vcDNA=SeqID_5835; Strand=+; Position=37-399
  misc_feature: Homolog annotation: Hit_ID=XP_320479.1; Match level="QueryCoverage =97%, HitCoverage=21%, E-value=2e-44, Identity=70%"; Hit description =ENSANGP00000015642 [Anopheles gambiae]
  misc_feature: Gene Ontology Annotation: Molecular function=arylsulfatase activity; Cellular component=lysosome; Biological process=binding of sperm to zona pellucida
  misc_feature (40)..(40): Xaa can be any naturally occurring amino acid
  misc_feature (79)..(79): Xaa can be any naturally occurring amino acid
  misc_feature (86)..(93): Xaa can be any naturally occurring amino acid
SSASKPPNIVFIMADELGWNDVSFHGSGQIPTPNIDALAXSGLILQNYYVNPICTRSRSALMTGKHPIHTGMQHTVLFXAEARGLXXXXXXXXQYLEELGYENHIVGKWHLGSDKLEYTAM

SEQ ID NO: 26139 - protein, 124 aa, Diabrotica virgifera
  misc_feature: Coding regions on vcDNA: vcDNA=SeqID_5836; Strand=+; Position=3-377
  misc_feature (73)..(73): Xaa can be any naturally occurring amino acid
FGSQIFNKWYWVCFSNIPAKLYFRVACTMDNHFPSFSTILLILEFRNLFFVLLKFFFYFSPVFLYYIFKFAFXLFYLVFHCCQTSFYFLFILFYAFLYFLIVLFYCLFCFLLIVIHFLLCFLHC

SEQ ID NO: 26140 - protein, 69 aa, Diabrotica virgifera
  misc_feature: Coding regions on vcDNA: vcDNA=SeqID_5837; Strand=-; Position=194-403
  misc_feature (38)..(46): Xaa can be any naturally occurring amino acid
TLKLNLQLNKHSFKSYASLKFMFIFTDDFFIDRLTDYXXXXXXXXXPYTHLHILANVYSLFFVIIPYTG

SEQ ID NO: 26141 - protein, 49 aa, Diabrotica virgifera
  misc_feature: Coding regions on vcDNA: vcDNA=SeqID_5838; Strand=+; Position=96-245
SSNKNLIYYLITISEGESKTSNKLNFKRKLWLTQIKCKILTSLNFYKDR

SEQ ID NO: 26142 - protein, 82 aa, Diabrotica virgifera
  misc_feature: Coding regions on vcDNA: vcDNA=SeqID_5839; Strand=-; Position=52-300
SNFKGNSVCFSNLAFRALYISNFHELEEFWTQTLSPVLRDSSNLQHFVMFTCFGVFSAEITTHKDTTLKKPVKGDILSSFIN

SEQ ID NO: 26143 - protein, 94 aa, Diabrotica virgifera
  misc_feature: Coding regions on vcDNA: vcDNA=SeqID_5840; Strand=-; Position=83-367
  misc_feature (3)..(12): Xaa can be any naturally occurring amino acid
  misc_feature (17)..(28): Xaa can be any naturally occurring amino acid
  misc_feature (38)..(54): Xaa can be any naturally occurring amino acid
  misc_feature (61)..(71): Xaa can be any naturally occurring amino acid
  misc_feature (84)..(90): Xaa can be any naturally occurring amino acid
KYXXXXXXXXXXIIMLXXXXXXXXXXXXVLFNDEQHIXXXXXXXXXXXXXXXXXSCSNYVXXXXXXXXXXXSMLHMLQINKFFXXXXXXXLPHY

SEQ ID NO: 26144 - protein, 126 aa, Diabrotica virgifera
  misc_feature: Coding regions on vcDNA: vcDNA=SeqID_5841; Strand=+; Position=2-379
  misc_feature: Homolog annotation: Hit_ID=CAG04279.1; Match level="QueryCoverage =80%, HitCoverage=17%, E-value=4e-24, Identity=50%"; Hit description =unnamed protein product [Tetraodon nigroviridis]
  misc_feature: Gene Ontology Annotation: Molecular function=procollagen-lysine 5 -dioxygenase activity; Cellular component=membrane; Biological process=protein modification
GVSAEIEIATRQEKEGEGELYYVRNTLTRTEPLVIHGNGAAKYALNYLSNYVPNVWNSVDGCKQCKKGAISLGTTAPKDFPSVLISVFIEQSTPFLEEMLQKVYFLDYPKERLHIFIHNSVKYHVD

SEQ ID NO: 26145 - protein, 71 aa, Diabrotica virgifera
  misc_feature: Coding regions on vcDNA: vcDNA=SeqID_5842; Strand=+; Position=3-218
  misc_feature (24)..(30): Xaa can be any naturally occurring amino acid
LLYTNPLFFSKTKENFYLLILNYXXXXXXXFYPRCGYSLYPAYQGLSSSNYILITCAFTGATILSFLLSTK

SEQ ID NO: 26146 - protein, 80 aa, Diabrotica virgifera
  misc_feature: Coding regions on vcDNA: vcDNA=SeqID_5843; Strand=+; Position=83-322
YTQVFSLKLMFMLPNICHKSCGRSTGLMPIIAFTSASSSSPQLTETNAVSEDVSDHAEHLRALQRAPQPEKSIVAAAFAS

SEQ ID NO: 26147 - protein, 125 aa, Diabrotica virgifera
  misc_feature: Coding regions on vcDNA: vcDNA=SeqID_5844; Strand=+; Position=2-376
  misc_feature (25)..(31): Xaa can be any naturally occurring amino acid
PRVRFRIKLIVLLCQFWSIHKIFMXXXXXXXSKKMACGDCGSCGQCCGSPCSPAMYPHAVCCMSCPPPIILPTKPEPVEPLQMPCALIKDECIPEDVALQKRYQNFYNALYEDWHCITPSNRGPM

SEQ ID NO: 26148 - protein, 142 aa, Diabrotica virgifera
  misc_feature: Coding regions on vcDNA: vcDNA=SeqID_5845; Strand=+; Position=3-428
RPTRQGRMACIWDMRNSVAASLLYSNEFSAINSVSWNQSDTNYIAVGTQAGDVYLLDKREPKDFVSVISCFSSPVNKLRFNNSNLAVCGDSKDVLVVNTQSNSMNVIYKNEEHKGHVKGLSWNKDVLFFWWILKDSQVNHVI

SEQ ID NO: 26149 - protein, 89 aa, Diabrotica virgifera
  misc_feature: Coding regions on vcDNA: vcDNA=SeqID_5846; Strand=+; Position=39-308
VQQKIQCLILVSVRKIMFFWYLKILKTLVVCLNKNALVDIFKTKYQETTFADIFTMVFILEFSKRLILYAMQMTQPLLFVRALGKKLLP

SEQ ID NO: 26150 - protein, 148 aa, Diabrotica virgifera
  misc_feature: Coding regions on vcDNA: vcDNA=SeqID_5847; Strand=-; Position=2-448
  misc_feature (77)..(77): Xaa can be any naturally occurring amino acid
  misc_feature (117)..(117): Xaa can be any naturally occurring amino acid
  misc_feature (120)..(120): Xaa can be any naturally occurring amino acid
  misc_feature (122)..(122): Xaa can be any naturally occurring amino acid
  misc_feature (124)..(124): Xaa can be any naturally occurring amino acid
  misc_feature (130)..(130): Xaa can be any naturally occurring amino acid
  misc_feature (140)..(142): Xaa can be any naturally occurring amino acid
  misc_feature (144)..(144): Xaa can be any naturally occurring amino acid
LRWWDVHALTMAEKSSNVGGVCEGGRGSVPRSRNILLQHFWGVLGSDGSQWLLGSPWSRPVFLLRVPRFLPFSWWVXCLLLLWVGVWRWLWRLVSSAGPLRPLGSVRLRKILLAGAXLSXLXRXLPVPVXLPPLKSPSSXXXKXIPGL

SEQ ID NO: 26151 - protein, 59 aa, Diabrotica virgifera
  misc_feature: Coding regions on vcDNA: vcDNA=SeqID_5848; Strand=+; Position=311-487
ERKERVLESNLRIETTDAEDIQDVMMVRHDPSHLDDILPGDYLTVDFMEEHYHEDLHLA

SEQ ID NO: 26152 - protein, 272 aa, Diabrotica virgifera
  misc_feature: Coding regions on vcDNA: vcDNA=SeqID_5849; Strand=+; Position=65-883
  misc_feature: Homolog annotation: Hit_ID=XP_394638.1; Match level="QueryCoverage =95%, HitCoverage=48%, E-value=3e-44, Identity=39%"; Hit description =similar to ENSANGP00000014809 [Apis mellifera]
  misc_feature: Gene Ontology Annotation: Molecular function=DNA-directed RNA polymerase III activity; Cellular component=DNA-directed RNA polymerase III complex; Biological process=regulation of transcription from Pol III promoter
  misc_feature: Pfam annotation: Pfam_ID=RNA_pol_Rpc82; Match level="Score=-219.7, E -value=0.0016, Copies=1"; Pfam description=RNA polymerase III subunit RPC82
  misc_feature (12)..(12): Xaa can be any naturally occurring amino acid
  misc_feature (199)..(209): Xaa can be any naturally occurring amino acid
  misc_feature (260)..(260): Xaa can be any naturally occurring amino acid
MFMCLVIIYHFXKVLSIILAERFGAVVEKVGTCLYQYGSAPLLHIKKRTELPLSKLKESLAILIKYQLVTFVPNQNENLANYCIKPDKVLLMLRYPKYINLIKKKFGDASEMIIEEYLLRSYISASEALIKIHERLSKNNENNVSFGQLKNEFIALINAKYLIKLPHNEQEDKPVPKLVLNEKDMHILPPIDVNLLVKXXXXXXXXXXXKDIYWQINFDRFHQDMRDKIIFTAFAKKFDENAGELVKMLLQQMYIRTEPXADVSNPIPYLEI

SEQ ID NO: 26153 - protein, 101 aa, Diabrotica virgifera
  misc_feature: Coding regions on vcDNA: vcDNA=SeqID_5850; Strand=-; Position=28-333
LNNLVKYICFPGIDYNYCRSRRKLSEHFSNNSTANQQCHSRNNIQSNHATLIRRRKIMQMRWPFNILLTKYKLFSFLHNLQMLKKHSYNKSSLVRNSLLHS

SEQ ID NO: 26154 - protein, 122 aa, Diabrotica virgifera
  misc_feature: Coding regions on vcDNA: vcDNA=SeqID_5851; Strand=-; Position=21-389
FGAQKKTQRMGSLVACVSSQDSTCGISSVGPSTKFSSIMVESTVANASSFVPLARTVEEGPIFNATFDSTAVKEDRKLSLLSELEASRVLAFGIVETTISGSAPVTFSFALTTIIVSPYILF

SEQ ID NO: 26155 - protein, 76 aa, Diabrotica virgifera
  misc_feature: Coding regions on vcDNA: vcDNA=SeqID_5852; Strand=-; Position=403-633
KIGKEASKRKAVGDMELNHKPTSYMNIILIFKEARSHNALDVFESQCFFSSPLFYMKLAAFHFNSGLLITYDLRGL

SEQ ID NO: 26156 - protein, 264 aa, Diabrotica virgifera
  misc_feature: Coding regions on vcDNA: vcDNA=SeqID_5853; Strand=+; Position=1-792
  misc_feature: Homolog annotation: Hit_ID=XP_307136.1; Match level="QueryCoverage =37%, HitCoverage=27%, E-value=2e-23, Identity=51%"; Hit description =ENSANGP00000012765 [Anopheles gambiae]
  misc_feature: Gene Ontology Annotation: Molecular function=protein serine/threonine kinase activity; Cellular component=centrosome; Biological process =regulation of cell cycle
GSHGREADVWGLGCLLYTLLVGESPFESPGVKSTLTKIVMESYNLPSYLTSDAKDLINCLLQKNPNDRMKLDQILEHPFMKKGRHMMYQVSHDSGNYTMSSKRDSTFDNISLPHSQNVYATNGHVRKANSNCLPLQNNYADNQLPSDMERLRVRSYEGLPTYRDLRPTEQISRCSQHSHCCCNRPATSLRSCSQERAIPVDPGGYQYQPKYNNGSLHSHHSDPPLSSNAGSHVNHSVSGGYIHSPHLTEKHIARDHSSRIERKS

SEQ ID NO: 26157 - protein, 76 aa, Diabrotica virgifera
  misc_feature: Coding regions on vcDNA: vcDNA=SeqID_5854; Strand=-; Position=1-228
HVDFATEMSPPSEKFLEGFDGHPHLLMRRLSLFFFVRPSPTTFHLRHSAHYFLRRSPSNYVLLRPCLPTLRMPSLP

SEQ ID NO: 26158 - protein, 116 aa, Diabrotica virgifera
  misc_feature: Coding regions on vcDNA: vcDNA=SeqID_5855; Strand=+; Position=79-429
  misc_feature (19)..(24): Xaa can be any naturally occurring amino acid
HRRNPYYRVKSLSYDTTGXXXXXXKIRRFSLIKLFTYATFPSINRITNAPSSIEWSRIINNLSSTLKFSRPRFDRWISKNKRLNGTNSHSYMNLQWFSNFSTLILNGPDADEWDHY

SEQ ID NO: 26159 - protein, 157 aa, Diabrotica virgifera
  misc_feature: Coding regions on vcDNA: vcDNA=SeqID_5856; Strand=+; Position=351-888
  misc_feature: Homolog annotation: Hit_ID=NP_510856.1; Match level="QueryCoverage =97%, HitCoverage=19%, E-value=5e-13, Identity=30%"; Hit description =predicted CDS, reverse transcriptase family member (XS300) [Caenorhabditis elegans]
  misc_feature (146)..(146): Xaa can be any naturally occurring amino acid
  misc_feature (151)..(151): Xaa can be any naturally occurring amino acid
RNQNKSLRHLRYADDIVLIANSKEEQEYMLEGLEHQAKTVGLTINLGKTKTMTNTEQDIAIPIRGSEIEQERECILAWAAFGKLSYILKNKKFAQHLKSKVFNQCVLPVITYGAQTWTLTKNNMNKLIKTQRAMETQILQIRLKHXNEPNXNRMLQS

SEQ ID NO: 26160 - protein, 40 aa, Diabrotica virgifera
  misc_feature: Coding regions on vcDNA: vcDNA=SeqID_5857; Strand=-; Position=12-134
FLGGEILGVFRRCDFELKLNSLGTRLFFSLFLFFRWLGGT

SEQ ID NO: 26161 - protein, 262 aa, Diabrotica virgifera
  misc_feature: Coding regions on vcDNA: vcDNA=SeqID_5858; Strand=+; Position=2-787
  misc_feature (42)..(47): Xaa can be any naturally occurring amino acid
  misc_feature (59)..(66): Xaa can be any naturally occurring amino acid
  misc_feature (68)..(91): Xaa can be any naturally occurring amino acid
  misc_feature (96)..(262): Xaa can be any naturally occurring amino acid
DFSFIFQNQSKSLFSVNSNRKNLSLHRSVNSVSVEMNHFHFXXXXXXHFFGTFAYPGIXXXXXXXXLXXXXXXXXXXXXXXXXXXXXXXXXNETLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 26162 - protein, 55 aa, Diabrotica virgifera
  misc_feature: Coding regions on vcDNA: vcDNA=SeqID_5859; Strand=-; Position=107-274
YSAAAPRSICLLNTSPRKQQLSTSTNSNTIHTYCRQIIGSVEMARSRCHVIKLQV

SEQ ID NO: 26163 - protein, 62 aa, Diabrotica virgifera
  misc_feature: Coding regions on vcDNA: vcDNA=SeqID_5860; Strand=-; Position=2-187
SESTIATLHAIMTCDLLTIKTWYDCNLLSINVAKTVALSYKVAYQPLLVNKRQISTVNSVKF

SEQ ID NO: 26164 - protein, 20 aa, Diabrotica virgifera
  misc_feature: Coding regions on vcDNA: vcDNA=SeqID_5861; Strand=-; Position=14-76
TGSHCGTHLVKWKMERLCHF

SEQ ID NO: 26165 - protein, 53 aa, Diabrotica virgifera
  misc_feature: Coding regions on vcDNA: vcDNA=SeqID_5862; Strand=+; Position=2-160
  misc_feature (7)..(7): Xaa can be any naturally occurring amino acid
  misc_feature (15)..(16): Xaa can be any naturally occurring amino acid
DIHQGDXLAILYEYXXSIIIFIGSQPKWAPNCFNNPKYLILFPNFRVRIPISN

SEQ ID NO: 26166 - protein, 106 aa, Diabrotica virgifera
  misc_feature: Coding regions on vcDNA: vcDNA=SeqID_5863; Strand=-; Position=97-417
  misc_feature (80)..(80): Xaa can be any naturally occurring amino acid
RDTLNAGRARRQSGQWQTACFFHNKCRGCTIYGQVWPGSLCHGAQAASLRLSEKWRARPAHVSAPNPCTQQGLYRSGTVXEFGPTWRIRACMYIGVRSPSMSGDSM

SEQ ID NO: 26167 - protein, 100 aa, Diabrotica virgifera
  misc_feature: Coding regions on vcDNA: vcDNA=SeqID_5864; Strand=+; Position=2-301
  misc_feature (72)..(72): Xaa can be any naturally occurring amino acid
GERDIPVSVDNLETADTAMIDYDVCMAVVDPSMDYKFPDLAQTLSCTGDFTGREDLCFVSNGSPTIQDRVVXRIYHSPTLACGVMGSAMLTLKTGPYVSW

SEQ ID NO: 26168 - protein, 37 aa, Diabrotica virgifera
  misc_feature: Coding regions on vcDNA: vcDNA=SeqID_5865; Strand=-; Position=28-141
  misc_feature (1)..(9): Xaa can be any naturally occurring amino acid
XXXXXXXXXPPIHGLIRRRDSSRIRSSALVPHIVARK

SEQ ID NO: 26169 - protein, 71 aa, Diabrotica virgifera
  misc_feature: Coding regions on vcDNA: vcDNA=SeqID_5866; Strand=+; Position=3-218
LIDSVTTTMSKIVLLLFTIGAMAVFSAAKQEPTVCYSCTIYDGDLCNDLNLSNRTKVRCPDMPQIIRQPQV

SEQ ID NO: 26170 - protein, 110 aa, Diabrotica virgifera
  misc_feature: Coding regions on vcDNA: vcDNA=SeqID_5867; Strand=-; Position=0-329
GKMTFQPSHQNDTVAAIQQKTDLKRDENTNQEIRDTLDVNTTFIEVEKSVTILQNTEDILQEIPTEHMSVNPEKIDTPAAKLENNLAADTFTTVVYDIVSQNKPEAIYIV

SEQ ID NO: 26171 - protein, 113 aa, Diabrotica virgifera
  misc_feature: Coding regions on vcDNA: vcDNA=SeqID_5868; Strand=+; Position=1-339
  misc_feature: Homolog annotation: Hit_ID=NP_998145.1; Match level="QueryCoverage =97%, HitCoverage=18%, E-value=1e-11, Identity=34%"; Hit description =zgc:77772 [Danio rerio] gb|AAH64889.1| Zgc:77772 [Danio rerio]
  misc_feature: Gene Ontology Annotation: Molecular function=aminopeptidase activity
  misc_feature (88)..(88): Xaa can be any naturally occurring amino acid
  misc_feature (92)..(92): Xaa can be any naturally occurring amino acid
VIIGNNNFTVFLNDKQNSSAVKEHLESEVENSSYKIENYDNIEKKIEELTNKVEGYIWFSEHSSFALTDLVPKKHRLLTDITPVCLMXGVQXDNDIQSMRNCHIKDAAALCCY

SEQ ID NO: 26172 - protein, 41 aa, Diabrotica virgifera
  misc_feature: Coding regions on vcDNA: vcDNA=SeqID_5869; Strand=-; Position=3-125
  misc_feature (18)..(24): Xaa can be any naturally occurring amino acid
LLLVYYTFISHFSLLLVXXXXXXXQNGIGIIFVNCAYVMPS

SEQ ID NO: 26173 - protein, 85 aa, Diabrotica virgifera
  misc_feature: Coding regions on vcDNA: vcDNA=SeqID_5870; Strand=+; Position=1-255
  misc_feature: Homolog annotation: Hit_ID=NP_573087.1; Match level="QueryCoverage =98%, HitCoverage=34%, E-value=4e-28, Identity=68%"; Hit description =CG9066-PA [Drosophila melanogaster] gb|AAF48534.1| CG9066-PA [Drosophila melanogaster]
  misc_feature: Gene Ontology Annotation: Molecular function=steroid hormone receptor activity; Cellular component=integral to membrane; Biological process= sterol metabolism
  misc_feature: Pfam annotation: Pfam_ID=Cyt-b5; Match level="Score=20.6, E-value =0.0049, Copies=1"; Pfam description=Cytochrome b5-like Heme/Steroid bindi
EELTKYDGTQPDGRFLVAVNGNVFDVTKGKRFYGPGGPYSPFGGRDASTCLATFEVNAVSENYDDLSDLSTMDMDSINEWESQFH

SEQ ID NO: 26174 - protein, 101 aa, Diabrotica virgifera
  misc_feature: Coding regions on vcDNA: vcDNA=SeqID_5871; Strand=+; Position=1-303
YAPERVSLGVESSDSDGVVARVMGQDYVYNYGVNLDLRYDQRQALLDYLRDVRSIQDIREDFVKSDSVCCVVIREYTDHAVVKWRPRANKDGCDPARSWDH

SEQ ID NO: 26175 - protein, 45 aa, Diabrotica virgifera
  misc_feature: Coding regions on vcDNA: vcDNA=SeqID_5872; Strand=+; Position=2-139
  misc_feature (4)..(11): Xaa can be any naturally occurring amino acid
AQKXXXXXXXXQDYCDYDKVSKYNMISNSNHYPFKGLIIIKLTGH

SEQ ID NO: 26176 - protein, 80 aa, Diabrotica virgifera
  misc_feature: Coding regions on vcDNA: vcDNA=SeqID_5873; Strand=-; Position=2-241
  misc_feature: Homolog annotation: Hit_ID=XP_393963.1; Match level="QueryCoverage =100%, HitCoverage=12%, E-value=8e-19, Identity=52%"; Hit description= similar to trehalase [Apis mellifera]
  misc_feature: Gene Ontology Annotation: Molecular function=alpha,alpha-trehalase activity; Cellular component=extrinsic to plasma membrane, GPI -anchored; Biological process=trehalose catabolism
SGEQWNLPNAWHPLQEIVILGLKNTNNSIALDMAEQLAKNYVESCILGYDKTQSMYEKYDSTTPGASGGGGEYNPQTGFG

SEQ ID NO: 26177 - protein, 39 aa, Diabrotica virgifera
  misc_feature: Coding regions on vcDNA: vcDNA=SeqID_5874; Strand=-; Position=2-118
CIDTRSHISRSCRSTTCDMRLGKVNQGQDVHPFVLQSAR

SEQ ID NO: 26178 - protein, 41 aa, Diabrotica virgifera
  misc_feature: Coding regions on vcDNA: vcDNA=SeqID_5875; Strand=+; Position=1-126
LLPNSAPCAQFCQARAVFCTICPLIYFNSHGMMTVLRSHYH

SEQ ID NO: 26179 - protein, 78 aa, Diabrotica virgifera
  misc_feature: Coding regions on vcDNA: vcDNA=SeqID_5876; Strand=+; Position=1-237
  misc_feature (76)..(76): Xaa can be any naturally occurring amino acid
VTYNSGGAFFHLSVVYGQLVYHLLILNFILINCSALMSELYHFSSLVCLLSKKHCKFFHCLVFINIFVINCRKHLXIH

SEQ ID NO: 26180 - protein, 99 aa, Diabrotica virgifera
  misc_feature: Coding regions on vcDNA: vcDNA=SeqID_5877; Strand=+; Position=3-299
  misc_feature: Homolog annotation: Hit_ID=AAP57537.3; Match level="QueryCoverage =87%, HitCoverage=13%, E-value=2e-23, Identity=54%"; Hit description =heat shock protein 70 [Locusta migratoria]
  misc_feature: Gene Ontology Annotation: Molecular function=protein binding; Biological process=reproduction
ARAQFGGRDKVLESYCFNFKSTMEDDIIKDQICESDDATVMEKCDEVLAWLDARHLDDDDDYDPSQQELEHICDPLIVNLYLSAGGAPSGRSGGFSCGA

SEQ ID NO: 26181 - protein, 38 aa, Diabrotica virgifera
  misc_feature: Coding regions on vcDNA: vcDNA=SeqID_5878; Strand=-; Position=1-114
YQVCENKLHATKQKQTFSKFVSSLNKQTSCKFVTLQLA

SEQ ID NO: 26182 - protein, 79 aa, Diabrotica virgifera
  misc_feature: Coding regions on vcDNA: vcDNA=SeqID_5879; Strand=+; Position=12-251
  misc_feature (5)..(11): Xaa can be any naturally occurring amino acid
  misc_feature (48)..(54): Xaa can be any naturally occurring amino acid
YCSFXXXXXXXKCPPMDFLSKKLTFFNSLVVFMSTSTCLTSNHRRNFXXXXXXXETTILYLFHLFIKISLNSNKISMTE

SEQ ID NO: 26183 - protein, 38 aa, Diabrotica virgifera
  misc_feature: Coding regions on vcDNA: vcDNA=SeqID_5880; Strand=-; Position=1-114
  misc_feature (2)..(2): Xaa can be any naturally occurring amino acid
  misc_feature (27)..(37): Xaa can be any naturally occurring amino acid
VXLDFTTTLTFTYCLYMYIFYEIGETXXXXXXXXXXXR

SEQ ID NO: 26184 - protein, 65 aa, Diabrotica virgifera
  misc_feature: Coding regions on vcDNA: vcDNA=SeqID_5881; Strand=-; Position=152-349
  misc_feature (1)..(2): Xaa can be any naturally occurring amino acid
  misc_feature (15)..(16): Xaa can be any naturally occurring amino acid
  misc_feature (22)..(22): Xaa can be any naturally occurring amino acid
  misc_feature (33)..(33): Xaa can be any naturally occurring amino acid
XXYRKLKVVTIAIAXXTLHIFXRNEKPKTLIGXYSKTTRDYLRGSDVKRFKCSFYSSEIISLKVV

SEQ ID NO: 26185 - protein, 109 aa, Diabrotica virgifera
  misc_feature: Coding regions on vcDNA: vcDNA=SeqID_5882; Strand=+; Position=1-330
  misc_feature: Pfam annotation: Pfam_ID=Attacin_C; Match level="Score=-10.8, E-value= 0.0061, Copies=1"; Pfam description=Attacin, C-terminal region
  misc_feature (92)..(92): Xaa can be any naturally occurring amino acid
  misc_feature (98)..(98): Xaa can be any naturally occurring amino acid
  misc_feature (101)..(101): Xaa can be any naturally occurring amino acid
  misc_feature (103)..(103): Xaa can be any naturally occurring amino acid
LDGTVGASKAWGSHGLKPDTFGGRVDYSHKPSGSSAFVNADRTPGYGTDVTAGGKYNFAGGKNWGADASAGYNRHFGGPGGTGKPQVGAGVXVHGNFXRIXYXVLLNYL

SEQ ID NO: 26186 - protein, 37 aa, Diabrotica virgifera
  misc_feature: Coding regions on vcDNA: vcDNA=SeqID_5883; Strand=-; Position=11-124
  misc_feature (7)..(7): Xaa can be any naturally occurring amino acid
NYVSNNXANTLAKITVQALTLKDFVCFFRQLLCHFVI

SEQ ID NO: 26187 - protein, 78 aa, Diabrotica virgifera
  misc_feature: Coding regions on vcDNA: vcDNA=SeqID_5884; Strand=+; Position=2-235
  misc_feature: Homolog annotation: Hit_ID=AAL78751.1; Match level="QueryCoverage =100%, HitCoverage=17%, E-value=1e-23, Identity=69%"; Hit description= translation elongation factor-1 gamma [Locusta migratoria]
  misc_feature: Gene Ontology Annotation: Molecular function=translation elongation factor activity; Cellular component=intracellular; Biological process=translational elongation
  misc_feature: Pfam annotation: Pfam_ID=GST_N; Match level="Score=56.5, E-value=7.3e- 14, Copies=1"; Pfam description=Glutathione S-transferase, N-terminal
  misc_feature (31)..(38): Xaa can be any naturally occurring amino acid
GTLYTYPENFRAAKTLIAAQYAKANVKVAPXXXXXXXXKTKEFTKKFPSGKVPAFESNDGKYLQDSNAIAYYVSNEQL

SEQ ID NO: 26188 - protein, 71 aa, Diabrotica virgifera
  misc_feature: Coding regions on vcDNA: vcDNA=SeqID_5885; Strand=+; Position=133-345
  misc_feature (10)..(10): Xaa can be any naturally occurring amino acid
  misc_feature (27)..(27): Xaa can be any naturally occurring amino acid
  misc_feature (53)..(54): Xaa can be any naturally occurring amino acid
  misc_feature (56)..(56): Xaa can be any naturally occurring amino acid
  misc_feature (62)..(62): Xaa can be any naturally occurring amino acid
  misc_feature (66)..(66): Xaa can be any naturally occurring amino acid
HTTHTILLIXCLGEIGANSSSTFFRSXITKKRYTQVQFNQPVSGVTIADHFSXXNXHQISYXLSFXNTFPA

SEQ ID NO: 26189 - protein, 60 aa, Diabrotica virgifera
  misc_feature: Coding regions on vcDNA: vcDNA=SeqID_5886; Strand=+; Position=71-250
  misc_feature: Homolog annotation: Hit_ID=AAV91413.1; Match level="QueryCoverage =83%, HitCoverage=59%, E-value=1e-10, Identity=68%"; Hit description =myosin 3 light chain [Lonomia obliqua]
  misc_feature (18)..(22): Xaa can be any naturally occurring amino acid
  misc_feature (45)..(45): Xaa can be any naturally occurring amino acid
  misc_feature (55)..(55): Xaa can be any naturally occurring amino acid
LEKLTSLTTAPAETRSSXXXXXKKAKRSGSNVFSMFSQSQVAEFXEAFQLMEHDXDGIIS

SEQ ID NO: 26190 - protein, 62 aa, Diabrotica virgifera
  misc_feature: Coding regions on vcDNA: vcDNA=SeqID_5887; Strand=+; Position=200-385
  misc_feature (16)..(16): Xaa can be any naturally occurring amino acid
  misc_feature (19)..(20): Xaa can be any naturally occurring amino acid
  misc_feature (55)..(60): Xaa can be any naturally occurring amino acid
FFSRFEVYIEEKLVIXEKXXGFLNLCGNYELYMSRKRHVRAANFTGCGLHLTMLXXXXXXLK

SEQ ID NO: 26191 - protein, 92 aa, Diabrotica virgifera
  misc_feature: Coding regions on vcDNA: vcDNA=SeqID_5888; Strand=+; Position=55-333
  misc_feature (16)..(16): Xaa can be any naturally occurring amino acid
  misc_feature (69)..(69): Xaa can be any naturally occurring amino acid
  misc_feature (80)..(82): Xaa can be any naturally occurring amino acid
KCEWHKGASKDRLSAXQKRWTRKLIDWRPTQQTTTTNTLDGRQECSRNGTKTHRTVKSGEKWEIPISTXGKTKLHDDDTXXXTILKSDKLCN

SEQ ID NO: 26192 - protein, 93 aa, Diabrotica virgifera
  misc_feature: Coding regions on vcDNA: vcDNA=SeqID_5889; Strand=+; Position=2-279
  misc_feature: Homolog annotation: Hit_ID=AAA84370.1; Match level="QueryCoverage =90%, HitCoverage=59%, E-value=5e-12, Identity=42%"; Hit description =beta-galactosidase alpha polypeptide
  misc_feature (49)..(49): Xaa can be any naturally occurring amino acid
  misc_feature (70)..(70): Xaa can be any naturally occurring amino acid
  misc_feature (88)..(88): Xaa can be any naturally occurring amino acid
GGRSRSSRISHGCGSSAPGGAPVHFWTMDNCYNKTLAVLLYRLDWENRXVNRITRLAAPLPFTIWLGTKXARVDRPSHHWRRLNGEWXIVSVK

SEQ ID NO: 26193 - protein, 105 aa, Diabrotica virgifera
  misc_feature: Coding regions on vcDNA: vcDNA=SeqID_5890; Strand=+; Position=1-315
  misc_feature: Homolog annotation: Hit_ID=NP_731942.1; Match level="QueryCoverage =70%, HitCoverage=23%, E-value=4e-11, Identity=45%"; Hit description =CG7390-PB, isoform B [Drosophila melanogaster] ref|NP_524353.2| CG7390-PA, isoform A [Drosophila
  misc_feature (75)..(84): Xaa can be any naturally occurring amino acid
LTIDTDGNLWLTAIFGSTLVKINPDDGKLLEKIVMSTPQPTSISFGGKNLNEMFVTTARIPVDGKIPPNPAGTTXXXXXXXXXXFKGDRIQSTIPCNSVYINIYV

SEQ ID NO: 26194 - protein, 60 aa, Diabrotica virgifera
  misc_feature: Coding regions on vcDNA: vcDNA=SeqID_5891; Strand=+; Position=125-307
  misc_feature (24)..(24): Xaa can be any naturally occurring amino acid
  misc_feature (27)..(27): Xaa can be any naturally occurring amino acid
FQLLVTIANMNLSNGELISMVLIXDLXEYNKNVVLALIIYHLPFPDRRQPRYFFRIVSTY

SEQ ID NO: 26195 - protein, 43 aa, Diabrotica virgifera
  misc_feature: Coding regions on vcDNA: vcDNA=SeqID_5892; Strand=-; Position=57-188
  misc_feature (9)..(9): Xaa can be any naturally occurring amino acid
FCHSNNSSXIIVSQPIKHVSEATLSYMPYKLIVSELTVEFIYN

SEQ ID NO: 26196 - protein, 115 aa, Diabrotica virgifera
  misc_feature: Coding regions on vcDNA: vcDNA=SeqID_5893; Strand=+; Position=1-344
  misc_feature: Homolog annotation: Hit_ID=XP_391944.1; Match level="QueryCoverage =100%, HitCoverage=4%, E-value=2e-41, Identity=77%"; Hit description =similar to ENSANGP00000019107 [Apis mellifera]
  misc_feature: Gene Ontology Annotation: Molecular function=structural molecule activity; Cellular component=focal adhesion; Biological process=cell adhesion
  misc_feature: Pfam annotation: Pfam_ID=I_LWEQ; Match level="Score=26.0, E-value =4.6e-10, Copies=1"; Pfam description=I/LWEQ domain
  misc_feature (71)..(71): Xaa can be any naturally occurring amino acid
  misc_feature (103)..(103): Xaa can be any naturally occurring amino acid
VSSSDDGQWSEGLISAARLVAAATHSLVESANALVQGLGSEKKLIAAAKQVASSTAQLLVACKGKAEGDTXATKKLHAAGNAVIRSTDNLVRAAQQAKSVEKXRYLILNKKMVGG

SEQ ID NO: 26197 - protein, 61 aa, Diabrotica virgifera
  misc_feature: Coding regions on vcDNA: vcDNA=SeqID_5894; Strand=+; Position=8-193
  misc_feature (2)..(8): Xaa can be any naturally occurring amino acid
YXXXXXXXTINVHLNKLDLSTMSSSYLQYLLILRYLLILQYLLILQYLLVFVQKADSVFFD

SEQ ID NO: 26198 - protein, 45 aa, Diabrotica virgifera
  misc_feature: Coding regions on vcDNA: vcDNA=SeqID_5895; Strand=-; Position=1-135
FGTGGIWNMVDLQPLLIDIYLHLLLLIICYIKFKIILIHRYNINT

SEQ ID NO: 26199 - protein, 98 aa, Diabrotica virgifera
  misc_feature: Coding regions on vcDNA: vcDNA=SeqID_5896; Strand=+; Position=32-325
  misc_feature: Homolog annotation: Hit_ID=NP_524404.1; Match level="QueryCoverage =100%, HitCoverage=36%, E-value=1e-40, Identity=81%"; Hit description= CG5269-PA [Drosophila melanogaster] gb|AAF55650.1| CG5269-PA [Drosophila melanogaster]
  misc_feature: Gene Ontology Annotation: Molecular function=phosphatidylcholine transporter activity; Cellular component=membrane fraction; Biological process=nonselective vesicle transport
  misc_feature: Pfam annotation: Pfam_ID=IP_trans; Match level="Score=-62.9, E-value =0.0013, Copies=1"; Pfam description=Phosphatidylinositol transfer protein
  misc_feature (40)..(40): Xaa can be any naturally occurring amino acid
  misc_feature (43)..(43): Xaa can be any naturally occurring amino acid
  misc_feature (45)..(45): Xaa can be any naturally occurring amino acid
  misc_feature (72)..(72): Xaa can be any naturally occurring amino acid
  misc_feature (81)..(81): Xaa can be any naturally occurring amino acid
MLIKEYRVTLPLTVEEYQVAQLFSVAEASKDNTGGGEGIXILXNXPFTNFPLLGGKYNSGQYTYKIYHLASXVPAFIRLLXHEGSLEIHKNAWYAYPY

SEQ ID NO: 26200 - protein, 59 aa, Diabrotica virgifera
  misc_feature: Coding regions on vcDNA: vcDNA=SeqID_5897; Strand=+; Position=164-343
FLNVLQNKYHVCCWIMRWHRLLNTSALVSITLCQLFNIILNSRPNRVSIININTSLVLL

SEQ ID NO: 26201 - protein, 51 aa, Diabrotica virgifera
  misc_feature: Coding regions on vcDNA: vcDNA=SeqID_5898; Strand=-; Position=0-152
CSPLKLARIALVSCFCGDAVFNLFRYCNQIPGTRGSKRFYYSQPGLPVVPL

SEQ ID NO: 26202 - protein, 72 aa, Diabrotica virgifera
  misc_feature: Coding regions on vcDNA: vcDNA=SeqID_5899; Strand=+; Position=1-219
VVSNPARGMVPIHLLIAPRPVIPPELIRYHTRTHPLVERVLPVCRKTSAYLDSSIRLSTHLLRTLESTVPQE

SEQ ID NO: 26203 - protein, 47 aa, Diabrotica virgifera
  misc_feature: Coding regions on vcDNA: vcDNA=SeqID_5900; Strand=+; Position=10-153
  misc_feature (7)..(12): Xaa can be any naturally occurring amino acid
  misc_feature (18)..(23): Xaa can be any naturally occurring amino acid
  misc_feature (37)..(38): Xaa can be any naturally occurring amino acid
YVVKTSXXXXXXPIIPSXXXXXXHALQYNETYTKYYXXRNVNDKIKT

SEQ ID NO: 26204 - protein, 42 aa, Diabrotica virgifera
  misc_feature: Coding regions on vcDNA: vcDNA=SeqID_5901; Strand=-; Position=56-184
GRCKTIDMAAIMYSASDSHLVGEISVGRQNVNRSDTQRESIR

SEQ ID NO: 26205 - protein, 62 aa, Diabrotica virgifera
  misc_feature: Coding regions on vcDNA: vcDNA=SeqID_5902; Strand=-; Position=2-187
SSISSSSSIDSLSMLFLVELSSDSKLTCVGFSLPGSQSSLVVSISSPVVELSSLVEFSDGVS

SEQ ID NO: 26206 - protein, 61 aa, Diabrotica virgifera
  misc_feature: Coding regions on vcDNA: vcDNA=SeqID_5903; Strand=-; Position=2-184
  misc_feature (4)..(16): Xaa can be any naturally occurring amino acid
  misc_feature (21)..(24): Xaa can be any naturally occurring amino acid
  misc_feature (37)..(44): Xaa can be any naturally occurring amino acid
KNMXXXXXXXXXXXXXNIIFXXXXFFILEYFIQINKXXXXXXXXNIQGHISISHLLVWRRQ

SEQ ID NO: 26207 - protein, 46 aa, Diabrotica virgifera
  misc_feature: Coding regions on vcDNA: vcDNA=SeqID_5904; Strand=+; Position=45-182
  misc_feature (14)..(21): Xaa can be any naturally occurring amino acid
  misc_feature (24)..(31): Xaa can be any naturally occurring amino acid
IVNDLMQMKHQIEXXXXXXXXPTXXXXXXXXLQHLYTHKKKLLSPL

SEQ ID NO: 26208 - protein, 85 aa, Diabrotica virgifera
  misc_feature: Coding regions on vcDNA: vcDNA=SeqID_5905; Strand=+; Position=3-260
RGGFRTTSSRVRPKAPRLRGGEIFLTFLGFSAIINAAPKFKSDIKSCYKESCPEDTFACEKTSKISPDRKHILHEIHCLGLKDDS

SEQ ID NO: 26209 - protein, 112 aa, Diabrotica virgifera
  misc_feature: Coding regions on vcDNA: vcDNA=SeqID_5906; Strand=+; Position=2-337
FYEKQTGISITGTANLKSVDISNSSDKKWSLHLSYVKVYQYLNSNNPAYYDVDRSIDQDTQNMPYEPPPTTITESTTSTMTTSTTTTSTVTESTTEDTGTTKSSTPTMESTT

SEQ ID NO: 26210 - protein, 66 aa, Diabrotica virgifera
  misc_feature: Coding regions on vcDNA: vcDNA=SeqID_5907; Strand=+; Position=2-199
SCPIQNQDSGVLCVIRRVFNTLFYNHTPHTNLSTQGGGIFFWKHKSVETRTPPTPWKVNSPWILKA

SEQ ID NO: 26211 - protein, 155 aa, Diabrotica virgifera
  misc_feature: Coding regions on vcDNA: vcDNA=SeqID_5908; Strand=+; Position=2-469
  misc_feature (52)..(57): Xaa can be any naturally occurring amino acid
DFTNISPLVAGIMKTENEEIRRIIENYMKSNNIVLDIKEEPEETDDEMDVEXXXXXXKTEKREFSPEELEELYEGIHSLTPQCLDTVSSILDIHDNWKNLAQLLEMEHLVDSGMIKSEAKAILTHAIEANHDWTNPTCIFALRKLFGKLGRDRNC

SEQ ID NO: 26212 - protein, 54 aa, Diabrotica virgifera
  misc_feature: Coding regions on vcDNA: vcDNA=SeqID_5909; Strand=-; Position=1-162
KGFWAPPWVNNFSQNCQIHLPLMSYPYAYKIHATVSLAIMFGVRSVNACGVRRE

SEQ ID NO: 26213 - protein, 134 aa, Diabrotica virgifera
  misc_feature: Coding regions on vcDNA: vcDNA=SeqID_5910; Strand=-; Position=1-402
  misc_feature (7)..(31): Xaa can be any naturally occurring amino acid
  misc_feature (34)..(44): Xaa can be any naturally occurring amino acid
  misc_feature (60)..(66): Xaa can be any naturally occurring amino acid
  misc_feature (75)..(83): Xaa can be any naturally occurring amino acid
  misc_feature (104)..(130): Xaa can be any naturally occurring amino acid
GAPPGSXXXXXXXXXXXXXXXXXXXXXXXXXPQXXXXXXXXXXXRGGVFLRGFFPLPKPXXXXXXXKGGVPPFFXXXXXXXXXSIFAPPRCGFFSPAFFCIKNXXXXXXXXXXXXXXXXXXXXXXXXXXXETSS

SEQ ID NO: 26214 - protein, 27 aa, Diabrotica virgifera
  misc_feature: Coding regions on vcDNA: vcDNA=SeqID_5911; Strand=-; Position=1-81
PTPLKLPKYLNSSCQRIVSNYFVITLI

SEQ ID NO: 26215 - protein, 86 aa, Diabrotica virgifera
  misc_feature: Coding regions on vcDNA: vcDNA=SeqID_5912; Strand=-; Position=0-257
ERTAYSGSEDCLQHQSRPIGSPVYIHWVHVPVHPEAVYESSRICRRVDVAIDLFLPLKSSVSGCNEAGVQINLRQKTGHPSTVGRT

SEQ ID NO: 26216 - protein, 54 aa, Diabrotica virgifera
  misc_feature: Coding regions on vcDNA: vcDNA=SeqID_5913; Strand=+; Position=2-163
SCPYGCKLSANGGPILIDGGTAEIDGSHAEIGAFSFHIGEYTIDCGEIDLQRDI

SEQ ID NO: 26217 - protein, 37 aa, Diabrotica virgifera
  misc_feature: Coding regions on vcDNA: vcDNA=SeqID_5914; Strand=-; Position=1-114
  misc_feature (7)..(13): Xaa can be any naturally occurring amino acid
  misc_feature (16)..(36): Xaa can be any naturally occurring amino acid
GGFVFEXXXXXXXKGXXXXXXXXXXXXXXXXXXXXXD

SEQ ID NO: 26218 - protein, 30 aa, Diabrotica virgifera
  misc_feature: Coding regions on vcDNA: vcDNA=SeqID_5915; Strand=+; Position=38-130
PKKHISNSNTWIQSLIYDKKVKMSSHIVLP

SEQ ID NO: 26219 - protein, 49 aa, Diabrotica virgifera
  misc_feature: Coding regions on vcDNA: vcDNA=SeqID_5916; Strand=+; Position=2-151
RHVPFHTSINMNFLHVALFSHFLYCFCRTKSTLNVLGGKLHYVISSNCV

SEQ ID NO: 26220 - protein, 46 aa, Diabrotica virgifera
  misc_feature: Coding regions on vcDNA: vcDNA=SeqID_5917; Strand=-; Position=6-146
YPCSLQRESTVLSVVSQICTRSHKTFKRKQFATKSCVYDGPRSLTF

SEQ ID NO: 26221 - protein, 99 aa, Diabrotica virgifera
  misc_feature: Coding regions on vcDNA: vcDNA=SeqID_5918; Strand=-; Position=3-299
  misc_feature (12)..(40): Xaa can be any naturally occurring amino acid
  misc_feature (49)..(96): Xaa can be any naturally occurring amino acid
GVILRGKNFLPXXXXXXXXXXXXXXXXXXXXXXXXXXXXXSYKPPENRXXXXXXXXXXXXXXXXXXXXXXXXXXXXXXXXXXXXXXXXXXXXXXXXSCR

SEQ ID NO: 26222 - protein, 30 aa, Diabrotica virgifera
  misc_feature: Coding regions on vcDNA: vcDNA=SeqID_5919; Strand=+; Position=1-90
LKIHYQISFDTIRRSFRDRILYYIMASSSV

SEQ ID NO: 26223 - protein, 82 aa, Diabrotica virgifera
  misc_feature: Coding regions on vcDNA: vcDNA=SeqID_5920; Strand=-; Position=1-246
  misc_feature: Homolog annotation: Hit_ID=XP_311257.1; Match level="QueryCoverage =98%, HitCoverage=16%, E-value=2e-21, Identity=67%"; Hit description =ENSANGP00000011950 [Anopheles gambiae]
  misc_feature: Gene Ontology Annotation: Molecular function=adenosylhomocysteinase activity; Cellular component=cytoplasm; Biological process =methionine metabolism
  misc_feature: Pfam annotation: Pfam_ID=AdoHcyase_NAD; Match level="Score=-6.4, E -value=0.0002, Copies=1"; Pfam description=S-adenosyl-L-homocysteine hydrolase, N
ATDVMLDGKVSIVERYGDVGKDYAQSPRACGGRVLITERDHIDGSNADMEGYESTKMEEASKEAQIKVTTTGCKEIIRGGHV

SEQ ID NO: 26224 - protein, 57 aa, Diabrotica virgifera
  misc_feature: Coding regions on vcDNA: vcDNA=SeqID_5921; Strand=-; Position=173-346
  misc_feature (9)..(27): Xaa can be any naturally occurring amino acid
  misc_feature (33)..(40): Xaa can be any naturally occurring amino acid
GSGTRPPPXXXXXXXXXXXXXXXXXXXGAPFGXXXXXXXXVGPPRVKTGLKLVLVKF

SEQ ID NO: 26225 - protein, 71 aa, Diabrotica virgifera
  misc_feature: Coding regions on vcDNA: vcDNA=SeqID_5922; Strand=-; Position=53-268
  misc_feature (4)..(12): Xaa can be any naturally occurring amino acid
PPLXXXXXXXXXISVLCSVTCQFSLTFHLACETISEALSILWNKVNIKLNVTLKNCNPKETLSSVRVEEGL

SEQ ID NO: 26226 - protein, 91 aa, Diabrotica virgifera
  misc_feature: Coding regions on vcDNA: vcDNA=SeqID_5923; Strand=+; Position=1-273
VNMDTLDIFLLLFFICSIINYVISVFINYWTLKTIPPEQTRSKYYIFNCLSNASTTYCIHDHLQKIVKLLSILARQNTTAWISPLDSQLKL

SEQ ID NO: 26227 - protein, 57 aa, Diabrotica virgifera
  misc_feature: Coding regions on vcDNA: vcDNA=SeqID_5924; Strand=-; Position=2-172
DLSDIADSTLYAYNFPLKGLIINIFLAASIDNLSVHLRFTVEFLDVGTLQNDVSTFK

SEQ ID NO: 26228 - protein, 64 aa, Diabrotica virgifera
  misc_feature: Coding regions on vcDNA: vcDNA=SeqID_5925; Strand=+; Position=1-195
  misc_feature (14)..(23): Xaa can be any naturally occurring amino acid
  misc_feature (25)..(33): Xaa can be any naturally occurring amino acid
LGSQFLFISFILNXXXXXXXXXXTXXXXXXXXXYKPSWLTPIYTQIMSNLKSRTDLLISLLLQL

SEQ ID NO: 26229 - protein, 73 aa, Diabrotica virgifera
  misc_feature: Coding regions on vcDNA: vcDNA=SeqID_5926; Strand=+; Position=3-224
  misc_feature (1)..(16): Xaa can be any naturally occurring amino acid
  misc_feature (45)..(52): Xaa can be any naturally occurring amino acid
XXXXXXXXXXXXXXXXLKFNPNSQLICPQKFQKGWFFQGETPPQXXXXXXXXGKPFIPGKIPHLNRESHAPPP

SEQ ID NO: 26230 - protein, 69 aa, Diabrotica virgifera
  misc_feature: Coding regions on vcDNA: vcDNA=SeqID_5927; Strand=+; Position=3-212
  misc_feature (8)..(22): Xaa can be any naturally occurring amino acid
RADSDTSXXXXXXXXXXXXXXXLVSPKFFLILGPPPFPPRGSKSKKGPKIFKFPPQNKCLGIPQLKIPT

SEQ ID NO: 26231 - protein, 74 aa, Diabrotica virgifera
  misc_feature: Coding regions on vcDNA: vcDNA=SeqID_5928; Strand=-; Position=4-228
VLDGKMGGEAPPLGGYDVVRAKEVRSVRVVCIDSSRWGGTGQRVHIARISWSACGDGVDIAHIVRDSGGDARDR

SEQ ID NO: 26232 - protein, 108 aa, Diabrotica virgifera
  misc_feature: Coding regions on vcDNA: vcDNA=SeqID_5929; Strand=-; Position=29-355
TIHRAFGAVGDTTPIKLREPEMRVYHAAPDEKLGAWMGGHVHGGTSSVRSAKIIWTILGCSSATRHERCCLTRGGNYRRSKLMIIRSGHTCYVLANSGFIQPAGCDSL

SEQ ID NO: 26233 - protein, 79 aa, Diabrotica virgifera
  misc_feature: Coding regions on vcDNA: vcDNA=SeqID_5930; Strand=+; Position=1-237
  misc_feature: Homolog annotation: Hit_ID=EAL32746.1; Match level="QueryCoverage =97%, HitCoverage=12%, E-value=2e-26, Identity=73%"; Hit description =GA21666-PA [Drosophila pseudoobscura]
  misc_feature: Gene Ontology Annotation: Molecular function=ATP-binding cassette (ABC) transporter activity; Cellular component=cellular_component unknown; Biological process=biological_process unknown
NEVRTRRIFVLISHSQHFLNGVCTNIIHINKKRLKYYTGNNDTIVKTRMELLEDHMIQYYWDQDRISHMKNYIARSGHR

SEQ ID NO: 26234 - protein, 72 aa, Diabrotica virgifera
  misc_feature: Coding regions on vcDNA: vcDNA=SeqID_5931; Strand=-; Position=3-218
  misc_feature (10)..(10): Xaa can be any naturally occurring amino acid
TQTNIMRLLXITTIILYTLFFNCCYTYVIEKVTTAVQHAEGPFWCPETRNLLYVDSFKLTLHRINIDNKKNS

SEQ ID NO: 26235 - protein, 69 aa, Diabrotica virgifera
  misc_feature: Coding regions on vcDNA: vcDNA=SeqID_5932; Strand=+; Position=1-207
  misc_feature: Homolog annotation: Hit_ID=CAE47501.1; Match level="QueryCoverage =100%, HitCoverage=21%, E-value=5e-34, Identity=94%"; Hit description= cathepsin L-like proteinase [Diabrotica virgifera virgifera]
  misc_feature: Gene Ontology Annotation: Cellular component=extracellular space
  misc_feature: Pfam annotation: Pfam_ID=Peptidase_C1; Match level="Score=-131.0, E -value=0.047, Copies=1"; Pfam description=Papain family cysteine protease
  misc_feature (53)..(53): Xaa can be any naturally occurring amino acid
  misc_feature (58)..(58): Xaa can be any naturally occurring amino acid
GMCGSCWTFSTTGSVEGAHFLKTGNLVSLSEQNLVDCAKDTCYGCGGGWMDKXLEYIXKGRIMSEKDYP

SEQ ID NO: 26236 - protein, 43 aa, Diabrotica virgifera
  misc_feature: Coding regions on vcDNA: vcDNA=SeqID_5933; Strand=+; Position=57-185
RKINNSKCQYTLISSIWRSCIFPIQIVPKHNFVRIGKTFHRKI

SEQ ID NO: 26237 - protein, 46 aa, Diabrotica virgifera
  misc_feature: Coding regions on vcDNA: vcDNA=SeqID_5934; Strand=+; Position=3-143
FGYSSGYRACYSALYKCTSSFENYRYRNYLKTFYCFIVLTEFIFSD

SEQ ID NO: 26238 - protein, 28 aa, Diabrotica virgifera
  misc_feature: Coding regions on vcDNA: vcDNA=SeqID_5935; Strand=-; Position=36-122
VRFSSVNILAHGTSISYLLLGGTLYPLR

SEQ ID NO: 26239 - protein, 83 aa, Diabrotica virgifera
  misc_feature: Coding regions on vcDNA: vcDNA=SeqID_5936; Strand=-; Position=3-251
  misc_feature (1)..(47): Xaa can be any naturally occurring amino acid
  misc_feature (50)..(55): Xaa can be any naturally occurring amino acid
  misc_feature (62)..(67): Xaa can be any naturally occurring amino acid
XXXXXXXXXXXXXXXXXXXXXXXXXXXXXXXXXXXXXXXXXXXXXXXIIXXXXXXLNKLFIXXXXXXFSTVDLEVSEFVRVLS

SEQ ID NO: 26240 - protein, 45 aa, Diabrotica virgifera
  misc_feature: Coding regions on vcDNA: vcDNA=SeqID_5937; Strand=-; Position=2-136
FVNARTYYKRKITKLNIRSFIIIAISICNIFISLLICEKKGTKLH

SEQ ID NO: 26241 - protein, 107 aa, Diabrotica virgifera
  misc_feature: Coding regions on vcDNA: vcDNA=SeqID_5938; Strand=-; Position=55-378
  misc_feature (4)..(11): Xaa can be any naturally occurring amino acid
  misc_feature (33)..(49): Xaa can be any naturally occurring amino acid
  misc_feature (82)..(91): Xaa can be any naturally occurring amino acid
  misc_feature (96)..(104): Xaa can be any naturally occurring amino acid
QNGXXXXXXXXRAPKFLEGPFTLGQVCEGEKRXXXXXXXXXXXXXXXXXGIFPPQKVFIKGGGISPGGGLFFGKNRGIWGRXXXXXXXXXXNSGVXXXXXXXXXPKF

SEQ ID NO: 26242 - protein, 21 aa, Diabrotica virgifera
  misc_feature: Coding regions on vcDNA: vcDNA=SeqID_5939; Strand=-; Position=0-62
KKKKLGPDLGRSLVRNPSGRG

SEQ ID NO: 26243 - protein, 54 aa, Diabrotica virgifera
  misc_feature: Coding regions on vcDNA: vcDNA=SeqID_5940; Strand=-; Position=42-206
FESVLTFFLVGHANHVVHYALDHEDDSIYLKNTTSAYIMKLTSNQLHPNSQSST

SEQ ID NO: 26244 - protein, 40 aa, Diabrotica virgifera
  misc_feature: Coding regions on vcDNA: vcDNA=SeqID_5941; Strand=-; Position=2-121
  misc_feature (1)..(10): Xaa can be any naturally occurring amino acid
  misc_feature (17)..(24): Xaa can be any naturally occurring amino acid
XXXXXXXXXXLKREKHXXXXXXXXPFSLCLRNSFKKSTSP

SEQ ID NO: 26245 - protein, 67 aa, Diabrotica virgifera
  misc_feature: Coding regions on vcDNA: vcDNA=SeqID_5942; Strand=+; Position=17-217
  misc_feature (16)..(37): Xaa can be any naturally occurring amino acid
VNRVQQKAQLLGAKGXXXXXXXXXXXXXXXXXXXXXXLCNEHGYYEGSLMTMHTIFLMKVLLNYNTS

SEQ ID NO: 26246 - protein, 42 aa, Diabrotica virgifera
  misc_feature: Coding regions on vcDNA: vcDNA=SeqID_5943; Strand=-; Position=108-236
VTGFRCAFSKSSSHRFRGLPPDRLSIGKLSICCHSAHVIVSF

SEQ ID NO: 26247 - protein, 44 aa, Diabrotica virgifera
  misc_feature: Coding regions on vcDNA: vcDNA=SeqID_5944; Strand=-; Position=183-317
ELKRPSHHKRNIYVINKRMYTCTHSVFLIPSDYAVTERFPIIYY

SEQ ID NO: 26248 - protein, 62 aa, Diabrotica virgifera
  misc_feature: Coding regions on vcDNA: vcDNA=SeqID_5945; Strand=+; Position=2-187
  misc_feature: Homolog annotation: Hit_ID=NP_996001.1; Match level="QueryCoverage =98%, HitCoverage=3%, E-value=1e-18, Identity=69%"; Hit description =CG5486-PC, isoform C [Drosophila melanogaster] ref|NP_729087.1| CG5486-PA, isoform A [Drosophila
  misc_feature (62)..(62): Xaa can be any naturally occurring amino acid
EGIDVSSGNNHDDKAKGPYMYELFSIMIHSGSASGGHYYAYSTDFDKNLWYCFNDQSVTGIX

SEQ ID NO: 26249 - protein, 40 aa, Diabrotica virgifera
  misc_feature: Coding regions on vcDNA: vcDNA=SeqID_5946; Strand=+; Position=1-120
VLNPARSCEVLPSIVENKPYHAIHCCKSVPDPPIRICELG

SEQ ID NO: 26250 - protein, 39 aa, Diabrotica virgifera
  misc_feature: Coding regions on vcDNA: vcDNA=SeqID_5947; Strand=+; Position=3-122
SCRTYFTELPPLYQTVLFQFEKISYYFRSDFLKQLMYFL

SEQ ID NO: 26251 - protein, 63 aa, Diabrotica virgifera
  misc_feature: Coding regions on vcDNA: vcDNA=SeqID_5948; Strand=-; Position=1-189
  misc_feature (20)..(35): Xaa can be any naturally occurring amino acid
LTYKKLCFSFRYLLVSSDLXXXXXXXXXXXXXXXXISTRLIFFVCFFLLPAKDFTISSNLSFF

SEQ ID NO: 26252 - protein, 56 aa, Diabrotica virgifera
  misc_feature: Coding regions on vcDNA: vcDNA=SeqID_5949; Strand=+; Position=135-302
SDRPLRVNLVHFPRALRVSECGKCYIVMYPANITKSRDPLKGGPGTPGGAGYPLPP

SEQ ID NO: 26253 - protein, 69 aa, Diabrotica virgifera
  misc_feature: Coding regions on vcDNA: vcDNA=SeqID_5950; Strand=-; Position=2-208
  misc_feature (17)..(17): Xaa can be any naturally occurring amino acid
  misc_feature (25)..(25): Xaa can be any naturally occurring amino acid
GYLFLSHHFLVITNCGXSLFFQHFXFIMSRFIILSLIMLLLIIILRATILSFIVCGTPCSVIICVLIVM

SEQ ID NO: 26254 - protein, 35 aa, Diabrotica virgifera
  misc_feature: Coding regions on vcDNA: vcDNA=SeqID_5951; Strand=-; Position=4-111
  misc_feature (28)..(35): Xaa can be any naturally occurring amino acid
SLSHSGLSQSIRVISCELLKKLYNTQVXXXXXXXX

SEQ ID NO: 26255 - protein, 55 aa, Diabrotica virgifera
  misc_feature: Coding regions on vcDNA: vcDNA=SeqID_5952; Strand=+; Position=3-170
VSVVTAAMGLCIFVTTSSYPFMEEMLGIHWCVWIYCCVCFIGATFIYFMIPETRG

SEQ ID NO: 26256 - protein, 80 aa, Diabrotica virgifera
  misc_feature: Coding regions on vcDNA: vcDNA=SeqID_5953; Strand=-; Position=0-239
  misc_feature (33)..(39): Xaa can be any naturally occurring amino acid
  misc_feature (65)..(79): Xaa can be any naturally occurring amino acid
KKNFGGHFFGRKRKNPPFFKLGGKNSPPRWGGXXXXXXXFGGGGNFGEFGCFHPLFKGGCPPGYXXXXXXXXXXXXXXXG

SEQ ID NO: 26257 - protein, 47 aa, Diabrotica virgifera
  misc_feature: Coding regions on vcDNA: vcDNA=SeqID_5954; Strand=-; Position=2-142
  misc_feature (3)..(3): Xaa can be any naturally occurring amino acid
  misc_feature (31)..(38): Xaa can be any naturally occurring amino acid
MCXAEETPDAHAPITATFILSKIPFMKPEEXXXXXXXXSYKTQNIFH

SEQ ID NO: 26258 - protein, 72 aa, Diabrotica virgifera
  misc_feature: Coding regions on vcDNA: vcDNA=SeqID_5955; Strand=-; Position=34-252
  misc_feature (26)..(26): Xaa can be any naturally occurring amino acid
  misc_feature (31)..(31): Xaa can be any naturally occurring amino acid
LTRGPDQGYKVVVNKFIHKKTKQIKXLQQRXRRLIKKVNTLNSLLEHLKEKQMIDEESSLKLSVKKIMNTSY

SEQ ID NO: 26259 - protein, 84 aa, Diabrotica virgifera
  misc_feature: Coding regions on vcDNA: vcDNA=SeqID_5956; Strand=-; Position=4-258
  misc_feature (11)..(18): Xaa can be any naturally occurring amino acid
  misc_feature (48)..(54): Xaa can be any naturally occurring amino acid
  misc_feature (65)..(82): Xaa can be any naturally occurring amino acid
CTHLIVSKNFXXXXXXXXCPYNKTFKYSNYKFCICIFLFISTYGNKMXXXXXXXLLEPKIQRDQXXXXXXXXXXXXXXXXXXKK

SEQ ID NO: 26260 - protein, 54 aa, Diabrotica virgifera
  misc_feature: Coding regions on vcDNA: vcDNA=SeqID_5957; Strand=+; Position=112-273
  misc_feature (13)..(14): Xaa can be any naturally occurring amino acid
  misc_feature (16)..(16): Xaa can be any naturally occurring amino acid
  misc_feature (33)..(33): Xaa can be any naturally occurring amino acid
TTSLLTPVLRFYXXYXTVVSKLESFTVKSGLSXQTQLRSCAVDYRNTTFAHKNT

SEQ ID NO: 26261 - protein, 71 aa, Diabrotica virgifera
  misc_feature: Coding regions on vcDNA: vcDNA=SeqID_5958; Strand=+; Position=1-213
  misc_feature: Homolog annotation: Hit_ID=XP_316957.1; Match level="QueryCoverage =100%, HitCoverage=11%, E-value=2e-11, Identity=45%"; Hit description= ENSANGP00000019358 [Anopheles gambiae]
  misc_feature: Gene Ontology Annotation: Cellular component=integral to membrane
  misc_feature (49)..(49): Xaa can be any naturally occurring amino acid
SALKTVRRQGYYAYSVNDKLKIIGLNNNVCYNFNWWLLLKTEYLNEQLXFLIQELQESEQKGAFVHILGHV

SEQ ID NO: 26262 - protein, 79 aa, Diabrotica virgifera
  misc_feature: Coding regions on vcDNA: vcDNA=SeqID_5959; Strand=-; Position=49-288
VGPHIHAEKCISHKFSNVFQFNDCPTHLCAPFIAVGNDHSPRRMRILPIVTYALFHDISYHSPLSLSVLDTYIFVFGRS

SEQ ID NO: 26263 - protein, 62 aa, Diabrotica virgifera
  misc_feature: Coding regions on vcDNA: vcDNA=SeqID_5960; Strand=+; Position=2-188
  misc_feature: Homolog annotation: Hit_ID=XP_396057.1; Match level="QueryCoverage =100%, HitCoverage=20%, E-value=1e-10, Identity=53%"; Hit description= similar to ENSANGP00000022280 [Apis mellifera]
  misc_feature: Gene Ontology Annotation: Molecular function=poly(A) binding; Cellular component=cytoplasm
  misc_feature (22)..(22): Xaa can be any naturally occurring amino acid
ELGEKATLCTNVYVINLGEHIXQEHLQVMCEKYGTITTYKIMSNEHRTSQGFGFVPIDSSQA

SEQ ID NO: 26264 - protein, 55 aa, Diabrotica virgifera
  misc_feature: Coding regions on vcDNA: vcDNA=SeqID_5961; Strand=+; Position=1-168
  misc_feature (3)..(11): Xaa can be any naturally occurring amino acid
  misc_feature (18)..(25): Xaa can be any naturally occurring amino acid
LVXXXXXXXXXKIYGKWXXXXXXXXPIFNSIRDFIYGKFSFSGGSLGYNYHLWLG

SEQ ID NO: 26265 - protein, 53 aa, Diabrotica virgifera
  misc_feature: Coding regions on vcDNA: vcDNA=SeqID_5962; Strand=+; Position=61-222
NTINLNNIPFTPKIKKQFGSPYFPQTTYLSFLAPPKLGSASPEIPFGFPVGPA

SEQ ID NO: 26266 - protein, 41 aa, Diabrotica virgifera
  misc_feature: Coding regions on vcDNA: vcDNA=SeqID_5963; Strand=-; Position=1-123
LSAFSLQTYHQDYVFMPSYSFIFAFFMTWQRGSFIPIYHHI

SEQ ID NO: 26267 - protein, 64 aa, Diabrotica virgifera
  misc_feature: Coding regions on vcDNA: vcDNA=SeqID_5964; Strand=+; Position=2-193
  misc_feature: Homolog annotation: Hit_ID=CAH04315.1; Match level="QueryCoverage =100%, HitCoverage=23%, E-value=1e-23, Identity=84%"; Hit description= S3Ae ribosomal protein [Biphyllus lunatus]
ISKDIEKACQGIYPLHDVYIRKVKVLKKPRFELSKLLELHGDGGKSGAGDSTGEAGSKVDRPDG

SEQ ID NO: 26268 - protein, 63 aa, Diabrotica virgifera
  misc_feature: Coding regions on vcDNA: vcDNA=SeqID_5965; Strand=+; Position=3-194
  misc_feature: Homolog annotation: Hit_ID=CAH04315.1; Match level="QueryCoverage =100%, HitCoverage=23%, E-value=7e-20, Identity=74%"; Hit description= S3Ae ribosomal protein [Biphyllus lunatus]
  misc_feature (11)..(18): Xaa can be any naturally occurring amino acid
GIYPLHDVYIXXXXXXXXPRFELSKLLELHGDGGKGGAGDSTGEAGSKVDRPEGYKPPVQESV

SEQ ID NO: 26269 - protein, 76 aa, Diabrotica virgifera
  misc_feature: Coding regions on vcDNA: vcDNA=SeqID_5966; Strand=+; Position=2-229
  misc_feature: Pfam annotation: Pfam_ID=LRR_1; Match level="Score=18.0, E-value =0.03, Copies=2"; Pfam description=Leucine Rich Repeat
TKRLLQDLRKLETLMVTKGRLEKVPSDTFQNNQEITILELDDSSITTIEPGTFDNLQKLDRLDLRSTGLQSPFDVN

SEQ ID NO: 26270 - protein, 68 aa, Diabrotica virgifera
  misc_feature: Coding regions on vcDNA: vcDNA=SeqID_5967; Strand=-; Position=2-205
  misc_feature (1)..(1): Xaa can be any naturally occurring amino acid
XSSSSYFNCIECANFYIRYICRFKIYYKRSMIFFGVCINLFFFLRIILGSLILIFFGIISHCNFSLIL

SEQ ID NO: 26271 - protein, 79 aa, Diabrotica virgifera
  misc_feature: Coding regions on vcDNA: vcDNA=SeqID_5968; Strand=+; Position=2-238
  misc_feature: Homolog annotation: Hit_ID=CAG07859.1; Match level="QueryCoverage =100%, HitCoverage=10%, E-value=4e-22, Identity=51%"; Hit description= unnamed protein product [Tetraodon nigroviridis]
  misc_feature: Gene Ontology Annotation: Molecular function=calcium ion binding; Cellular component=extracellular space; Biological process=cell -matrix adhesion
  misc_feature: Pfam annotation: Pfam_ID=TSP_3; Match level="Score=34.8, E-value=2.6e- 07, Copies=3"; Pfam description=Thrombospondin type 3 repeat
  misc_feature (62)..(62): Xaa can be any naturally occurring amino acid
NERDNCKTIPNTDQADRDGDGIGDVCDNCPSAYNPGSEDKDDNNVGDVCDSPINTDNDGVPXNHDNCRLIPNPNQLDTD

SEQ ID NO: 26272 - protein, 43 aa, Diabrotica virgifera
  misc_feature: Coding regions on vcDNA: vcDNA=SeqID_5969; Strand=+; Position=1-132
HLPNAARARAQYGTIGTRNLLFRFKTSISHISHITFIPHLVEI

SEQ ID NO: 26273 - protein, 47 aa, Diabrotica virgifera
  misc_feature: Coding regions on vcDNA: vcDNA=SeqID_5970; Strand=+; Position=95-235
  misc_feature (27)..(34): Xaa can be any naturally occurring amino acid
FCDLPFLIRTCIYKLFFQVKLFTENYXXXXXXXXHDTHNMLLINYDY

SEQ ID NO: 26274 - protein, 23 aa, Diabrotica virgifera
  misc_feature: Coding regions on vcDNA: vcDNA=SeqID_5971; Strand=+; Position=138-206
VEKSMDPLIVDFFTNWCGPCEAL

SEQ ID NO: 26275 - protein, 58 aa, Diabrotica virgifera
  misc_feature: Coding regions on vcDNA: vcDNA=SeqID_5972; Strand=+; Position=102-275
  misc_feature (14)..(14): Xaa can be any naturally occurring amino acid
  misc_feature (47)..(58): Xaa can be any naturally occurring amino acid
ITFLCTLLIRPVVXNLLCLATHFLMSFHIREPLLTHDDTLFCTLYAXXXXXXXXXXXX

SEQ ID NO: 26276 - protein, 75 aa, Diabrotica virgifera
  misc_feature: Coding regions on vcDNA: vcDNA=SeqID_5973; Strand=+; Position=2-226
  misc_feature (2)..(10): Xaa can be any naturally occurring amino acid
  misc_feature (34)..(40): Xaa can be any naturally occurring amino acid
SXXXXXXXXXGFWFYSPKNLKPPKFKNPKPFFLXXXXXXXPFPRKIKGFSPKKGVPPPKFLPPFPGPGVKNRQNF

SEQ ID NO: 26277 - protein, 71 aa, Diabrotica virgifera
  misc_feature: Coding regions on vcDNA: vcDNA=SeqID_5974; Strand=+; Position=2-214
  misc_feature (44)..(44): Xaa can be any naturally occurring amino acid
  misc_feature (53)..(53): Xaa can be any naturally occurring amino acid
  misc_feature (58)..(58): Xaa can be any naturally occurring amino acid
SNPLIPRLYGLPKIHKVGIPIRPVVSFINTPVSILSKYILNTLXNLINFTPRXTVSNXYQLFDKLQLINLN

SEQ ID NO: 26278 - protein, 57 aa, Diabrotica virgifera
  misc_feature: Coding regions on vcDNA: vcDNA=SeqID_5975; Strand=+; Position=28-198
  misc_feature (17)..(42): Xaa can be any naturally occurring amino acid
  misc_feature (44)..(53): Xaa can be any naturally occurring amino acid
KKEQINYIICLSNIINXXXXXXXXXXXXXXXXXXXXXXXXXXPXXXXXXXXXXPGPP

SEQ ID NO: 26279 - protein, 51 aa, Diabrotica virgifera
  misc_feature: Coding regions on vcDNA: vcDNA=SeqID_5976; Strand=-; Position=162-317
  misc_feature (3)..(10): Xaa can be any naturally occurring amino acid
  misc_feature (16)..(25): Xaa can be any naturally occurring amino acid
PPXXXXXXXXTLTLYXXXXXXXXXXVKITPNHKQYTNRLFIDLTISDFSYN

SEQ ID NO: 26280 - protein, 43 aa, Diabrotica virgifera
  misc_feature: Coding regions on vcDNA: vcDNA=SeqID_5977; Strand=+; Position=3-134
HVYFCSRVSSTAIHNLYADLCRPCLPITNYLVYVITCLSIFID

SEQ ID NO: 26281 - protein, 40 aa, Diabrotica virgifera
  misc_feature: Coding regions on vcDNA: vcDNA=SeqID_5978; Strand=-; Position=91-213
RGPGAPQKNTFRGEWGPCPPPGVQKVITYVNHLGRSTRRS

SEQ ID NO: 26282 - protein, 35 aa, Diabrotica virgifera
  misc_feature: Coding regions on vcDNA: vcDNA=SeqID_5979; Strand=-; Position=2-106
  misc_feature (1)..(7): Xaa can be any naturally occurring amino acid
  misc_feature (14)..(24): Xaa can be any naturally occurring amino acid
XXXXXXXVLKSFKXXXXXXXXXXXQLETSSLFSLS

SEQ ID NO: 26283 - protein, 30 aa, Diabrotica virgifera
  misc_feature: Coding regions on vcDNA: vcDNA=SeqID_5980; Strand=-; Position=81-173
  misc_feature (2)..(10): Xaa can be any naturally occurring amino acid
PXXXXXXXXXQTKKLYSQLILLDVKKNKTR

SEQ ID NO: 26284 - protein, 22 aa, Diabrotica virgifera
  misc_feature: Coding regions on vcDNA: vcDNA=SeqID_5981; Strand=+; Position=1-66
LVPKSARPARALSLCLWVFLSL

SEQ ID NO: 26285 - protein, 35 aa, Diabrotica virgifera
  misc_feature: Coding regions on vcDNA: vcDNA=SeqID_5982; Strand=-; Position=2-106
  misc_feature (5)..(14): Xaa can be any naturally occurring amino acid
GPFFXXXXXXXXXXPGGQILLGWALNFPKAKRAPF

SEQ ID NO: 26286 - protein, 109 aa, Diabrotica virgifera
  misc_feature: Coding regions on vcDNA: vcDNA=SeqID_5983; Strand=+; Position=1-330
PNLIWLSVQFSALFFTYKQPLGPANLSNPRNVELLLSDAHNIMTSFSNSLNHSNHFSPSKLPRLRNISLFHSTKQTVIFKIIPTIQLLSGNPITFTLGETKILKFQTFF

SEQ ID NO: 26287 - protein, 45 aa, Diabrotica virgifera
  misc_feature: Coding regions on vcDNA: vcDNA=SeqID_5984; Strand=-; Position=46-183
YSKVYNIANEVTILDKNLEDRKSLMDLFQTSQRRMCKSGDKDINT

SEQ ID NO: 26288 - protein, 111 aa, Diabrotica virgifera
  misc_feature: Coding regions on vcDNA: vcDNA=SeqID_5985; Strand=+; Position=3-338
  misc_feature: Homolog annotation: Hit_ID=BAC82199.1; Match level="QueryCoverage =82%, HitCoverage=78%, E-value=1e-15, Identity=41%"; Hit description =acaloleptin A precursor [Acalolepta luxuriosa]
QAGWSKVVHGPNRAKPTWHVGGSFRFSRSPKPEWEVNPGANDDGNGNTNAGGEVPRPEWEVNPGANGDGNGNTDAGIEVRNKGKDHGFQAGWDMHMPWLYGMGAHGSFKFE

SEQ ID NO: 26289 - protein, 80 aa, Diabrotica virgifera
  misc_feature: Coding regions on vcDNA: vcDNA=SeqID_5986; Strand=+; Position=29-268
  misc_feature (44)..(54): Xaa can be any naturally occurring amino acid
  misc_feature (64)..(70): Xaa can be any naturally occurring amino acid
TRDPRLENSARRNFRWNPGNPKWLFSLSPEGVFPQNAQNLLKGXXXXXXXXXXXHICKISLYKXXXXXXXTLPHRKSYSQ

SEQ ID NO: 26290 - protein, 35 aa, Diabrotica virgifera
  misc_feature: Coding regions on vcDNA: vcDNA=SeqID_5987; Strand=+; Position=2-109
LLPISAPSLAVFFWKNARGLKLKKWWSTVLFLSLA

SEQ ID NO: 26291 - protein, 50 aa, Diabrotica virgifera
  misc_feature: Coding regions on vcDNA: vcDNA=SeqID_5988; Strand=+; Position=3-155
  misc_feature (1)..(8): Xaa can be any naturally occurring amino acid
  misc_feature (37)..(43): Xaa can be any naturally occurring amino acid
XXXXXXXXYRLKGVLFGKKLQCHKSGPIKFPIIRVGXXXXXXXPLVAKNH

SEQ ID NO: 26292 - protein, 36 aa, Diabrotica virgifera
  misc_feature: Coding regions on vcDNA: vcDNA=SeqID_5989; Strand=-; Position=59-169
IRLSDQKYSGKQFRISLNNAVGMLSRSVRQLIATIV

SEQ ID NO: 26293 - protein, 61 aa, Diabrotica virgifera
  misc_feature: Coding regions on vcDNA: vcDNA=SeqID_5990; Strand=+; Position=1-183
  misc_feature (3)..(15): Xaa can be any naturally occurring amino acid
  misc_feature (21)..(36): Xaa can be any naturally occurring amino acid
  misc_feature (41)..(46): Xaa can be any naturally occurring amino acid
VSXXXXXXXXXXXXXKFLAFXXXXXXXXXXXXXXXXFSLGXXXXXXAPHSPLWGGVYQSPA

SEQ ID NO: 26294 - protein, 65 aa, Diabrotica virgifera
  misc_feature: Coding regions on vcDNA: vcDNA=SeqID_5991; Strand=-; Position=15-212
KTTETEQPDSQWVPIVAAIIGKLEVNKNITMTITDMRKLPAAAPVLSSTHFHGIPLIWKWDPNSQ

SEQ ID NO: 26295 - protein, 84 aa, Diabrotica virgifera
  misc_feature: Coding regions on vcDNA: vcDNA=SeqID_5992; Strand=-; Position=54-308
  misc_feature (77)..(77): Xaa can be any naturally occurring amino acid
DQYKDLFMVQLDKEPRSFDDILNPQGIRHQDVKHVILRIGRNSHAWNDLGFGISNDVRNTEDFAIIPRQRNYKPREXNDIVRSN

SEQ ID NO: 26296 - protein, 113 aa, Diabrotica virgifera
  misc_feature: Coding regions on vcDNA: vcDNA=SeqID_5993; Strand=+; Position=2-340
  misc_feature: Homolog annotation: Hit_ID=XP_314824.1; Match level="QueryCoverage =99%, HitCoverage=33%, E-value=3e-34, Identity=58%"; Hit description =ENSANGP00000011126 [Anopheles gambiae]
NRTKEVIELSEKNDIKVRGYISCVVGCPYDGMIEPAAVAKLTESLLSMGCYEISLGDTIGVGTRDSVNKMLKDVLAVASADTLAIHCHDTYGQALLNIFTALENGISVVDSSV

SEQ ID NO: 26297 - protein, 67 aa, Diabrotica virgifera
  misc_feature: Coding regions on vcDNA: vcDNA=SeqID_5994; Strand=+; Position=1-204
  misc_feature (1)..(8): Xaa can be any naturally occurring amino acid
  misc_feature (36)..(53): Xaa can be any naturally occurring amino acid
XXXXXXXXNLNQKTTTWALLYSTRLISCKINLVLYXXXXXXXXXXXXXXXXXXGGGAGPHSPLRGGV

SEQ ID NO: 26298 - protein, 55 aa, Diabrotica virgifera
  misc_feature: Coding regions on vcDNA: vcDNA=SeqID_5995; Strand=-; Position=0-164
  misc_feature (1)..(12): Xaa can be any naturally occurring amino acid
  misc_feature (41)..(46): Xaa can be any naturally occurring amino acid
XXXXXXXXXXXXGRRLWISEDFDGISYIVIYLTIPLYTLDXXXXXXVNNCLMSLS

SEQ ID NO: 26299 - protein, 51 aa, Diabrotica virgifera
  misc_feature: Coding regions on vcDNA: vcDNA=SeqID_5996; Strand=-; Position=117-272
  misc_feature (2)..(11): Xaa can be any naturally occurring amino acid
  misc_feature (23)..(29): Xaa can be any naturally occurring amino acid
PXXXXXXXXXXVEIQSLFYKNLXXXXXXXFKVVYRIQSLNKCNSKLFATCW

SEQ ID NO: 26300 - protein, 27 aa, Diabrotica virgifera
  misc_feature: Coding regions on vcDNA: vcDNA=SeqID_5997; Strand=-; Position=0-80
LVGGSVFFTVCGCGVIEIEPHRERDRP

SEQ ID NO: 26301 - protein, 62 aa, Diabrotica virgifera
  misc_feature: Coding regions on vcDNA: vcDNA=SeqID_5998; Strand=+; Position=5-193
  misc_feature (39)..(48): Xaa can be any naturally occurring amino acid
CLYINYTEYVYYHGTHQKTCVSRRGCEIVPYLEKCTIIXXXXXXXXXXRGGPGPNFPLWGGV

SEQ ID NO: 26302 - protein, 48 aa, Diabrotica virgifera
  misc_feature: Coding regions on vcDNA: vcDNA=SeqID_5999; Strand=+; Position=3-146
RLTTDALIIIRQLMEKSSLLLSMSLFLIAIHILLLYAKPLLGEDYKAG

SEQ ID NO: 26303 - protein, 32 aa, Diabrotica virgifera
  misc_feature: Coding regions on vcDNA: vcDNA=SeqID_6000; Strand=-; Position=3-98
AIHQCIMFLKRLCVGQTLFCIVCISDCIHHNS

SEQ ID NO: 26304 - protein, 19 aa, Diabrotica virgifera
  misc_feature: Coding regions on vcDNA: vcDNA=SeqID_6001; Strand=-; Position=0-56
QVAPNAARARPEYGMSSCR

SEQ ID NO: 26305 - protein, 40 aa, Diabrotica virgifera
  misc_feature: Coding regions on vcDNA: vcDNA=SeqID_6002; Strand=+; Position=2-121
FCTRLNAFNNMIVPLAQMPISISSFMGLRQMTDVPSDSLS

SEQ ID NO: 26306 - protein, 75 aa, Diabrotica virgifera
  misc_feature: Coding regions on vcDNA: vcDNA=SeqID_6003; Strand=-; Position=102-329
  misc_feature (28)..(67): Xaa can be any naturally occurring amino acid
PPPEFGTPKIKVYKTGGPIFLPPPKWGXXXXXXXXXXXXXXXXXXXXXXXXXXXXXXXXXXXXXXXXLSLRLVLG

SEQ ID NO: 26307 - protein, 119 aa, Diabrotica virgifera
  misc_feature: Coding regions on vcDNA: vcDNA=SeqID_6004; Strand=+; Position=1-357
  misc_feature: Homolog annotation: Hit_ID=AAC97621.1; Match level="QueryCoverage =96%, HitCoverage=21%, E-value=1e-17, Identity=37%"; Hit description =ORF MSV061 putative LINE reverse transcriptase, similar to Caenorhabditis elegans GB:U00063 [Melanoplus sa
QQCVNNHEIPKEWKESHLSTIHKKGDKSKPENYRGIAVTSSISRIYGKLIKNRIEEEYQNMEAEEQAGFRAGRSTIDHVFSITQIIEKKVARGQEVHLMFVDLRKAYDSVPLVKLWEGG

SEQ ID NO: 26308 - protein, 114 aa, Diabrotica virgifera
  misc_feature: Coding regions on vcDNA: vcDNA=SeqID_6005; Strand=+; Position=3-344
  misc_feature: Homolog annotation: Hit_ID=XP_317737.1; Match level="QueryCoverage =93%, HitCoverage=18%, E-value=3e-14, Identity=36%"; Hit description =ENSANGP00000010087 [Anopheles gambiae]
  misc_feature (58)..(58): Xaa can be any naturally occurring amino acid
  misc_feature (80)..(80): Xaa can be any naturally occurring amino acid
FVSILKYCWKMVVGVAYFLFLVILMGVANTEAVVTNEDIRAAILQLVNIVRATDDKVXRHEYRERILGEQLKKGMINIDXRIKMLDPLKGTVRRMDERLTALETMLMQTNEKEK

SEQ ID NO: 26309 - protein, 74 aa, Diabrotica virgifera
  misc_feature: Coding regions on vcDNA: vcDNA=SeqID_6006; Strand=+; Position=1-225
VKEITSQIPYEIPKLPESDVASSIVKESWNKGVLVTFKFLSDLPDTTRELTAKGIDAIKQNEEVKKLLNSTSSS

SEQ ID NO: 26310 - protein, 45 aa, Diabrotica virgifera
  misc_feature: Coding regions on vcDNA: vcDNA=SeqID_6007; Strand=-; Position=76-213
  misc_feature (5)..(18): Xaa can be any naturally occurring amino acid
PPPKXXXXXXXXXXXXXXVIYFTARKNKIVLTFIKTYKSVCQHIQ

SEQ ID NO: 26311 - protein, 38 aa, Diabrotica virgifera
  misc_feature: Coding regions on vcDNA: vcDNA=SeqID_6008; Strand=+; Position=2-115
QEILTRPVCSVYVDMGYIPYKLILPCPDRTFRAPRTNL

SEQ ID NO: 26312 - protein, 125 aa, Diabrotica virgifera
  misc_feature: Coding regions on vcDNA: vcDNA=SeqID_6009; Strand=-; Position=0-374
  misc_feature (3)..(11): Xaa can be any naturally occurring amino acid
  misc_feature (66)..(76): Xaa can be any naturally occurring amino acid
  misc_feature (108)..(120): Xaa can be any naturally occurring amino acid
PAXXXXXXXXXGGIGAGAPPQNWGPPNWGGSKGGGQKPPRGLILTPKKRLVSPGGTPWGNPGPLKXXXXXXXXXXXGVKNNPKKFGPLPKKGPLENEKFPKILKGWPXXXXXXXXXXXXXRLVLS

SEQ ID NO: 26313 - protein, 60 aa, Diabrotica virgifera
  misc_feature: Coding regions on vcDNA: vcDNA=SeqID_6010; Strand=-; Position=66-248
  misc_feature (8)..(8): Xaa can be any naturally occurring amino acid
CEAQRWLXFLLLTFIAIYYYSGAIELYPTNQLPCRGHQFESPTLTNTMVYVLLLSRAPFI

SEQ ID NO: 26314 - protein, 95 aa, Diabrotica virgifera
  misc_feature: Coding regions on vcDNA: vcDNA=SeqID_6011; Strand=-; Position=82-369
  misc_feature (4)..(4): Xaa can be any naturally occurring amino acid
  misc_feature (13)..(14): Xaa can be any naturally occurring amino acid
  misc_feature (31)..(37): Xaa can be any naturally occurring amino acid
  misc_feature (55)..(62): Xaa can be any naturally occurring amino acid
QIEXLKNMCLIFXXNLSNDTKHDFPQRGVGXXXXXXXPRYFAKWTSDRKTIKYTXXXXXXXXSNGTKHDPHGGGVWGYFKILNGNPHFLLQIWIP

SEQ ID NO: 26315 - protein, 81 aa, Diabrotica virgifera
  misc_feature: Coding regions on vcDNA: vcDNA=SeqID_6012; Strand=+; Position=3-248
SLVLLCIINMFLSFCLECFHFFHFPLVRICRTFGLAGFRFAGFYCILKLFLTKAQNLSKHKILLTNYLFYKGLLDLGETYR

SEQ ID NO: 26316 - protein, 75 aa, Diabrotica virgifera
  misc_feature: Coding regions on vcDNA: vcDNA=SeqID_6013; Strand=+; Position=1-228
VLLALVAVVVLATTEVSAKSVKGTSFKAVALATLGKTLGEDVCDCDECTKTCVTEDPSSVGGVCYEDECYCGYLN

SEQ ID NO: 26317 - protein, 118 aa, Diabrotica virgifera
  misc_feature: Coding regions on vcDNA: vcDNA=SeqID_6014; Strand=+; Position=51-406
  misc_feature: Homolog annotation: Hit_ID=AAG31959.1; Match level="QueryCoverage =89%, HitCoverage=30%, E-value=1e-31, Identity=57%"; Hit description =cytochrome b [Gryllus integer]
  misc_feature (25)..(25): Xaa can be any naturally occurring amino acid
  misc_feature (47)..(47): Xaa can be any naturally occurring amino acid
  misc_feature (73)..(73): Xaa can be any naturally occurring amino acid
  misc_feature (80)..(80): Xaa can be any naturally occurring amino acid
GGLAEDNATLTRFYTYHSIIPSIIXAFIIIHLLLVHQTGSRNLSGNXGSIDKIPYHTYITINDILGCLILLLXINNINSXDPYLFGDSDNFTPADPIRTPVHMHPELIYFVGICAFTL

SEQ ID NO: 26318 - protein, 61 aa, Diabrotica virgifera
  misc_feature: Coding regions on vcDNA: vcDNA=SeqID_6015; Strand=+; Position=5-190
CQIRTELLKHMVYLIKDLRNYIKDLPKYKVLQLKHLGFILVKLQLMVIKIPMIDSLNKIEY

SEQ ID NO: 26319 - protein, 43 aa, Diabrotica virgifera
  misc_feature: Coding regions on vcDNA: vcDNA=SeqID_6016; Strand=+; Position=2-130
  misc_feature (1)..(9): Xaa can be any naturally occurring amino acid
  misc_feature (29)..(35): Xaa can be any naturally occurring amino acid
XXXXXXXXXSLYLWIYIALSGALSLSLYXXXXXXXETTHEREE

SEQ ID NO: 26320 - protein, 85 aa, Diabrotica virgifera
  misc_feature: Coding regions on vcDNA: vcDNA=SeqID_6017; Strand=-; Position=80-337
LKKVGFGPPPKKVFKRNFFWGSNKMGNLNLKDPNLANGPGKKKGGFSLKRFQPKKIFGKLVLANWSQIRNKNKVQIWTNNLEGKM

SEQ ID NO: 26321 - protein, 64 aa, Diabrotica virgifera
  misc_feature: Coding regions on vcDNA: vcDNA=SeqID_6018; Strand=-; Position=123-317
  misc_feature (2)..(7): Xaa can be any naturally occurring amino acid
MXXXXXXCILGSFLDKLFKCTYSGLEKGILKDEISILEQMDHYSKLIIHIIYEFRSFTHNTHCE

SEQ ID NO: 26322 - protein, 34 aa, Diabrotica virgifera
  misc_feature: Coding regions on vcDNA: vcDNA=SeqID_6019; Strand=-; Position=1-102
  misc_feature (11)..(18): Xaa can be any naturally occurring amino acid
  misc_feature (22)..(28): Xaa can be any naturally occurring amino acid
RIGIIFHFYGXXXXXXXXFTVXXXXXXXYQSHFF

SEQ ID NO: 26323 - protein, 69 aa, Diabrotica virgifera
  misc_feature: Coding regions on vcDNA: vcDNA=SeqID_6020; Strand=+; Position=318-527
YLYSILYLCYKKLSVPFVNALFEPIVLKHSPITGNILIFLRSVNLAPRNANIRVKICASFAHRLTMFAH

SEQ ID NO: 26324 - protein, 82 aa, Diabrotica virgifera
  misc_feature: Coding regions on vcDNA: vcDNA=SeqID_6021; Strand=+; Position=1-249
  misc_feature: Homolog annotation: Hit_ID=AAV91385.1; Match level="QueryCoverage =100%, HitCoverage=56%, E-value=2e-28, Identity=80%"; Hit description= ribosomal protein 14 [Lonomia obliqua]
  misc_feature: Gene Ontology Annotation: Molecular function=structural constituent of ribosome; Cellular component=cytosolic large ribosomal subunit (sensu Eukarya); Biological process=reproduction
RRTQKFQRAIVGASLNDIMAKRNQRPEVRKAQREQAIRAAKEQKKSTKTAKKATAPAKAKPAPKQKVTKNQPKAAPRVGGKR

SEQ ID NO: 26325 - protein, 53 aa, Diabrotica virgifera
  misc_feature: Coding regions on vcDNA: vcDNA=SeqID_6022; Strand=+; Position=3-164
  misc_feature (1)..(13): Xaa can be any naturally occurring amino acid
  misc_feature (28)..(38): Xaa can be any naturally occurring amino acid
XXXXXXXXXXXXXLGDNSEILWESPNRXXXXXXXXXXXVYNGGTTFFIKSVQL

SEQ ID NO: 26326 - protein, 151 aa, Diabrotica virgifera
  misc_feature: Coding regions on vcDNA: vcDNA=SeqID_6023; Strand=+; Position=2-454
LSAPLSCVINEGSTIEVEFGSIVSKQFVIKGQPPKRYAIKNVDIAYHCDDNAVGNTDRIKLTLTADQAVADSSTPYIAKLLDRDHLGVRVYDEHRQNVTLDGTYEFAVTMDPQGNGVVKNHAVPVSTTNAFSAPGRFEGNVTVKMDLSLPN

SEQ ID NO: 26327 - protein, 86 aa, Diabrotica virgifera
  misc_feature: Coding regions on vcDNA: vcDNA=SeqID_6024; Strand=+; Position=1-261
  misc_feature (34)..(40): Xaa can be any naturally occurring amino acid
LVPNADRGRHGSLPSTTRAHTCEPYCLLNMTLHXXXXXXXDGAFQAHCRLGSISIFTAIAMSSTGLYHNEYRAVIQSGAGFSVNRI

SEQ ID NO: 26328 - protein, 65 aa, Diabrotica virgifera
  misc_feature: Coding regions on vcDNA: vcDNA=SeqID_6025; Strand=+; Position=28-225
TRGLAWPGETSTAHVKLRWKCHGIVPVNYDDRDLNVGFKFIYVVPTIVIPLYYSQNCRSSELSTV

SEQ ID NO: 26329 - protein, 84 aa, Diabrotica virgifera
  misc_feature: Coding regions on vcDNA: vcDNA=SeqID_6026; Strand=-; Position=1-255
  misc_feature (11)..(35): Xaa can be any naturally occurring amino acid
  misc_feature (46)..(62): Xaa can be any naturally occurring amino acid
HFAFRAFDSGXXXXXXXXXXXXXXXXXXXXXXXXXIRCRSLKHTQXXXXXXXXXXXXXXXXXFFFPIVYTMFICVFILVFQWFW

SEQ ID NO: 26330 - protein, 107 aa, Diabrotica virgifera
  misc_feature: Coding regions on vcDNA: vcDNA=SeqID_6027; Strand=+; Position=1-324
  misc_feature (20)..(53): Xaa can be any naturally occurring amino acid
  misc_feature (55)..(74): Xaa can be any naturally occurring amino acid
  misc_feature (82)..(98): Xaa can be any naturally occurring amino acid
IPCKEVRIESLGCILLNKYXXXXXXXXXXXXXXXXXXXXXXXXXXXXXXXXXXKXXXXXXXXXXXXXXXXXXXXRGFLNSIXXXXXXXXXXXXXXXXXANKYIKLNS

SEQ ID NO: 26331 - protein, 72 aa, Diabrotica virgifera
  misc_feature: Coding regions on vcDNA: vcDNA=SeqID_6028; Strand=+; Position=1-219
GNKAITGFSINSMEGFVLVATHILIHFNHWINSYKGHFNSRGTKHTFSTIFPKIGYLLKLRINIFFNSLVIL

SEQ ID NO: 26332 - protein, 82 aa, Diabrotica virgifera
  misc_feature: Coding regions on vcDNA: vcDNA=SeqID_6029; Strand=-; Position=151-399
DEMKNLMNIRPIMRYASETRPDTAKIERRLETAETRILRRITKKTLRDRIKSDEIRTKCNVQDINGCCVHAAGNNIWFHNFD

SEQ ID NO: 26333 - protein, 126 aa, Diabrotica virgifera
  misc_feature: Coding regions on vcDNA: vcDNA=SeqID_6030; Strand=+; Position=2-382
  misc_feature (117)..(125): Xaa can be any naturally occurring amino acid
SAIFAIGLTVPVLTGPGPAFQVTDGECENVSTDELVRQEQVNKGGFPFVTKQADVEYLGDPSKVIYCVQALSSDDPSVGSIAEITVGGVGHDFVNVHLTSKKGGPLHYDVEIYARAXXXXXXXXXH

SEQ ID NO: 26334 - protein, 165 aa, Diabrotica virgifera
  misc_feature: Coding regions on vcDNA: vcDNA=SeqID_6031; Strand=+; Position=63-557
MACFLDELVLEDNCPFNAVAFLGQYDSQDVSKESVTPNIVGMPMSMVELVANNEYVRKTIDEKESYKMEGVDLVVGRQKLRDRFAQLRWANIINSTLKRILIEADPDFFLNGAITKFEEGEYRQSLSIFRSIRSLQPAKDLITKKLCESNTGGTSFACYRRLLDK

SEQ ID NO: 26335 - protein, 142 aa, Diabrotica virgifera
  misc_feature: Coding regions on vcDNA: vcDNA=SeqID_6032; Strand=+; Position=108-536
SADLTLNSPPALSACIPRVGRPSSPPTRTSIAPDRSVKRPSGAIHARARRLGCPPTTMELAKQNQLVITSNANHSYSHQFIHTLHTALFCDPGPPIFGFSLFSVEVLPSAFRHASCMCCPKLSLLSKVPRYLTVLWGLISGA

SEQ ID NO: 26336 - protein, 64 aa, Diabrotica virgifera
  misc_feature: Coding regions on vcDNA: vcDNA=SeqID_6033; Strand=-; Position=113-307
  misc_feature: Homolog annotation: Hit_ID=EAL39842.1; Match level="QueryCoverage =100%, HitCoverage=11%, E-value=9e-09, Identity=39%"; Hit description= ENSANGP00000027774 [Anopheles gambiae str. PEST] ref|XP_556131.1| ENSANGP00000027774 [Anopheles gambiae s
  misc_feature (37)..(37): Xaa can be any naturally occurring amino acid
GEKELKEKILSLLKSIWKEEKMPEDWKIGQVITIHKXGDQPICENYRGVTLLSTTYHILTSIIR

SEQ ID NO: 26337 - protein, 91 aa, Diabrotica virgifera
  misc_feature: Coding regions on vcDNA: vcDNA=SeqID_6034; Strand=-; Position=2-277
PWFNLSFCLVLTFFPSCCSPCFLVYPLWSAILFAVSFVDLSSPLVFRCSLSVYVLLYSSLFSLSLFVSLSPPPCVTLRARRDRESERDRER

SEQ ID NO: 26338 - protein, 83 aa, Diabrotica virgifera
  misc_feature: Coding regions on vcDNA: vcDNA=SeqID_6035; Strand=-; Position=3-251
  misc_feature: Homolog annotation: Hit_ID=EAL39842.1; Match level="QueryCoverage =98%, HitCoverage=15%, E-value=8e-11, Identity=40%"; Hit description =ENSANGP00000027774 [Anopheles gambiae str. PEST] ref|XP_556131.1| ENSANGP00000027774 [Anopheles gambiae st
CGGNELKDKIISVLKIIWKEEKMPEDWKIGQVITIHKKGYQHICENYRGITLLRTTYIILTSIISKSLSKITEKRARQYQCGF

SEQ ID NO: 26339 - protein, 89 aa, Diabrotica virgifera
  misc_feature: Coding regions on vcDNA: vcDNA=SeqID_6036; Strand=-; Position=105-374
DAKLRCRCACSSSVRSFTWIKSYISRLTYTKSQASGIFHNVNVCSSSDVYQFLVSVPNDIRQWTSIHGSDLWYLACLIRQPQAQLSEEI

SEQ ID NO: 26340 - protein, 42 aa, Diabrotica virgifera
  misc_feature: Coding regions on vcDNA: vcDNA=SeqID_6037; Strand=-; Position=2-127
  misc_feature (26)..(26): Xaa can be any naturally occurring amino acid
SSKGGYLGCLYQSPKYAFPLKFVTTXTFGHLSTGICPCADIT

SEQ ID NO: 26341 - protein, 139 aa, Diabrotica virgifera
  misc_feature: Coding regions on vcDNA: vcDNA=SeqID_6038; Strand=-; Position=0-416
TYTSVHEIRATQFKDLANCRIKCKERINVTKREEVFKELWGIGDYSKRVAYIAGLISSKEKNVLKRKIDGKKHKNRMITHFYSLYINGENVNICKACFMTTFDVTNMFVSDVIKNKNASTAGIVHSDLRGKGEPYNKTP

SEQ ID NO: 26342 - protein, 75 aa, Diabrotica virgifera
  misc_feature: Coding regions on vcDNA: vcDNA=SeqID_6039; Strand=+; Position=61-285
  misc_feature (11)..(60): Xaa can be any naturally occurring amino acid
  misc_feature (65)..(73): Xaa can be any naturally occurring amino acid
PLFTLVNKHYXXXXXXXXXXXXXXXXXXXXXXXXXXXXXXXXXXXXXXXXXXXXXXXXXXHHTKXXXXXXXXXGG

SEQ ID NO: 26343 - protein, 58 aa, Diabrotica virgifera
  misc_feature: Coding regions on vcDNA: vcDNA=SeqID_6040; Strand=-; Position=5-181
  misc_feature (24)..(38): Xaa can be any naturally occurring amino acid
PGPNLAQGAKVGPNLGPRGPSSFXXXXXXXXXXXXXXXFKYFLGSIESSFYIKRKTVT

SEQ ID NO: 26344 - protein, 194 aa, Diabrotica virgifera
  misc_feature: Coding regions on vcDNA: vcDNA=SeqID_6041; Strand=+; Position=1-582
  misc_feature: Homolog annotation: Hit_ID=EAL39769.1; Match level="QueryCoverage =68%, HitCoverage=6%, E-value=2e-17, Identity=39%"; Hit description =ENSANGP00000027480 [Anopheles gambiae str. PEST] ref|XP_555903.1| ENSANGP00000027480 [Anopheles gambiae str
GSPRYPDEIEEPDDVNVRKPPKRLSDIPLLESEDVTNFSRITEISDTKVVTDIDKVETTDESLLSVNRKINLFLDTADKLTKTGKGPSGPAPKVERPELEVTQDLESDECLLSVSEKVNKFINTADQFMNVRDLPERPKSPRCKFNNDKISSNNFITTEQKTIQKENLTNETRKVSLENLNTVDTYRKSAPTDI

SEQ ID NO: 26345 - protein, 59 aa, Diabrotica virgifera
  misc_feature: Coding regions on vcDNA: vcDNA=SeqID_6042; Strand=-; Position=0-176
LTPVTHKSICVDIYHTSTCGHRWTGISPRADSTTHLNSAPRPSNLIDRPPRGEWSPVCR

SEQ ID NO: 26346 - protein, 32 aa, Diabrotica virgifera
  misc_feature: Coding regions on vcDNA: vcDNA=SeqID_6043; Strand=+; Position=2-97
FSLKENKSLNYLSELISMLTCFSNKHLRFSRQ

SEQ ID NO: 26347 - protein, 174 aa, Diabrotica virgifera
  misc_feature: Coding regions on vcDNA: vcDNA=SeqID_6044; Strand=-; Position=1-522
  misc_feature (31)..(115): Xaa can be any naturally occurring amino acid
  misc_feature (126)..(142): Xaa can be any naturally occurring amino acid
  misc_feature (147)..(158): Xaa can be any naturally occurring amino acid
  misc_feature (163)..(173): Xaa can be any naturally occurring amino acid
RGRKKGPKSLFYPKKILKKNHILKAQYAPNXXXXXXXXXXXXXXXXXXXXXXXXXXXXXXXXXXXXXXXXXXXXXXXXXXXXXXXXXXXXXXXXXXXXXXXXXXXXXXXXXXXXXEIFKTGNHFIXXXXXXXXXXXXXXXXXGLFKXXXXXXXXXXXXPRKPXXXXXXXXXXXE

SEQ ID NO: 26348 - protein, 68 aa, Diabrotica virgifera
  misc_feature: Coding regions on vcDNA: vcDNA=SeqID_6045; Strand=+; Position=2-205
  misc_feature (63)..(68): Xaa can be any naturally occurring amino acid
RSPITTDIPRPTRIVTDTGTHPSSEKTPAATTLVPSSTGAAYSRFIASECLLPLLMIVIALNXXXXXX

SEQ ID NO: 26349 - protein, 105 aa, Diabrotica virgifera
  misc_feature: Coding regions on vcDNA: vcDNA=SeqID_6046; Strand=-; Position=52-369
  misc_feature (80)..(86): Xaa can be any naturally occurring amino acid
  misc_feature (94)..(102): Xaa can be any naturally occurring amino acid
KQTGVNGTKIEWIKFYQPPFMGIFNPEGHCPVRIGWLPNGEKWNPPLYLGSSFGAGVVNLGPIMASAIPTSHYPKNWDPXXXXXXXGGIYKGLXXXXXXXXXDSF

SEQ ID NO: 26350 - protein, 46 aa, Diabrotica virgifera
  misc_feature: Coding regions on vcDNA: vcDNA=SeqID_6047; Strand=+; Position=60-197
FDMLLSITACVINKLAIICCGLLVGITYFMNARVPLKWIPGMCISS

SEQ ID NO: 26351 - protein, 25 aa, Diabrotica virgifera
  misc_feature: Coding regions on vcDNA: vcDNA=SeqID_6048; Strand=+; Position=1-78
EQGYIRVARGSNLCGINLMNSYPKL

SEQ ID NO: 26352 - protein, 28 aa, Diabrotica virgifera
  misc_feature: Coding regions on vcDNA: vcDNA=SeqID_6049; Strand=+; Position=3-89
VIEVDSNRKVTRENLERVYSDREDSTRH

SEQ ID NO: 26353 - protein, 101 aa, Diabrotica virgifera
  misc_feature: Coding regions on vcDNA: vcDNA=SeqID_6050; Strand=+; Position=1-306
PKTTFRKIICLDHCVGILRYIACADGQKPLRRDGDGLLGKPHTHYERRVFKSEWLHLGGKFCANIRNEVSTLASRGVSNLEKYTSEHELHVKSTCKRRGRY

SEQ ID NO: 26354 - protein, 55 aa, Diabrotica virgifera
  misc_feature: Coding regions on vcDNA: vcDNA=SeqID_6051; Strand=+; Position=56-223
TLFDLDAKLCSVRILVPLSPKPNNSLGCNVVGYLSLCRRPLQEHQEYQGVYSSDQ

SEQ ID NO: 26355 - protein, 71 aa, Diabrotica virgifera
  misc_feature: Coding regions on vcDNA: vcDNA=SeqID_6052; Strand=-; Position=32-247
LERLYYVIFPSFCIYIFTIFCSSVVYLEVWSILSSGAHGMFCFYQLFFFIYFQYIYSYFSILFPSHHHYLL

SEQ ID NO: 26356 - protein, 165 aa, Diabrotica virgifera
  misc_feature: Coding regions on vcDNA: vcDNA=SeqID_6053; Strand=-; Position=3-497
  misc_feature (14)..(27): Xaa can be any naturally occurring amino acid
  misc_feature (35)..(41): Xaa can be any naturally occurring amino acid
  misc_feature (67)..(78): Xaa can be any naturally occurring amino acid
  misc_feature (85)..(91): Xaa can be any naturally occurring amino acid
  misc_feature (99)..(110): Xaa can be any naturally occurring amino acid
  misc_feature (118)..(125): Xaa can be any naturally occurring amino acid
  misc_feature (139)..(148): Xaa can be any naturally occurring amino acid
  misc_feature (158)..(165): Xaa can be any naturally occurring amino acid
KQGYFLVSHGGGAXXXXXXXXXXXXXXPGGGVSPXXXXXXXPAGRRWPRNNLGPFVPPKRFFPPKNXXXXXXXXXXXXVFPPQGXXXXXXXPSPGGSLXXXXXXXXXXXXPRDPPGGXXXXXXXXGSPGGSLLFFGGGXXXXXXXXXXTHPPKKSPTXXXXXXXX

SEQ ID NO: 26357 - protein, 28 aa, Diabrotica virgifera
  misc_feature: Coding regions on vcDNA: vcDNA=SeqID_6054; Strand=+; Position=3-89
PPCQGMGAPNVFTNVANFVDWINENISQ

SEQ ID NO: 26358 - protein, 72 aa, Diabrotica virgifera
  misc_feature: Coding regions on vcDNA: vcDNA=SeqID_6055; Strand=+; Position=66-284
  misc_feature (2)..(26): Xaa can be any naturally occurring amino acid
LXXXXXXXXXXXXXXXXXXXXXXXXXPPKGGLKKNPGPVLKKRVSGQESTPGLNRQSQTRTYTIQIITCPTN

SEQ ID NO: 26359 - protein, 71 aa, Diabrotica virgifera
  misc_feature: Coding regions on vcDNA: vcDNA=SeqID_6056; Strand=-; Position=51-266
  misc_feature (24)..(41): Xaa can be any naturally occurring amino acid
FLKTRPWNFKTPPKRGNWGPAPPXXXXXXXXXXXXXXXXXXLNHIQLKKCKYHLQINLKNMYIIYSIYHNS

SEQ ID NO: 26360 - protein, 159 aa, Diabrotica virgifera
  misc_feature: Coding regions on vcDNA: vcDNA=SeqID_6057; Strand=+; Position=1-476
  misc_feature: Homolog annotation: Hit_ID=XP_321116.1; Match level="QueryCoverage =100%, HitCoverage=13%, E-value=1e-63, Identity=74%"; Hit description= ENSANGP00000018360 [Anopheles gambiae]
  misc_feature: Gene Ontology Annotation: Molecular function=protein binding; Cellular component=chromosome, telomeric region; Biological process =telomerase-dependent telomere maintenance
  misc_feature (38)..(38): Xaa can be any naturally occurring amino acid
  misc_feature (61)..(68): Xaa can be any naturally occurring amino acid
  misc_feature (151)..(151): Xaa can be any naturally occurring amino acid
FRHKLIKGMERLVASCGGLWTTPSNPGTLLVDLLSDDXEFITVEEEMQNSIREHRDNGHAXXXXXXXXIIRIQKVQNKKLWERYTHRRKEVSEENTNQSCERMLFHGSPFINAIVQKGFDERHAYIGGMFGAGIYFAEHFAKSNQYVYGIXGGTGCPTH

SEQ ID NO: 26361 - protein, 53 aa, Diabrotica virgifera
  misc_feature: Coding regions on vcDNA: vcDNA=SeqID_6058; Strand=-; Position=1-159
FGTKICVEVVTYHSGNSPLACRQFIDTINAPEQSLRYSGYLWTIIGTNILGNF

SEQ ID NO: 26362 - protein, 124 aa, Diabrotica virgifera
  misc_feature: Coding regions on vcDNA: vcDNA=SeqID_6059; Strand=-; Position=48-422
  misc_feature (3)..(22): Xaa can be any naturally occurring amino acid
  misc_feature (24)..(49): Xaa can be any naturally occurring amino acid
  misc_feature (58)..(70): Xaa can be any naturally occurring amino acid
  misc_feature (84)..(91): Xaa can be any naturally occurring amino acid
  misc_feature (103)..(110): Xaa can be any naturally occurring amino acid
KMXXXXXXXXXXXXXXXXXXXXPXXXXXXXXXXXXXXXXXXXXXXXXXXSFLLKKFSXXXXXXXXXXXXXKQFFFHSTLQFSFXXXXXXXXYLSPVQIPRPFXXXXXXXXPYNLFQKAWFLLTG

SEQ ID NO: 26363 - protein, 81 aa, Diabrotica virgifera
  misc_feature: Coding regions on vcDNA: vcDNA=SeqID_6060; Strand=+; Position=2-244
LNLLHSICIIECTQIMSIIMSRTGGVGHWHTAQRQQIWDCVSLSGTSEGRWVEYVHHHHKHDVLAAYLEYALQVHVRRVDF

SEQ ID NO: 26364 - protein, 62 aa, Diabrotica virgifera
  misc_feature: Coding regions on vcDNA: vcDNA=SeqID_6061; Strand=-; Position=0-185
YFHFDIVDLLFRLSGIRPLSPLHMLGLVLTVVLYPFILLSPAKYLFLHTVFGSHPLLLAVLV

SEQ ID NO: 26365 - protein, 104 aa, Diabrotica virgifera
  misc_feature: Coding regions on vcDNA: vcDNA=SeqID_6062; Strand=+; Position=4-315
  misc_feature (16)..(25): Xaa can be any naturally occurring amino acid
  misc_feature (29)..(38): Xaa can be any naturally occurring amino acid
NTTTFFWIFCKCVGGXXXXXXXXXXGRPXXXXXXXXXXKKPTLFFRAPFFEIFFGKNPHFYFGGTGAAKYILKKVFFLTTGCTKKKPGFFYGYKNRTLGQLFRG

SEQ ID NO: 26366 - protein, 63 aa, Diabrotica virgifera
  misc_feature: Coding regions on vcDNA: vcDNA=SeqID_6063; Strand=+; Position=23-214
  misc_feature (41)..(46): Xaa can be any naturally occurring amino acid
AESIRRLSVCWSGSLSVTRNPDSLRRVESLLLGPTYVTVGXXXXXXRSPMGYRCSTSIYSTST

SEQ ID NO: 26367 - protein, 99 aa, Diabrotica virgifera
  misc_feature: Coding regions on vcDNA: vcDNA=SeqID_6064; Strand=-; Position=1-297
RKGSRSNLRIIIINSIENHGWKDSEENRKEREDGPRNLRLENQNWKGKGQEREAPGPPPIIPLPDKDFLIGLDLNLQERVENFRKVKVPKERGYSKKTM

SEQ ID NO: 26368 - protein, 54 aa, Diabrotica virgifera
  misc_feature: Coding regions on vcDNA: vcDNA=SeqID_6065; Strand=-; Position=123-287
  misc_feature (16)..(16): Xaa can be any naturally occurring amino acid
GFTYFRLMRRTTQSFXTNVICEKNGFTKSIYSTQLQYRYLGRRKSTSDSSINAL

SEQ ID NO: 26369 - protein, 40 aa, Diabrotica virgifera
  misc_feature: Coding regions on vcDNA: vcDNA=SeqID_6066; Strand=+; Position=1-123
  misc_feature (12)..(20): Xaa can be any naturally occurring amino acid
KNLKNNNGLTVXXXXXXXXXPRLGPNGWNLTLKILVKLTL

SEQ ID NO: 26370 - protein, 90 aa, Diabrotica virgifera
  misc_feature: Coding regions on vcDNA: vcDNA=SeqID_6067; Strand=-; Position=34-303
RILINFINRTRKLFYWPNLTNDIVSFIKSCRICEKYMPANYKEPLLPHSVPTLRFNKIGTDILEFAGKSYLVVIDHFSHWIERLVLSLSL

SEQ ID NO: 26371 - protein, 86 aa, Diabrotica virgifera
  misc_feature: Coding regions on vcDNA: vcDNA=SeqID_6068; Strand=-; Position=1-258
  misc_feature (4)..(36): Xaa can be any naturally occurring amino acid
  misc_feature (40)..(46): Xaa can be any naturally occurring amino acid
  misc_feature (50)..(58): Xaa can be any naturally occurring amino acid
  misc_feature (62)..(83): Xaa can be any naturally occurring amino acid
KKWXXXXXXXXXXXXXXXXXXXXXXXXXXXXXXXXXLKNXXXXXXXFKRXXXXXXXXXAFYXXXXXXXXXXXXXXXXXXXXXXAFI

SEQ ID NO: 26372 - protein, 61 aa, Diabrotica virgifera
  misc_feature: Coding regions on vcDNA: vcDNA=SeqID_6069; Strand=-; Position=2-184
  misc_feature (2)..(2): Xaa can be any naturally occurring amino acid
  misc_feature (4)..(20): Xaa can be any naturally occurring amino acid
  misc_feature (29)..(36): Xaa can be any naturally occurring amino acid
  misc_feature (42)..(51): Xaa can be any naturally occurring amino acid
NXKXXXXXXXXXXXXXXXXXQFFSLPERXXXXXXXXARGGGXXXXXXXXXXDGGGDKIIRT

SEQ ID NO: 26373 - protein, 40 aa, Diabrotica virgifera
  misc_feature: Coding regions on vcDNA: vcDNA=SeqID_6070; Strand=-; Position=66-188
KKTGLVNYSKRYWFKLKFFDKRNLFDKLLRYQKIIIDGFG

SEQ ID NO: 26374 - protein, 86 aa, Diabrotica virgifera
  misc_feature: Coding regions on vcDNA: vcDNA=SeqID_6071; Strand=-; Position=221-481
  misc_feature (4)..(19): Xaa can be any naturally occurring amino acid
  misc_feature (21)..(22): Xaa can be any naturally occurring amino acid
PPPXXXXXXXXXXXXXXXXKXXYFYSYLGFFYKICVPKIKNQIRQCRCIHTNSFMYSFIRDKIVGYKKQSRHKNTPSNFYTILFPK

SEQ ID NO: 26375 - protein, 46 aa, Diabrotica virgifera
  misc_feature: Coding regions on vcDNA: vcDNA=SeqID_6072; Strand=-; Position=53-193
LRLVVLEHSLFSDSKDLYFFELKERDNRSSPSSSNRWHPFSINPLI

SEQ ID NO: 26376 - protein, 93 aa, Diabrotica virgifera
  misc_feature: Coding regions on vcDNA: vcDNA=SeqID_6073; Strand=+; Position=3-284
  misc_feature (47)..(88): Xaa can be any naturally occurring amino acid
RARIRPKINTKRTGFNKPGEKMVANFFIKPIYFTNFHFLITILIILXXXXXXXXXXXXXXXXXXXXXXXXXXXXXXXXXXXXXXXXXXPPIPL

SEQ ID NO: 26377 - protein, 45 aa, Diabrotica virgifera
  misc_feature: Coding regions on vcDNA: vcDNA=SeqID_6074; Strand=-; Position=1-135
FLGFNKTAIFQPHFLLEVINYHPLLKILPFGVIRSNIPLIILIRN

SEQ ID NO: 26378 - protein, 26 aa, Diabrotica virgifera
  misc_feature: Coding regions on vcDNA: vcDNA=SeqID_6075; Strand=+; Position=31-108
TAKSLEWILDPVVLKLIVKVDHYLNF

SEQ ID NO: 26379 - protein, 70 aa, Diabrotica virgifera
  misc_feature: Coding regions on vcDNA: vcDNA=SeqID_6076; Strand=+; Position=181-390
  misc_feature (18)..(23): Xaa can be any naturally occurring amino acid
KGKGGKMVGKKFYKFNRXXXXXXGGGGPLTRGTGSPFSEGALFSPTLGPNKALGGGENGSLRPPNGDFFP

SEQ ID NO: 26380 - protein, 89 aa, Diabrotica virgifera
  misc_feature: Coding regions on vcDNA: vcDNA=SeqID_6077; Strand=+; Position=2-271
  misc_feature (55)..(64): Xaa can be any naturally occurring amino acid
  misc_feature (72)..(78): Xaa can be any naturally occurring amino acid
FEPFHFWNLQKISWPLWPKRDPALKPSSLIPTVGTFHPYPVQVLMGVLTPPSTFXXXXXXXXXXAYKKIPAXXXXXXXKNGWIFWLSFS

SEQ ID NO: 26381 - protein, 38 aa, Diabrotica virgifera
  misc_feature: Coding regions on vcDNA: vcDNA=SeqID_6078; Strand=+; Position=1-114
  misc_feature (22)..(27): Xaa can be any naturally occurring amino acid
QNFTIILSPPYLIYFPPQFSPXXXXXXPPVEGPPFLPP

SEQ ID NO: 26382 - protein, 35 aa, Diabrotica virgifera
  misc_feature: Coding regions on vcDNA: vcDNA=SeqID_6079; Strand=+; Position=1-105
TNQTFTCLLSLFRPSKGPAVEVPGFACPRFYWPGG

SEQ ID NO: 26383 - protein, 101 aa, Diabrotica virgifera
  misc_feature: Coding regions on vcDNA: vcDNA=SeqID_6080; Strand=-; Position=45-350
  misc_feature (2)..(16): Xaa can be any naturally occurring amino acid
  misc_feature (21)..(43): Xaa can be any naturally occurring amino acid
  misc_feature (48)..(82): Xaa can be any naturally occurring amino acid
NXXXXXXXXXXXXXXXIHQCXXXXXXXXXXXXXXXXXXXXXXXNLLVXXXXXXXXXXXXXXXXXXXXXXXXXXXXXXXXXXXKIRIFNSKKIVNRENWFIW

SEQ ID NO: 26384 - protein, 52 aa, Diabrotica virgifera
  misc_feature: Coding regions on vcDNA: vcDNA=SeqID_6081; Strand=+; Position=2-157
  misc_feature (38)..(45): Xaa can be any naturally occurring amino acid
SCPFRTNHNLTFQRWPNSTKNGPSLNLQKVCDRWTSGXXXXXXXXKYWTYYI

SEQ ID NO: 26385 - protein, 54 aa, Diabrotica virgifera
  misc_feature: Coding regions on vcDNA: vcDNA=SeqID_6082; Strand=+; Position=1-162
LVPARAQIRTKAEPPVAERAPTSDNLLLTTRKKAVLTPLGQITRFPNAPKIRWT

SEQ ID NO: 26386 - protein, 68 aa, Diabrotica virgifera
  misc_feature: Coding regions on vcDNA: vcDNA=SeqID_6083; Strand=+; Position=2-208
  misc_feature (6)..(14): Xaa can be any naturally occurring amino acid
  misc_feature (18)..(25): Xaa can be any naturally occurring amino acid
  misc_feature (42)..(46): Xaa can be any naturally occurring amino acid
NHYQFXXXXXXXXXPGPXXXXXXXXFPLWGGVLKIPGPGFKXXXXXIFGRFSWVVHRKQISNFESNLN

SEQ ID NO: 26387 - protein, 38 aa, Diabrotica virgifera
  misc_feature: Coding regions on vcDNA: vcDNA=SeqID_6084; Strand=-; Position=42-158
KYMRFHCRRTVVDIMTLHTASVTQLTRGSSGGRIDEWY

SEQ ID NO: 26388 - protein, 75 aa, Diabrotica virgifera
  misc_feature: Coding regions on vcDNA: vcDNA=SeqID_6085; Strand=-; Position=0-224
LAPMAPKFIIPVAFFPTNSPIITTTCHFPVVFGKGPLPVVPGRQEAALVLLKVKGKVVPANRFGFSLVRNRPEVG

SEQ ID NO: 26389 - protein, 49 aa, Diabrotica virgifera
  misc_feature: Coding regions on vcDNA: vcDNA=SeqID_6086; Strand=+; Position=180-329
  misc_feature (10)..(10): Xaa can be any naturally occurring amino acid
YEIFTHLILXDFWAYIIKYINVFKGLYFSYNAIGHNVINKHLEITNYNT

SEQ ID NO: 26390 - protein, 29 aa, Diabrotica virgifera
  misc_feature: Coding regions on vcDNA: vcDNA=SeqID_6087; Strand=-; Position=4-93
KSPQGHYVKNNALEVMARLFLECRPVSIR

SEQ ID NO: 26391 - protein, 56 aa, Diabrotica virgifera
  misc_feature: Coding regions on vcDNA: vcDNA=SeqID_6088; Strand=+; Position=108-278
SINYKIFFTSIRPPKPPKKNSCFSLSKFNTLKCHLITNGAKNCYHYCIRKHTIYML

SEQ ID NO: 26392 - protein, 183 aa, Diabrotica virgifera
  misc_feature: Coding regions on vcDNA: vcDNA=SeqID_6089; Strand=+; Position=126-674
  misc_feature (80)..(80): Xaa can be any naturally occurring amino acid
  misc_feature (93)..(93): Xaa can be any naturally occurring amino acid
  misc_feature (99)..(99): Xaa can be any naturally occurring amino acid
  misc_feature (117)..(117): Xaa can be any naturally occurring amino acid
  misc_feature (122)..(122): Xaa can be any naturally occurring amino acid
  misc_feature (135)..(136): Xaa can be any naturally occurring amino acid
LEVPSFKNQNSVVKNLITTRFDLVKKKVEGIINDIRHSKIKIGNYMNIHRETAKLFEEIYQFGEARIMYDADRIRIDQVXEGVYNDVHDEQVXSEKVEXPFENVASMVKHYKSRSFXARLVXEKCPRPGGVGIPXXDNNKIYVAATDTHNILILDRSKIKLLGRINNPEMLCPMNLAFSRKFD

SEQ ID NO: 26393 - protein, 44 aa, Diabrotica virgifera
  misc_feature: Coding regions on vcDNA: vcDNA=SeqID_6090; Strand=+; Position=2-133
  misc_feature (3)..(9): Xaa can be any naturally occurring amino acid
  misc_feature (13)..(22): Xaa can be any naturally occurring amino acid
SSXXXXXXXPFNXXXXXXXXXXKTGFFSFHPSFQLSKKKPRGGP

SEQ ID NO: 26394 - protein, 82 aa, Diabrotica virgifera
  misc_feature: Coding regions on vcDNA: vcDNA=SeqID_6091; Strand=-; Position=1-246
  misc_feature (2)..(9): Xaa can be any naturally occurring amino acid
  misc_feature (12)..(57): Xaa can be any naturally occurring amino acid
  misc_feature (73)..(78): Xaa can be any naturally occurring amino acid
MXXXXXXXXKGXXXXXXXXXXXXXXXXXXXXXXXXXXXXXXXXXXXXXXXXXXXXXXSGDEILCSTGGDPTSXXXXXXTAVE

SEQ ID NO: 26395 - protein, 59 aa, Diabrotica virgifera
  misc_feature: Coding regions on vcDNA: vcDNA=SeqID_6092; Strand=+; Position=16-195
  misc_feature (22)..(38): Xaa can be any naturally occurring amino acid
CIPNGNPLWLTGFNGNLFPINXXXXXXXXXXXXXXXXXKTYIKEQNLLIFDMINQTNSN

SEQ ID NO: 26396 - protein, 133 aa, Diabrotica virgifera
  misc_feature: Coding regions on vcDNA: vcDNA=SeqID_6093; Strand=-; Position=130-531
  misc_feature (1)..(10): Xaa can be any naturally occurring amino acid
  misc_feature (14)..(21): Xaa can be any naturally occurring amino acid
  misc_feature (44)..(52): Xaa can be any naturally occurring amino acid
  misc_feature (80)..(86): Xaa can be any naturally occurring amino acid
  misc_feature (91)..(109): Xaa can be any naturally occurring amino acid
  misc_feature (111)..(133): Xaa can be any naturally occurring amino acid
XXXXXXXXXXPLGXXXXXXXXIGPHPGPPRFNPGPGKFLKADRXXXXXXXXXFKPLTPPGGANFIIGLDLPKKIRGFPQXXXXXXXKKLGXXXXXXXXXXXXXXXXXXXPXXXXXXXXXXXXXXXXXXXXXXX

SEQ ID NO: 26397 - protein, 57 aa, Diabrotica virgifera
  misc_feature: Coding regions on vcDNA: vcDNA=SeqID_6094; Strand=-; Position=120-293
  misc_feature (4)..(11): Xaa can be any naturally occurring amino acid
PPPXXXXXXXXYTNNYWFKKIRNLSPLKPNQLILPVLIQGNQVFHKAYHFIHPSSTV

SEQ ID NO: 26398 - protein, 94 aa, Diabrotica virgifera
  misc_feature: Coding regions on vcDNA: vcDNA=SeqID_6095; Strand=-; Position=1-282
  misc_feature (8)..(66): Xaa can be any naturally occurring amino acid
  misc_feature (68)..(74): Xaa can be any naturally occurring amino acid
RRRRGGGXXXXXXXXXXXXXXXXXXXXXXXXXXXXXXXXXXXXXXXXXXXXXXXXXXXXXXXXXXXLXXXXXXXLINGTLIIWFKIRLDQVHHH

SEQ ID NO: 26399 - protein, 49 aa, Diabrotica virgifera
  misc_feature: Coding regions on vcDNA: vcDNA=SeqID_6096; Strand=+; Position=2-151
LRISPQEEMGSCLTARPWWRVEKVQGGKLLVISFTSGTKKLFPPTRLPS

SEQ ID NO: 26400 - protein, 73 aa, Diabrotica virgifera
  misc_feature: Coding regions on vcDNA: vcDNA=SeqID_6097; Strand=+; Position=78-296
  misc_feature: Homolog annotation: Hit_ID=XP_312604.1; Match level="QueryCoverage =91%, HitCoverage=22%, E-value=7e-09, Identity=38%"; Hit description =ENSANGP00000024944 [Anopheles gambiae]
  misc_feature (26)..(26): Xaa can be any naturally occurring amino acid
RVNSKIKMGKMVDNNPNAGLNKTVFXNYLTFPFPKGKAPAPLFWVGGSGKNVKGQTGTLNFGPTSPKKFPGGN

SEQ ID NO: 26401 - protein, 47 aa, Diabrotica virgifera
  misc_feature: Coding regions on vcDNA: vcDNA=SeqID_6098; Strand=-; Position=150-293
FIVQCYKKSLQYYWYKVKFPKTFSIRRIFFLLPVFYKPIPRKTTKNF

SEQ ID NO: 26402 - protein, 90 aa, Diabrotica virgifera
  misc_feature: Coding regions on vcDNA: vcDNA=SeqID_6099; Strand=+; Position=245-514
  misc_feature (6)..(37): Xaa can be any naturally occurring amino acid
  misc_feature (60)..(69): Xaa can be any naturally occurring amino acid
  misc_feature (77)..(77): Xaa can be any naturally occurring amino acid
  misc_feature (80)..(89): Xaa can be any naturally occurring amino acid
YQKNGXXXXXXXXXXXXXXXXXXXXXXXXXXXXXXXXLKNLLIFINSIGLLVFKKFKLLXXXXXXXXXXDRFFSFTXQFXXXXXXXXXXG

SEQ ID NO: 26403 - protein, 26 aa, Diabrotica virgifera
  misc_feature: Coding regions on vcDNA: vcDNA=SeqID_6100; Strand=-; Position=1-78
GPPLGPNLATLVRIWQEVGANSGTRQ

SEQ ID NO: 26404 - protein, 103 aa, Diabrotica virgifera
  misc_feature: Coding regions on vcDNA: vcDNA=SeqID_6101; Strand=+; Position=1-312
  misc_feature (60)..(60): Xaa can be any naturally occurring amino acid
  misc_feature (64)..(64): Xaa can be any naturally occurring amino acid
LCFVPHVLCSQLLVFETILSGSQPGISFFLAPNLFLPFNPCLSTISCSRLYLSLRNTWPXYDAXPPFTVGNNSNSLPIRLNTLCVGHSVCPRNSQYASIQPHF

SEQ ID NO: 26405 - protein, 108 aa, Diabrotica virgifera
  misc_feature: Coding regions on vcDNA: vcDNA=SeqID_6102; Strand=+; Position=1-327
  misc_feature: Homolog annotation: Hit_ID=NP_610524.1; Match level="QueryCoverage =97%, HitCoverage=48%, E-value=1e-32, Identity=58%"; Hit description =CG1599-PA [Drosophila melanogaster] gb|AAF58892.1| CG1599-PA [Drosophila melanogaster]
  misc_feature: Gene Ontology Annotation: Molecular function=molecular_function unknown; Cellular component=integral to membrane; Biological process= biological_process unknown
  misc_feature: Pfam annotation: Pfam_ID=Synaptobrevin; Match level="Score=118.7, E -value=1.4e-32, Copies=1"; Pfam description=Synaptobrevin
MKLYSESHDLDTISRVHSELYELKDIMVKNIDNISMRGERLELLVNKADDLNQGSVTFRTTSRNLTRSLFWKNMKMYIIIGVAVTVIVYFIVSISCGGLLWQGCISKK

SEQ ID NO: 26406 - protein, 116 aa, Diabrotica virgifera
  misc_feature: Coding regions on vcDNA: vcDNA=SeqID_6103; Strand=-; Position=17-367
  misc_feature (4)..(16): Xaa can be any naturally occurring amino acid
  misc_feature (23)..(32): Xaa can be any naturally occurring amino acid
  misc_feature (37)..(54): Xaa can be any naturally occurring amino acid
  misc_feature (62)..(92): Xaa can be any naturally occurring amino acid
  misc_feature (95)..(115): Xaa can be any naturally occurring amino acid
YCEXXXXXXXXXXXXXVPCVSGXXXXXXXXXXRFKRXXXXXXXXXXXXXXXXXXNVFGFKYXXXXXXXXXXXXXXXXXXXXXXXXXXXXXXXMRXXXXXXXXXXXXXXXXXXXXXI

SEQ ID NO: 26407 - protein, 80 aa, Diabrotica virgifera
  misc_feature: Coding regions on vcDNA: vcDNA=SeqID_6104; Strand=+; Position=1-243
  misc_feature (4)..(10): Xaa can be any naturally occurring amino acid
  misc_feature (63)..(69): Xaa can be any naturally occurring amino acid
KNGXXXXXXXNQWETGERMVFLVQVSSRLWKKLLNDVFQNLIYSRTPIIRTPIIRIAIIRIRXXXXXXXVCKKIIHFTVS

SEQ ID NO: 26408 - protein, 50 aa, Diabrotica virgifera
  misc_feature: Coding regions on vcDNA: vcDNA=SeqID_6105; Strand=+; Position=1-150
  misc_feature (4)..(12): Xaa can be any naturally occurring amino acid
  misc_feature (17)..(26): Xaa can be any naturally occurring amino acid
  misc_feature (29)..(29): Xaa can be any naturally occurring amino acid
  misc_feature (37)..(48): Xaa can be any naturally occurring amino acid
WGLXXXXXXXXXRKDHXXXXXXXXXXGVXPKKKTGGXXXXXXXXXXXXGG

SEQ ID NO: 26409 - protein, 43 aa, Diabrotica virgifera
  misc_feature: Coding regions on vcDNA: vcDNA=SeqID_6106; Strand=-; Position=3-131
  misc_feature (24)..(31): Xaa can be any naturally occurring amino acid
KTQIISGQRKNSSYYNIKIFVLKXXXXXXXXKNQGRRSTTIPM

SEQ ID NO: 26410 - protein, 114 aa, Diabrotica virgifera
  misc_feature: Coding regions on vcDNA: vcDNA=SeqID_6107; Strand=+; Position=1-342
  misc_feature: Homolog annotation: Hit_ID=XP_313425.1; Match level="QueryCoverage =99%, HitCoverage=22%, E-value=2e-40, Identity=70%"; Hit description =ENSANGP00000020207 [Anopheles gambiae]
  misc_feature: Gene Ontology Annotation: Molecular function=electron transporter activity; Cellular component=mitochondrion; Biological process =alcohol metabolism
GDETQFNKILGLIKEGQNQGAQLVHGGERHGDKGYFIQPTVFADVQDDHVIAKEEIFGPVQQLLRFKDLDELIERANRTNYGLASAIFSNDVNKINYISQGLKAGTVWVNCYNV

SEQ ID NO: 26411 - protein, 62 aa, Diabrotica virgifera
  misc_feature: Coding regions on vcDNA: vcDNA=SeqID_6108; Strand=+; Position=2-190
TCLYIWRTVCQRVKQLVREGKDRSLKQEKLNLDYLTSHLIKQCTVNAYAEMHSTLRRRVCES

SEQ ID NO: 26412 - protein, 61 aa, Diabrotica virgifera
  misc_feature: Coding regions on vcDNA: vcDNA=SeqID_6109; Strand=-; Position=3-185
FFKSPVFGSSFKSKRQYLEECHHLFKELKKHHSDRFYAFKRISVDKFQHIYANLRRMSRGL

SEQ ID NO: 26413 - protein, 122 aa, Diabrotica virgifera
  misc_feature: Coding regions on vcDNA: vcDNA=SeqID_6110; Strand=+; Position=2-367
  misc_feature (30)..(37): Xaa can be any naturally occurring amino acid
  misc_feature (82)..(82): Xaa can be any naturally occurring amino acid
VLKMSNKKLSDAELREIAENMSEKEYEFIXXXXXXXXMDIDDPNDQDSCSSSSNLEINSDGPELEFESDLESLNNDSEPDNXLNNPNPNIILYIKIYCCALVSLKLENVWTDLANFDGEIFG

SEQ ID NO: 26414 - protein, 39 aa, Diabrotica virgifera
  misc_feature: Coding regions on vcDNA: vcDNA=SeqID_6111; Strand=-; Position=46-165
  misc_feature (3)..(10): Xaa can be any naturally occurring amino acid
PPXXXXXXXXKNKCLFIFNNYNKHFNNKLQIKQFLIHAW

SEQ ID NO: 26415 - protein, 51 aa, Diabrotica virgifera
  misc_feature: Coding regions on vcDNA: vcDNA=SeqID_6112; Strand=-; Position=147-302
  misc_feature (12)..(12): Xaa can be any naturally occurring amino acid
  misc_feature (22)..(22): Xaa can be any naturally occurring amino acid
YNYFIPRTTTPXQKTGRRVFFXPTHNEKAKVESIFYKAVNALHCNINIFSI

SEQ ID NO: 26416 - protein, 118 aa, Diabrotica virgifera
  misc_feature: Coding regions on vcDNA: vcDNA=SeqID_6113; Strand=-; Position=1-354
  misc_feature (7)..(117): Xaa can be any naturally occurring amino acid
KKCGRIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXE

SEQ ID NO: 26417 - protein, 19 aa, Diabrotica virgifera
  misc_feature: Coding regions on vcDNA: vcDNA=SeqID_6114; Strand=-; Position=1-57
  misc_feature (2)..(10): Xaa can be any naturally occurring amino acid
PXXXXXXXXXGLNKGGGTP

SEQ ID NO: 26418 - protein, 46 aa, Diabrotica virgifera
  misc_feature: Coding regions on vcDNA: vcDNA=SeqID_6115; Strand=+; Position=2-142
FRNKVLFMLTLFVRDFKDNEKVVPLFTDILPQLALLKIVYKHIRQL

SEQ ID NO: 26419 - protein, 50 aa, Diabrotica virgifera
  misc_feature: Coding regions on vcDNA: vcDNA=SeqID_6116; Strand=+; Position=2-154
  misc_feature (1)..(10): Xaa can be any naturally occurring amino acid
  misc_feature (14)..(23): Xaa can be any naturally occurring amino acid
  misc_feature (28)..(35): Xaa can be any naturally occurring amino acid
XXXXXXXXXXHPPXXXXXXXXXXILRKXXXXXXXXYWGFSALKKIKLFYL

SEQ ID NO: 26420 - protein, 17 aa, Diabrotica virgifera
  misc_feature: Coding regions on vcDNA: vcDNA=SeqID_6117; Strand=-; Position=1-51
  misc_feature (3)..(12): Xaa can be any naturally occurring amino acid
PPXXXXXXXXXXNPRLV

SEQ ID NO: 26421 - protein, 68 aa, Diabrotica virgifera
  misc_feature: Coding regions on vcDNA: vcDNA=SeqID_6118; Strand=+; Position=36-242
KSVFFWSVPKLGSNGILSRFCSESSKSDVFVVNTLPVYSCVSNSGVEYAFFKNNLIQASQGRGPRPFN

SEQ ID NO: 26422 - protein, 93 aa, Diabrotica virgifera
  misc_feature: Coding regions on vcDNA: vcDNA=SeqID_6119; Strand=+; Position=28-306
  misc_feature (16)..(25): Xaa can be any naturally occurring amino acid
  misc_feature (64)..(79): Xaa can be any naturally occurring amino acid
KGSFFFSPLKTPQIYXXXXXXXXXXTSLEGKGSPFKHFPHFLKKKSHSFFSPLIFNQPSFSFHXXXXXXXXXXXXXXXXLLFNHTSGLKLPLF

SEQ ID NO: 26423 - protein, 70 aa, Diabrotica virgifera
  misc_feature: Coding regions on vcDNA: vcDNA=SeqID_6120; Strand=+; Position=1-210
  misc_feature (47)..(57): Xaa can be any naturally occurring amino acid
IGGREICGGRRGQDILCPFQKKQKELRLLNQGNCFFQFTKLCLKTSXXXXXXXXXXXGGGAGPPPPPLGG

SEQ ID NO: 26424 - protein, 45 aa, Diabrotica virgifera
  misc_feature: Coding regions on vcDNA: vcDNA=SeqID_6121; Strand=+; Position=107-241
  misc_feature (15)..(22): Xaa can be any naturally occurring amino acid
  misc_feature (36)..(44): Xaa can be any naturally occurring amino acid
IKCYYIKINLILKKXXXXXXXXYRVFSSLKKFKLFXXXXXXXXXG

SEQ ID NO: 26425 - protein, 58 aa, Diabrotica virgifera
  misc_feature: Coding regions on vcDNA: vcDNA=SeqID_6122; Strand=-; Position=61-237
GVYLLPTTFYKKEQSSLLNNWGVNGPPFSVSKPKILGKFAPRPLKTHHFRNLFWKGTV

SEQ ID NO: 26426 - protein, 81 aa, Diabrotica virgifera
  misc_feature: Coding regions on vcDNA: vcDNA=SeqID_6123; Strand=+; Position=44-289
  misc_feature (37)..(43): Xaa can be any naturally occurring amino acid
HLSECGLYFAYIKGLIQGFVHDNWNALYLNVLILTHXXXXXXXGVTLYRYINYTKTFFIHRPFIIFNVFYKSRLSLRTDNF

SEQ ID NO: 26427 - protein, 62 aa, Diabrotica virgifera
  misc_feature: Coding regions on vcDNA: vcDNA=SeqID_6124; Strand=-; Position=170-358
  misc_feature (30)..(36): Xaa can be any naturally occurring amino acid
  misc_feature (46)..(46): Xaa can be any naturally occurring amino acid
VKNINILIGKLYSYLNSFYLDKLKFCVIIXXXXXXXKTKASLTFKXALVRWLYLRYLGTKKE

SEQ ID NO: 26428 - protein, 33 aa, Diabrotica virgifera
  misc_feature: Coding regions on vcDNA: vcDNA=SeqID_6125; Strand=+; Position=1-99
  misc_feature (16)..(22): Xaa can be any naturally occurring amino acid
ATSTKKLKISQMQNPXXXXXXXVDSILELRIFV

SEQ ID NO: 26429 - protein, 100 aa, Diabrotica virgifera
  misc_feature: Coding regions on vcDNA: vcDNA=SeqID_6126; Strand=+; Position=3-305
  misc_feature: Homolog annotation: Hit_ID=XP_319248.1; Match level="QueryCoverage =98%, HitCoverage=20%, E-value=3e-50, Identity=72%"; Hit description =ENSANGP00000006103 [Anopheles gambiae]
  misc_feature: Gene Ontology Annotation: Molecular function=protein tyrosine phosphatase activity; Cellular component=integral to plasma membrane; Biological process=motor axon guidance
  misc_feature: Pfam annotation: Pfam_ID=Y_phosphatase; Match level="Score=26.4, E -value=2.5e-09, Copies=1"; Pfam description=Protein-tyrosine phosphatase
VPKSGEGFIDFIGQVHKTKEQFGQDGPITVHCSAGVGRTGVFITLSIVLERMQYEGVVDVFQTARILRTQRPAMVQTEDQYQFCYRAALEYLGSFDHYTN

SEQ ID NO: 26430 - protein, 67 aa, Diabrotica virgifera
  misc_feature: Coding regions on vcDNA: vcDNA=SeqID_6127; Strand=-; Position=374-577
KSNTIVTSTLQSVVYTNRFSDNLLPFYVFIFVKPKICPYKQSIHCKLNKFTIKLHFNPDKQEENKIK

SEQ ID NO: 26431 - protein, 103 aa, Diabrotica virgifera
  misc_feature: Coding regions on vcDNA: vcDNA=SeqID_6128; Strand=-; Position=1-308
  misc_feature: Homolog annotation: Hit_ID=XP_312332.1; Match level="QueryCoverage =86%, HitCoverage=60%, E-value=1e-12, Identity=42%"; Hit description =ENSANGP00000010621 [Anopheles gambiae]
  misc_feature (59)..(59): Xaa can be any naturally occurring amino acid
NYAEKRSARFGVTIEVQQDLFSVSENVSLAHCVAQVVEMTKGISSVFNRKFGRLNELKXQQPKVGKVLRLEDGSRSLLYMVTKKCYTNMPSYENIWRALTNLK

SEQ ID NO: 26432 - protein, 188 aa, Diabrotica virgifera
  misc_feature: Coding regions on vcDNA: vcDNA=SeqID_6129; Strand=-; Position=2-564
  misc_feature: Homolog annotation: Hit_ID=NP_723065.1; Match level="QueryCoverage =99%, HitCoverage=4%, E-value=8e-54, Identity=56%"; Hit description =CG31649-PA [Drosophila melanogaster] gb|AAN10532.1| CG31649-PA [Drosophila melanogaster]
  misc_feature (1)..(1): Xaa can be any naturally occurring amino acid
  misc_feature (12)..(12): Xaa can be any naturally occurring amino acid
  misc_feature (169)..(180): Xaa can be any naturally occurring amino acid
XLEGGTLVKEQXQAIQKSIERVRRKHGEMSKRLDLCESSEKLGSDSIEKSVSECYEVGEELVTLWQDLMAIRQLLHGLPTRLKVSVSPLTVERDISKLQDDHTALEKRCGDILALLRSRLALWKRFERQLELVQQSVQEADFMVELLTVQGTVDYERLRKATERLESVXXXXXXXXXXXXELKDASKP

SEQ ID NO: 26433 - protein, 70 aa, Diabrotica virgifera
  misc_feature: Coding regions on vcDNA: vcDNA=SeqID_6130; Strand=+; Position=3-215
  misc_feature: Homolog annotation: Hit_ID=AAV34814.1; Match level="QueryCoverage =97%, HitCoverage=22%, E-value=2e-22, Identity=70%"; Hit description =ribosomal protein L5 [Bombyx mori]
  misc_feature: Gene Ontology Annotation: Molecular function=5S RNA binding; Cellular component=ribosome; Biological process=protein biosynthesis
  misc_feature: Pfam annotation: Pfam_ID=Ribosomal_L18p; Match level="Score=-16.3, E -value=0.00026, Copies=1"; Pfam description=Ribosomal L18p/L5e family
KYNTPNYRVIVRISNKNITCLIAFSRLEGDNIVCAAHSHELPRSGLTTGLTHYAAAYATGLLLVSMLLII

SEQ ID NO: 26434 - protein, 141 aa, Diabrotica virgifera
  misc_feature: Coding regions on vcDNA: vcDNA=SeqID_6131; Strand=-; Position=1-423
  misc_feature (1)..(13): Xaa can be any naturally occurring amino acid
  misc_feature (21)..(33): Xaa can be any naturally occurring amino acid
  misc_feature (38)..(53): Xaa can be any naturally occurring amino acid
  misc_feature (68)..(99): Xaa can be any naturally occurring amino acid
  misc_feature (105)..(113): Xaa can be any naturally occurring amino acid
  misc_feature (119)..(139): Xaa can be any naturally occurring amino acid
XXXXXXXXXXXXXPPEKWGGXXXXXXXXXXXXXRPPLXXXXXXXXXXXXXXXXPGTKKKLSPPPGQKXXXXXXXXXXXXXXXXXXXXXXXXXXXXXXXXGAGGFXXXXXXXXXGGGSPXXXXXXXXXXXXXXXXXXXXXTR

SEQ ID NO: 26435 - protein, 89 aa, Diabrotica virgifera
  misc_feature: Coding regions on vcDNA: vcDNA=SeqID_6132; Strand=-; Position=2-268
  misc_feature (52)..(62): Xaa can be any naturally occurring amino acid
KIVKGSLILYLFQTISLENWATFAKKKQEKMPNLVFFHKKRRGEKALLNVGXXXXXXXXXXXLNLVYSKKNPKKKVEEIFSYFLKGNKG

SEQ ID NO: 26436 - protein, 35 aa, Diabrotica virgifera
  misc_feature: Coding regions on vcDNA: vcDNA=SeqID_6133; Strand=-; Position=29-136
PHLSTSAWALFMMLSTIVRTPSLARQFILLCWPSI

SEQ ID NO: 26437 - protein, 44 aa, Diabrotica virgifera
  misc_feature: Coding regions on vcDNA: vcDNA=SeqID_6134; Strand=+; Position=2-136
  misc_feature (8)..(28): Xaa can be any naturally occurring amino acid
NSCTIHLXXXXXXXXXXXXXXXXXXXXXSSFVTIEYNKIVSIIY

SEQ ID NO: 26438 - protein, 73 aa, Diabrotica virgifera
  misc_feature: Coding regions on vcDNA: vcDNA=SeqID_6135; Strand=+; Position=5-226
  misc_feature (23)..(39): Xaa can be any naturally occurring amino acid
CTIKVLTIAKMYLTYHLCLKDVXXXXXXXXXXXXXXXXXPHMKKVKKSARGGPATVAPYSNSYYSHWPSCYTI

SEQ ID NO: 26439 - protein, 46 aa, Diabrotica virgifera
  misc_feature: Coding regions on vcDNA: vcDNA=SeqID_6136; Strand=+; Position=3-143
  misc_feature: Homolog annotation: Hit_ID=CAA06694.1; Match level="QueryCoverage =78%, HitCoverage=5%, E-value=8e-11, Identity=94%"; Hit description =heat shock protein 90 [Brugia pahangi]
  misc_feature: Gene Ontology Annotation: Molecular function=chaperonin ATPase activity; Cellular component=centrosome; Biological process =regulation of sleep
DLVNNLGTIAKSGTKAFMEALLAGADISMIGQFGDGENASRMEEVN

SEQ ID NO: 26440 - protein, 121 aa, Diabrotica virgifera
  misc_feature: Coding regions on vcDNA: vcDNA=SeqID_6137; Strand=+; Position=2-367
  misc_feature: Homolog annotation: Hit_ID=JU0141; Match level="QueryCoverage=97%, HitCoverage=24%, E-value=1e-24, Identity=52%"; Hit description=UMP synthase - fruit fly (Drosophila melanogaster)
  misc_feature: Gene Ontology Annotation: Molecular function=orotidine-5'-phosphate decarboxylase activity; Cellular component=cellular_component unknown; Biological process=UMP biosynthesis
  misc_feature (16)..(16): Xaa can be any naturally occurring amino acid
  misc_feature (63)..(69): Xaa can be any naturally occurring amino acid
GIQERGVFLLAEASAXGNLITESYVKDTLKMAEEYSDLVAGVVCQNPLFLNSHGLIHLCPGVXXXXXXXTLGQRYNSPETVVLEKGADIAVVGRGITQAPDPATAAESYRQLLWNAYEKKT

SEQ ID NO: 26441 - protein, 73 aa, Diabrotica virgifera
  misc_feature: Coding regions on vcDNA: vcDNA=SeqID_6138; Strand=+; Position=166-387
INISKTKGMAVGKINIDQDVFPLNGEEMERRIQPCKVGVMKCKFSRVWRTQDFFRDGLLFSYSSCTVSFQNVG

SEQ ID NO: 26442 - protein, 215 aa, Diabrotica virgifera
  misc_feature: Coding regions on vcDNA: vcDNA=SeqID_6139; Strand=-; Position=1-645
  misc_feature: Homolog annotation: Hit_ID=S18211; Match level="QueryCoverage=94%, HitCoverage=19%, E-value=2e-36, Identity=37%"; Hit description =hypothetical protein 2 - fruit fly (Drosophila virilis) retrotransposon Ulysses emb|CAA39967.1|
  misc_feature: Pfam annotation: Pfam_ID=rve; Match level="Score=58.9, E-value=1.4e -14, Copies=1"; Pfam description=Integrase core domain
  misc_feature (11)..(11): Xaa can be any naturally occurring amino acid
PEVNKSCHDPXRCAHLGFYKILSRVQERYYWPKMRRDILQYVRSCLICGAQKAPNTGLMGMMGREKTADRPWQVIAVDLIGPLTRSRKGYTWLLVIADWFSKYTLLHPLRNATATNIASYLEDNVFLIFGVPEYVMCDNAHNFTGPPLRNLCERYNVRKIWYSAVYSPQCNFVERTNKTIGTAIRSYIDEHRDWDNTLSKIRQALNTAKHEVTGY

SEQ ID NO: 26443 - protein, 41 aa, Diabrotica virgifera
  misc_feature: Coding regions on vcDNA: vcDNA=SeqID_6140; Strand=+; Position=2-127
  misc_feature (20)..(26): Xaa can be any naturally occurring amino acid
LNKFKLFSLKIKFFINEIKXXXXXXXHSFKISIKRLMIKLP

SEQ ID NO: 26444 - protein, 67 aa, Diabrotica virgifera
  misc_feature: Coding regions on vcDNA: vcDNA=SeqID_6141; Strand=+; Position=3-206
  misc_feature (4)..(12): Xaa can be any naturally occurring amino acid
  misc_feature (31)..(39): Xaa can be any naturally occurring amino acid
  misc_feature (54)..(60): Xaa can be any naturally occurring amino acid
TILXXXXXXXXXNLKGGGGIIIISNKGGVVXXXXXXXXXVSSKKPTFFKYPHDXXXXXXXYDPPTIK

SEQ ID NO: 26445 - protein, 80 aa, Diabrotica virgifera
  misc_feature: Coding regions on vcDNA: vcDNA=SeqID_6142; Strand=+; Position=2-244
  misc_feature (1)..(6): Xaa can be any naturally occurring amino acid
  misc_feature (8)..(8): Xaa can be any naturally occurring amino acid
XXXXXXHXRSFGFLPWILLLSDKFVSYKCDDIIGSKMGRANLKKIISPLWARLLPKYIPKRAVPIFWTRMINLPMPRVKI

SEQ ID NO: 26446 - protein, 97 aa, Diabrotica virgifera
  misc_feature: Coding regions on vcDNA: vcDNA=SeqID_6143; Strand=+; Position=220-513
KRTTLTRTHFGQYAYIAWITDEYSAIQLEAHYCIVAHTRSFRICQALSTTVSYTQLMRTILTPYPYYTEALSMMVGACVFSTVRLHLKESETMSYSE

SEQ ID NO: 26447 - protein, 55 aa, Diabrotica virgifera
  misc_feature: Coding regions on vcDNA: vcDNA=SeqID_6144; Strand=-; Position=2-166
  misc_feature (25)..(32): Xaa can be any naturally occurring amino acid
  misc_feature (39)..(39): Xaa can be any naturally occurring amino acid
SPVVKHITSDALRCYEKIHSVTLMXXXXXXXXVMTSQPXIHIYNNCVFNFTNWYL

SEQ ID NO: 26448 - protein, 204 aa, Diabrotica virgifera
  misc_feature: Coding regions on vcDNA: vcDNA=SeqID_6145; Strand=+; Position=19-630
  misc_feature (187)..(187): Xaa can be any naturally occurring amino acid
  misc_feature (201)..(201): Xaa can be any naturally occurring amino acid
IMSEGVSPWKTNHHDIGMLMLKDRREKITNAGKYSDRYKDIFSHEVPDEEKFPLSAKCRDTMEHYRKVSKGGKPEDSPTAVSKLTTEKMKLTVGKKSSNATNDLNKQENALIGFKHVPEGTHKPNQPPLPLSSPNTTKWQKRNVNVYSVNTNVPPSSPNQIRAPPGFPPKKPPPVALSAILNGNNNXQYITNNNNHFRYTXSHL

SEQ ID NO: 26449 - protein, 67 aa, Diabrotica virgifera
  misc_feature: Coding regions on vcDNA: vcDNA=SeqID_6146; Strand=+; Position=262-465
LNQIYCSMIYFSLLCAVLENICLLFKSAILFLTADVVLRAVLINSTMNIDQCIYFVNSICILTYFLL

SEQ ID NO: 26450 - protein, 50 aa, Diabrotica virgifera
  misc_feature: Coding regions on vcDNA: vcDNA=SeqID_6147; Strand=+; Position=359-508
  misc_feature (17)..(17): Xaa can be any naturally occurring amino acid
ACVVIKILTILLILIPXNLSLAICYCVNTFWQRVPFLLDVKTYTCITLLV

SEQ ID NO: 26451 - protein, 183 aa, Diabrotica virgifera
  misc_feature: Coding regions on vcDNA: vcDNA=SeqID_6148; Strand=+; Position=3-551
  misc_feature: Homolog annotation: Hit_ID=XP_393690.1; Match level="QueryCoverage =97%, HitCoverage=18%, E-value=1e-54, Identity=57%"; Hit description =similar to ENSANGP00000016011 [Apis mellifera]
  misc_feature: Gene Ontology Annotation: Molecular function=dihydropyrimidine dehydrogenase activity; Cellular component=cytosol; Biological process=pyrimidine base catabolism
  misc_feature (83)..(89): Xaa can be any naturally occurring amino acid
  misc_feature (96)..(96): Xaa can be any naturally occurring amino acid
  misc_feature (141)..(141): Xaa can be any naturally occurring amino acid
DNASCPCKQSAEMFPKLHGDVIVLGARDTAFDCATSALRCGAKKVFVVFRRGFTNIRAVPEEVSVAVEEKCELIGFLAPHSVXXXXXXXVSVTFNXTEDTEDGKWVQDTEQLNTIKSSFLISAFGSGVEDQEVIDALAPLXLGPKNLPVVDVNTMQTSHPSVWGGGDLAGVAETTVEAVNDGK

SEQ ID NO: 26452 - protein, 40 aa, Diabrotica virgifera
  misc_feature: Coding regions on vcDNA: vcDNA=SeqID_6149; Strand=+; Position=26-145
FNLPGFYPLFLLLHSLCYLISTIFLLMLISTHLYILFLLS

SEQ ID NO: 26453 - protein, 60 aa, Diabrotica virgifera
  misc_feature: Coding regions on vcDNA: vcDNA=SeqID_6150; Strand=-; Position=0-179
  misc_feature (10)..(16): Xaa can be any naturally occurring amino acid
  misc_feature (19)..(26): Xaa can be any naturally occurring amino acid
  misc_feature (33)..(39): Xaa can be any naturally occurring amino acid
NTVQNYMLNXXXXXXXCQXXXXXXXXFNYDLGXXXXXXXKANRDTLATLTTLNLTPGISP

SEQ ID NO: 26454 - protein, 88 aa, Diabrotica virgifera
  misc_feature: Coding regions on vcDNA: vcDNA=SeqID_6151; Strand=-; Position=1-264
  misc_feature (32)..(40): Xaa can be any naturally occurring amino acid
  misc_feature (61)..(68): Xaa can be any naturally occurring amino acid
KYGSCDNSGERVFNSLFTNVNINIIIYTGCAXXXXXXXXXETERRMYVIYLIQNAFYYCQXXXXXXXXQINIDFRLTEMFKLARGRWV

SEQ ID NO: 26455 - protein, 66 aa, Diabrotica virgifera
  misc_feature: Coding regions on vcDNA: vcDNA=SeqID_6152; Strand=+; Position=3-200
  misc_feature: Homolog annotation: Hit_ID=XP_312465.1; Match level="QueryCoverage =98%, HitCoverage=45%, E-value=3e-14, Identity=60%"; Hit description =ENSANGP00000022152 [Anopheles gambiae]
  misc_feature: Pfam annotation: Pfam_ID=ATP-synt_F; Match level="Score=-17.0, E -value=0.09, Copies=1"; Pfam description=ATP synthase (F/14-kDa) subunit
CVGFLLRGIGNINSYSHPNFLVVDINSAVIEIQYFFYRILIRYDIDIIWVIQNFADLIIYVFDSHY

SEQ ID NO: 26456 - protein, 155 aa, Diabrotica virgifera
  misc_feature: Coding regions on vcDNA: vcDNA=SeqID_6153; Strand=+; Position=22-486
  misc_feature: Homolog annotation: Hit_ID=IJCH3; Match level="QueryCoverage=74%, HitCoverage=14%, E-value=2e-10, Identity=26%"; Hit description =integrin, band 3 precursor - chicken sp|P07228|ITB1_CHICK Integrin beta-1 precursor (CSAT antigen) (JG22 antige
  misc_feature: Gene Ontology Annotation: Molecular function=oxidoreductase activity; Cellular component=integral to membrane; Biological process=metabolism
  misc_feature (58)..(64): Xaa can be any naturally occurring amino acid
TQHIKRILTLNLVLIVIILCIYNETSICYGLDNREVNFKVQLTAKHIPEHTQRDTLYXXXXXXXEKLTVNVEYVSSCQCSNYKDDGNKFCGHGTYRCGRWYCQEGWSGSNCSENCENFDFRSCRSYEDLIPHQKICFENGDCKCGHWECELPYSG

SEQ ID NO: 26457 - protein, 50 aa, Diabrotica virgifera
  misc_feature: Coding regions on vcDNA: vcDNA=SeqID_6154; Strand=+; Position=2-154
KNLIDCGVQNNKISSSYKLIGHRQGRQTKCPGDALYEEVTKMPHWEAHPN

SEQ ID NO: 26458 - protein, 135 aa, Diabrotica virgifera
  misc_feature: Coding regions on vcDNA: vcDNA=SeqID_6155; Strand=-; Position=3-407
  misc_feature (16)..(21): Xaa can be any naturally occurring amino acid
  misc_feature (41)..(47): Xaa can be any naturally occurring amino acid
  misc_feature (69)..(79): Xaa can be any naturally occurring amino acid
  misc_feature (105)..(120): Xaa can be any naturally occurring amino acid
  misc_feature (122)..(132): Xaa can be any naturally occurring amino acid
KPAKKFLNPPIKGEFXXXXXXLCKFGKKFGQIWPKFFPFGXXXXXXXPFPTEKTGKKVPKRGWEKKSKXXXXXXXXXXXRNWVFKGLIPKTPLFWGPQKLGIPNXXXXXXXXXXXXXXXXPXXXXXXXXXXXFGT

SEQ ID NO: 26459 - protein, 163 aa, Diabrotica virgifera
  misc_feature: Coding regions on vcDNA: vcDNA=SeqID_6156; Strand=-; Position=0-488
FVQDVYVKEFEVWRICLDINRKMFYYPTENHRSFCVVGAFYAYGFATNKSGSRTRRYPIVGLRRIYRDSVPHGNISQGRHTWKHGIDIFMKKINRIEDRNYKLDKEYIPEGVDVPEIVPEPIVQEPCTEVDEDIYNRFKDYMNLQKNGNRKSFSGNVGWRMHG

SEQ ID NO: 26460 - protein, 187 aa, Diabrotica virgifera
  misc_feature: Coding regions on vcDNA: vcDNA=SeqID_6157; Strand=-; Position=19-582
  misc_feature: Homolog annotation: Hit_ID=CAH64510.1; Match level="QueryCoverage =90%, HitCoverage=32%, E-value=1e-28, Identity=38%"; Hit description =putative esterase [Tribolium castaneum]
  misc_feature: Gene Ontology Annotation: Molecular function=carboxylesterase activity
  misc_feature (72)..(81): Xaa can be any naturally occurring amino acid
MAIENKDPKKELIKEKLKKFYFTENADEMAKYVMATDGTYTAPVVGTAKLHAKAQTEPVYLYLMSLDAGLNXXXXXXXXXXMPGACHADDLGYLFQMPLESLNMHRGEKELKAIRIFVKLWTNFAKFGNPTPQGNDMNITWSPVNQEEVNYLDIGDELTMRSNPEPERLKLWREIFQLSPYTQYYLQ

SEQ ID NO: 26461 - protein, 52 aa, Diabrotica virgifera
  misc_feature: Coding regions on vcDNA: vcDNA=SeqID_6158; Strand=+; Position=3-158
  misc_feature (16)..(35): Xaa can be any naturally occurring amino acid
NIHRHCLYQPHFKYAXXXXXXXXXXXXXXXXXXXXVLYCYVILSLINGKFTV

SEQ ID NO: 26462 - protein, 96 aa, Diabrotica virgifera
  misc_feature: Coding regions on vcDNA: vcDNA=SeqID_6159; Strand=-; Position=2-289
  misc_feature: Homolog annotation: Hit_ID=AAV91018.1; Match level="QueryCoverage =88%, HitCoverage=23%, E-value=3e-09, Identity=41%"; Hit description =hemolymph proteinase 20 [Manduca sexta]
AERFEQQYHFFDKICAGRQNGTIAVCKGNSGSGLIFKNRENDRYYLQGIVSISPNLYTSQCNYQTIALYTSVLFYNSFIKREITKSHLDLEDCILP

SEQ ID NO: 26463 - protein, 138 aa, Diabrotica virgifera
  misc_feature: Coding regions on vcDNA: vcDNA=SeqID_6160; Strand=-; Position=1-414
MESREHTLAATFYGMFTSTDVDIVGEKDPIYRRKTIRIRSLEHEFHVSRTYVKKSRRDKNPVATMEMRYGSDIINDYVYRMAEYKLKFDQEYCATNLEPKTVHPDNIVEDDEEIREDVYQKFKEIANLRKNGGRGMSG

SEQ ID NO: 26464 - protein, 77 aa, Diabrotica virgifera
  misc_feature: Coding regions on vcDNA: vcDNA=SeqID_6161; Strand=-; Position=272-505
  misc_feature (51)..(63): Xaa can be any naturally occurring amino acid
KIHPGPPLFIPLKGVIYLNSNMKTTIFPTIYFPRAYVYRPPFSGGGATKMXXXXXXXXXXXXXALTVMKIKKKPCAS

SEQ ID NO: 26465 - protein, 50 aa, Diabrotica virgifera
  misc_feature: Coding regions on vcDNA: vcDNA=SeqID_6162; Strand=+; Position=3-155
APLSILHTTLIKGGLLKLGGAFVEHIRIFCTYKLKLNILLIGLDNISFIT

SEQ ID NO: 26466 - protein, 90 aa, Diabrotica virgifera
  misc_feature: Coding regions on vcDNA: vcDNA=SeqID_6163; Strand=+; Position=192-464
HAIQKSGFTYFSPRINTVINLINSILTALMNAIIWPYGGSWSLKNLIRFLFQNTDRRLQNKDRFFFSTLYSSFNKKSMIIFLSRGKIPGH

SEQ ID NO: 26467 - protein, 33 aa, Diabrotica virgifera
  misc_feature: Coding regions on vcDNA: vcDNA=SeqID_6164; Strand=+; Position=2-103
ELKKSNKLQKHIEKRSKKLSKKEKRNMGKAEIQ

SEQ ID NO: 26468 - protein, 41 aa, Diabrotica virgifera
  misc_feature: Coding regions on vcDNA: vcDNA=SeqID_6165; Strand=-; Position=178-303
SVIKKFRFAANKITENILYRHLSVFQQYKNNAVKLVLRAFV

SEQ ID NO: 26469 - protein, 77 aa, Diabrotica virgifera
  misc_feature: Coding regions on vcDNA: vcDNA=SeqID_6166; Strand=+; Position=19-252
WLKRYWPSSQGWSARLVAMESKVKTLEEARQHMFQATTPLYPNLANIAPTQHVPVNVTPLAAQTVSEDPFGPVFKGH

SEQ ID NO: 26470 - protein, 65 aa, Diabrotica virgifera
  misc_feature: Coding regions on vcDNA: vcDNA=SeqID_6167; Strand=+; Position=5-199
KFPDAIIPILRDMYVDDFIISFPNVSEAIVTHTQLVNLFQKSGFKLTKWMSNSNDLLSTIPEPLQ

SEQ ID NO: 26471 - protein, 82 aa, Diabrotica virgifera
  misc_feature: Coding regions on vcDNA: vcDNA=SeqID_6168; Strand=+; Position=150-398
  misc_feature (17)..(29): Xaa can be any naturally occurring amino acid
  misc_feature (53)..(60): Xaa can be any naturally occurring amino acid
TNFDVFVFYTNKLDFSXXXXXXXXXXXXXILKFLENLMYCPFLYLCLLLPLSXXXXXXXXHYYDSLITSVLKHVLSNIKMGA

SEQ ID NO: 26472 - protein, 54 aa, Diabrotica virgifera
  misc_feature: Coding regions on vcDNA: vcDNA=SeqID_6169; Strand=+; Position=94-258
  misc_feature (6)..(12): Xaa can be any naturally occurring amino acid
  misc_feature (42)..(47): Xaa can be any naturally occurring amino acid
VIKDQXXXXXXXKMHVFNQFFINNSKSVSSYKKGIIIKIEAXXXXXXPFSRKTF

SEQ ID NO: 26473 - protein, 21 aa, Diabrotica virgifera
  misc_feature: Coding regions on vcDNA: vcDNA=SeqID_6170; Strand=-; Position=1-66
  misc_feature (21)..(21): Xaa can be any naturally occurring amino acid
LNFNLTNVPMYQIKTKFIINX

SEQ ID NO: 26474 - protein, 65 aa, Diabrotica virgifera
  misc_feature: Coding regions on vcDNA: vcDNA=SeqID_6171; Strand=+; Position=1-198
FSFDGFCQMYLNNIFFPTAFTVLRHLLRLPTPTVVGRLFVAKCLTYVTRVQKPIFKFVAVTIFDL

SEQ ID NO: 26475 - protein, 40 aa, Diabrotica virgifera
  misc_feature: Coding regions on vcDNA: vcDNA=SeqID_6172; Strand=-; Position=1-120
  misc_feature (24)..(33): Xaa can be any naturally occurring amino acid
KPAPEFLKPPPKGEFGAGPPTQGXXXXXXXXXXSLPIFLI

SEQ ID NO: 26476 - protein, 42 aa, Diabrotica virgifera
  misc_feature: Coding regions on vcDNA: vcDNA=SeqID_6173; Strand=+; Position=3-128
  misc_feature (33)..(40): Xaa can be any naturally occurring amino acid
ILRYKLIGRYIRRIYSEKSVNTHTLYGKRPRDXXXXXXXXLG

SEQ ID NO: 26477 - protein, 54 aa, Diabrotica virgifera
  misc_feature: Coding regions on vcDNA: vcDNA=SeqID_6174; Strand=-; Position=8-172
  misc_feature (9)..(9): Xaa can be any naturally occurring amino acid
ATQYINQNXRVVSFLTSKISKTNHFIVTNEGYIIFIESTGESKKLTKIAFSPVA

SEQ ID NO: 26478 - protein, 59 aa, Diabrotica virgifera
  misc_feature: Coding regions on vcDNA: vcDNA=SeqID_6175; Strand=-; Position=95-274
  misc_feature (24)..(29): Xaa can be any naturally occurring amino acid
GANHRKSNSKFFSNQIMLALNFVXXXXXXTLYRTRLLLASLATLTLLVISDSFDKESFY

SEQ ID NO: 26479 - protein, 48 aa, Diabrotica virgifera
  misc_feature: Coding regions on vcDNA: vcDNA=SeqID_6176; Strand=+; Position=12-158
VKVITMTITITTIPAHQTITGIRGIMIWLLSLIDNMKLRRDSKQSYFF

SEQ ID NO: 26480 - protein, 81 aa, Diabrotica virgifera
  misc_feature: Coding regions on vcDNA: vcDNA=SeqID_6177; Strand=-; Position=54-299
  misc_feature (69)..(78): Xaa can be any naturally occurring amino acid
KQISGCLLMPFLEIAESGVLLLRGPLLSAIVPCIMRSRRLYLSGCPKCLKYYNFRIFIYTRVLFSTFNXXXXXXXXXXRFL

SEQ ID NO: 26481 - protein, 58 aa, Diabrotica virgifera
  misc_feature: Coding regions on vcDNA: vcDNA=SeqID_6178; Strand=-; Position=0-173
  misc_feature (15)..(38): Xaa can be any naturally occurring amino acid
  misc_feature (46)..(57): Xaa can be any naturally occurring amino acid
PPELLTPPQRGKGGXXXXXXXXXXXXXXXXXXXXXXXXGVLVPQNXXXXXXXXXXXXG

SEQ ID NO: 26482 - protein, 126 aa, Diabrotica virgifera
  misc_feature: Coding regions on vcDNA: vcDNA=SeqID_6179; Strand=-; Position=77-457
  misc_feature (57)..(66): Xaa can be any naturally occurring amino acid
  misc_feature (85)..(97): Xaa can be any naturally occurring amino acid
FLLNSFYGFPPSPQVKKPPVIRNSPLGRRQIFWEIFCPKGHPFRFRGAWGPQKIWVXXXXXXXXXXKWENLVFFHQEKKLGPKRXXXXXXXXXXXXXAPLGHPMGENFSPPPFSKGVFKMKKPLRV

SEQ ID NO: 26483 - protein, 76 aa, Diabrotica virgifera
  misc_feature: Coding regions on vcDNA: vcDNA=SeqID_6180; Strand=-; Position=1-227
  misc_feature: Homolog annotation: Hit_ID=T30319; Match level="QueryCoverage=92%, HitCoverage=5%, E-value=2e-12, Identity=48%"; Hit description=Lian -Aa1 retrotransposition protein - yellow fever mosquito gb|AAB65093.1| Lian-Aa1
  misc_feature (62)..(62): Xaa can be any naturally occurring amino acid
LKYSPEPPPTLELMELVRYCEDLRITLLVGCDFNSHHIVWGSTYINPRGAALLQCLSGTDLXILNRSSVPTFMTSR

SEQ ID NO: 26484 - protein, 170 aa, Diabrotica virgifera
  misc_feature: Coding regions on vcDNA: vcDNA=SeqID_6181; Strand=+; Position=71-580
TPYENTWHIIPPDYIHLEEEYRYPLLDTMKMTGTTIANQRQPASFAISDILELDRQNSEEIDPITTDMSVYPTHHDLSYSTRHQWLQVPEPGMHHAPPHLTIPPHSSQLSPDSTSPAISERSSVPPDTPLGDSNMTNPLNQAPSSMGTISEGEMEEQDDIKEEEGEQQSN

SEQ ID NO: 26485 - protein, 97 aa, Diabrotica virgifera
  misc_feature: Coding regions on vcDNA: vcDNA=SeqID_6182; Strand=-; Position=0-290
  misc_feature (3)..(11): Xaa can be any naturally occurring amino acid
PPXXXXXXXXXISSVGVRYLSDKSLSGISLSGLAISFLGLEISSLGLEISSTISSVGLGTEDSSSCLASTTTSASTFSDSVLPSTVGSSVVGVSSAA

SEQ ID NO: 26486 - protein, 131 aa, Diabrotica virgifera
  misc_feature: Coding regions on vcDNA: vcDNA=SeqID_6183; Strand=+; Position=22-414
  misc_feature (71)..(80): Xaa can be any naturally occurring amino acid
  misc_feature (104)..(110): Xaa can be any naturally occurring amino acid
GAPLKIKNPPGLGVVFQKGPPWGETNWPRKTLGRFLFWKKGCLTPALENSPTPGGLVGPKKNKNLGGLIGXXXXXXXXXXFYPGETPAFEPLEAPRNLGAPFSXXXXXXXKMVSFWGGPPRKGFFFLGGGA

SEQ ID NO: 26487 - protein, 160 aa, Diabrotica virgifera
  misc_feature: Coding regions on vcDNA: vcDNA=SeqID_6184; Strand=+; Position=70-549
  misc_feature: Homolog annotation: Hit_ID=XP_314867.1; Match level="QueryCoverage =71%, HitCoverage=15%, E-value=2e-14, Identity=39%"; Hit description =ENSANGP00000005174 [Anopheles gambiae]
  misc_feature (70)..(70): Xaa can be any naturally occurring amino acid
GCVWELGCFDGGHEQSETYPLSSDARGGTSFGRLCADSPNWNIENNAFFDDVDIIARSKREMIEAFNAIXRAAHNSGLNINEIKTTYMKARKSTGQRNLQNLTIGDYNIESVKNFTYLGSLVTAEYNVSEEVKRRIHIANKTYNGLIKHLRSNNITRKTK

SEQ ID NO: 26488 - protein, 212 aa, Diabrotica virgifera
  misc_feature: Coding regions on vcDNA: vcDNA=SeqID_6185; Strand=-; Position=1-639
  misc_feature (2)..(28): Xaa can be any naturally occurring amino acid
  misc_feature (33)..(41): Xaa can be any naturally occurring amino acid
  misc_feature (43)..(54): Xaa can be any naturally occurring amino acid
  misc_feature (61)..(84): Xaa can be any naturally occurring amino acid
  misc_feature (86)..(92): Xaa can be any naturally occurring amino acid
  misc_feature (96)..(107): Xaa can be any naturally occurring amino acid
  misc_feature (128)..(135): Xaa can be any naturally occurring amino acid
  misc_feature (143)..(156): Xaa can be any naturally occurring amino acid
  misc_feature (160)..(187): Xaa can be any naturally occurring amino acid
  misc_feature (190)..(198): Xaa can be any naturally occurring amino acid
  misc_feature (204)..(211): Xaa can be any naturally occurring amino acid
PXXXXXXXXXXXXXXXXXXXXXXXXXXXTGGGXXXXXXXXXLXXXXXXXXXXXXRQKHPPXXXXXXXXXXXXXXXXXXXXXXXXKXXXXXXXCFFXXXXXXXXXXXXAPPQRKMGGFLRRAPPLFPIXXXXXXXXNVGGGFRXXXXXXXXXXXXXXKTPXXXXXXXXXXXXXXXXXXXXXXXXXXXXREXXXXXXXXXKPKKKXXXXXXXXD

SEQ ID NO: 26489 - protein, 106 aa, Diabrotica virgifera
  misc_feature: Coding regions on vcDNA: vcDNA=SeqID_6186; Strand=+; Position=3-323
  misc_feature: Homolog annotation: Hit_ID=NP_729929.1; Match level="QueryCoverage =100%, HitCoverage=67%, E-value=3e-43, Identity=83%"; Hit description= CG32131-PA [Drosophila melanogaster] gb|EAL31116.1| GA16700-PA [Drosophila
  misc_feature: Pfam annotation: Pfam_ID=PDZ; Match level="Score=14.1, E-value=0.025, Copies=1"; Pfam description=PDZ domain (Also known as DHR or GLGF)
LRITGQKTKPILGIAIERGANTKHPLPRIININESGAAFYAGGLEVGQLILQVDGTRVDGLQHQDVARLIAECFARRDREEIEFLVVEAKKSNMEPKPTALIFLEA

SEQ ID NO: 26490 - protein, 141 aa, Diabrotica virgifera
  misc_feature: Coding regions on vcDNA: vcDNA=SeqID_6187; Strand=-; Position=2-424
  misc_feature (9)..(25): Xaa can be any naturally occurring amino acid
  misc_feature (31)..(40): Xaa can be any naturally occurring amino acid
  misc_feature (77)..(84): Xaa can be any naturally occurring amino acid
  misc_feature (91)..(101): Xaa can be any naturally occurring amino acid
  misc_feature (132)..(139): Xaa can be any naturally occurring amino acid
PGGAHSPKXXXXXXXXXXXXXXXXXPGEIGXXXXXXXXXXKAGVFPLNPGGGEGFFKYLTTFQMKKLVFFPLKGTGXXXXXXXXPPPQKVXXXXXXXXXXXSLPNQKQVGLSQRRKLGGFTQVTRAPTGIEXXXXXXXXSR

SEQ ID NO: 26491 - protein, 57 aa, Diabrotica virgifera
  misc_feature: Coding regions on vcDNA: vcDNA=SeqID_6188; Strand=-; Position=1-171
  misc_feature (52)..(52): Xaa can be any naturally occurring amino acid
KKKEGWPPPPPRGVIKIPPRAGGRPPPPKERSEKMLVFLWWPPTKKRGVWGXGFFFY

SEQ ID NO: 26492 - protein, 103 aa, Diabrotica virgifera
  misc_feature: Coding regions on vcDNA: vcDNA=SeqID_6189; Strand=+; Position=92-400
  misc_feature: Homolog annotation: Hit_ID=XP_394440.1; Match level="QueryCoverage =99%, HitCoverage=53%, E-value=2e-28, Identity=56%"; Hit description =similar to CG10343-PA [Apis mellifera]
  misc_feature: Pfam annotation: Pfam_ID=RWD; Match level="Score=65.0, E-value=2.1e -16, Copies=1"; Pfam description=RWD domain
  misc_feature (93)..(93): Xaa can be any naturally occurring amino acid
MSELELQEEEREALSSIYEGDDLFKQIDKCTYQYKYGEHDTNKSFVLEIKWVEQYPNELPVMNMDTFYNNHIVTSLKQKIVEMFRTEAEQYLXMSMTYSLFEF

SEQ ID NO: 26493 - protein, 37 aa, Diabrotica virgifera
  misc_feature: Coding regions on vcDNA: vcDNA=SeqID_6190; Strand=+; Position=64-177
RKFNYATFISVQLFSEMNTVKVIIKKPRKKSDFSLIF

SEQ ID NO: 26494 - protein, 121 aa, Diabrotica virgifera
  misc_feature: Coding regions on vcDNA: vcDNA=SeqID_6191; Strand=+; Position=1-366
  misc_feature (66)..(75): Xaa can be any naturally occurring amino acid
HKYMGRRLTGEEEETVEQWVASNLSDEFLAVMLSFKIKDTYMFPATLFKEELVKKFSTKKWWKLIXXXXXXXXXXPYEFCIYMLSLFSCPASSASIERIFSSYGLIWTKLRNRLGELGKKI

SEQ ID NO: 26495 - protein, 76 aa, Diabrotica virgifera
  misc_feature: Coding regions on vcDNA: vcDNA=SeqID_6192; Strand=-; Position=2-229
  misc_feature (5)..(33): Xaa can be any naturally occurring amino acid
  misc_feature (39)..(45): Xaa can be any naturally occurring amino acid
  misc_feature (51)..(58): Xaa can be any naturally occurring amino acid
  misc_feature (61)..(71): Xaa can be any naturally occurring amino acid
KKLGXXXXXXXXXXXXXXXXXXXXXXXXXXXXXLILKEXXXXXXXLLRVFXXXXXXXXFYXXXXXXXXXXXGRFFF

SEQ ID NO: 26496 - protein, 87 aa, Diabrotica virgifera
  misc_feature: Coding regions on vcDNA: vcDNA=SeqID_6193; Strand=-; Position=1-261
MWVPTLDPFFSDQIKIRFRPTSGVAFPILIEKCLVSFRLVASWLQVCCKLVVSWLQVGGLQANMLKYIQCHHLLKHLIGTHTLAEKS

SEQ ID NO: 26497 - protein, 50 aa, Diabrotica virgifera
  misc_feature: Coding regions on vcDNA: vcDNA=SeqID_6194; Strand=+; Position=3-155
  misc_feature (38)..(48): Xaa can be any naturally occurring amino acid
ARGLALICSNRSRNEGQAETKTVFFETIKKGMFKLKTXXXXXXXXXXXKV

SEQ ID NO: 26498 - protein, 99 aa, Diabrotica virgifera
  misc_feature: Coding regions on vcDNA: vcDNA=SeqID_6195; Strand=+; Position=2-298
  misc_feature: Homolog annotation: Hit_ID=NP_652705.1; Match level="QueryCoverage =98%, HitCoverage=12%, E-value=1e-19, Identity=54%"; Hit description =CG1915-PC, isoform C [Drosophila melanogaster] gb|AAG22226.2| CG1915- PC, isoform C [Drosophila
  misc_feature: Gene Ontology Annotation: Biological process=mitotic chromosome condensation
KKKKVIKKRVIKKHKDGKQEKTEIVTIEEEGRKPETTVTVEELEELEEVAPEKPTYIVEELPEEVQVTEVVTKEGDKKRKVIKKRVIKKQKDGKQEKTE

SEQ ID NO: 26499 - protein, 53 aa, Diabrotica virgifera
  misc_feature: Coding regions on vcDNA: vcDNA=SeqID_6196; Strand=+; Position=1-159
CRFMAHNCIKCKQYCLMCICLRKIKYDIVLIKINKHQQFRPPRTHPSLLPDFP

SEQ ID NO: 26500 - protein, 44 aa, Diabrotica virgifera
  misc_feature: Coding regions on vcDNA: vcDNA=SeqID_6197; Strand=+; Position=50-184
FITTVQSSSQQSDHSHYDIQPPIGQGTLRRILQLCTIGELHLVL

SEQ ID NO: 26501 - protein, 95 aa, Diabrotica virgifera
  misc_feature: Coding regions on vcDNA: vcDNA=SeqID_6198; Strand=+; Position=10-294
KTQSKPAALSPSQLSISSAASLACLWMSVRSLSKGAPVLTKATMLSFTHLPAPSTRATRILTRSASCCSTQETMDILKVDLQIPEAVKGDIQPVI

SEQ ID NO: 26502 - protein, 43 aa, Diabrotica virgifera
  misc_feature: Coding regions on vcDNA: vcDNA=SeqID_6199; Strand=-; Position=118-249
KNGPLFWIVQNSWGASWGKKGFFRIQRPPTPCCFTWTVSFPPV

SEQ ID NO: 26503 - protein, 120 aa, Diabrotica virgifera
  misc_feature: Coding regions on vcDNA: vcDNA=SeqID_6200; Strand=-; Position=2-361
  misc_feature (5)..(11): Xaa can be any naturally occurring amino acid
  misc_feature (14)..(36): Xaa can be any naturally occurring amino acid
  misc_feature (39)..(52): Xaa can be any naturally occurring amino acid
  misc_feature (63)..(102): Xaa can be any naturally occurring amino acid
  misc_feature (109)..(119): Xaa can be any naturally occurring amino acid
MGGSXXXXXXXIKXXXXXXXXXXXXXXXXXXXXXXXGGXXXXXXXXXXXXXXGLLGGEGGFFXXXXXXXXXXXXXXXXXXXXXXXXXXXXXXXXXXXXXXXXPFFQRKXXXXXXXXXXXL

SEQ ID NO: 26504 - protein, 67 aa, Diabrotica virgifera
  misc_feature: Coding regions on vcDNA: vcDNA=SeqID_6201; Strand=+; Position=164-364
FSYYIFGLINMLVACHCGSPNCVSAIFNRKITDKNLLARRGSVEILYTRELWITSINRDEFTISLIQ

SEQ ID NO: 26505 - protein, 59 aa, Diabrotica virgifera
  misc_feature: Coding regions on vcDNA: vcDNA=SeqID_6202; Strand=-; Position=1-177
  misc_feature (45)..(45): Xaa can be any naturally occurring amino acid
KYVNLFLYGYVFTGICVCVYISGAHIVGVLQFSFLCLVEFGTLVXNLERDRAPSGTRRD

SEQ ID NO: 26506 - protein, 28 aa, Diabrotica virgifera
  misc_feature: Coding regions on vcDNA: vcDNA=SeqID_6203; Strand=+; Position=1-84
  misc_feature (15)..(20): Xaa can be any naturally occurring amino acid
NLGGFLKGGAGIQNXXXXXXPFYPNPLK

SEQ ID NO: 26507 - protein, 51 aa, Diabrotica virgifera
  misc_feature: Coding regions on vcDNA: vcDNA=SeqID_6204; Strand=-; Position=134-289
EHAHDAGFSDGQRQYNELCTQKLLYYILTRPEFLGLHFQDYETHEMDQANL

SEQ ID NO: 26508 - protein, 84 aa, Diabrotica virgifera
  misc_feature: Coding regions on vcDNA: vcDNA=SeqID_6205; Strand=-; Position=1-252
  misc_feature (1)..(1): Xaa can be any naturally occurring amino acid
  misc_feature (14)..(14): Xaa can be any naturally occurring amino acid
  misc_feature (31)..(41): Xaa can be any naturally occurring amino acid
XKSWFGICAYSHSXMFPLRKYEVRRAKLLAXXXXXXXXXXXQKITLFAPEHIFLGFLGHSNKKGMLPFFSKVDRFRVKGDLKSE

SEQ ID NO: 26509 - protein, 151 aa, Diabrotica virgifera
  misc_feature: Coding regions on vcDNA: vcDNA=SeqID_6206; Strand=-; Position=0-452
  misc_feature (1)..(32): Xaa can be any naturally occurring amino acid
  misc_feature (41)..(71): Xaa can be any naturally occurring amino acid
  misc_feature (73)..(108): Xaa can be any naturally occurring amino acid
  misc_feature (112)..(121): Xaa can be any naturally occurring amino acid
  misc_feature (123)..(129): Xaa can be any naturally occurring amino acid
  misc_feature (142)..(150): Xaa can be any naturally occurring amino acid
XXXXXXXXXXXXXXXXXXXXXXXXXXXXXXXXRNFGAALFXXXXXXXXXXXXXXXXXXXXXXXXXXXXXXXVXXXXXXXXXXXXXXXXXXXXXXXXXXXXXXXXXXXXSFKXXXXXXXXXXGXXXXXXXGEKFFLGPPLKVXXXXXXXXXG

SEQ ID NO: 26510 - protein, 52 aa, Diabrotica virgifera
  misc_feature: Coding regions on vcDNA: vcDNA=SeqID_6207; Strand=+; Position=8-163
  misc_feature (1)..(1): Xaa can be any naturally occurring amino acid
  misc_feature (12)..(22): Xaa can be any naturally occurring amino acid
XGPKKKHMGLKXXXXXXXXXXXCPQICNQFHQNIELGQRPFLNCNPSGKNKI

SEQ ID NO: 26511 - protein, 178 aa, Diabrotica virgifera
  misc_feature: Coding regions on vcDNA: vcDNA=SeqID_6208; Strand=-; Position=0-533
  misc_feature (33)..(40): Xaa can be any naturally occurring amino acid
  misc_feature (43)..(50): Xaa can be any naturally occurring amino acid
  misc_feature (67)..(78): Xaa can be any naturally occurring amino acid
  misc_feature (80)..(113): Xaa can be any naturally occurring amino acid
  misc_feature (116)..(123): Xaa can be any naturally occurring amino acid
  misc_feature (125)..(143): Xaa can be any naturally occurring amino acid
  misc_feature (156)..(171): Xaa can be any naturally occurring amino acid
GGFSPPPHPPQKFPPPPNLKARGGKNPPNAGGXXXXXXXXEPXXXXXXXXKKSAPPYVPPPAHTYKXXXXXXXXXXXXKXXXXXXXXXXXXXXXXXXXXXXXXXXXXXXXXXXGGXXXXXXXXTXXXXXXXXXXXXXXXXXXXQSPPSGKKKGLSXXXXXXXXXXXXXXXXSRLALSL

SEQ ID NO: 26512 - protein, 96 aa, Diabrotica virgifera
  misc_feature: Coding regions on vcDNA: vcDNA=SeqID_6209; Strand=+; Position=3-293
  misc_feature: Homolog annotation: Hit_ID=T30319; Match level="QueryCoverage=73%, HitCoverage=5%, E-value=1e-11, Identity=46%"; Hit description=Lian -Aa1 retrotransposition protein - yellow fever mosquito gb|AAB65093.1| Lian-Aa1
  misc_feature (57)..(57): Xaa can be any naturally occurring amino acid
QAALRALEAPKMSSKLVLECKRALDDVAITNRVRLVWVPGHTGVEGNERADALARRXSSSLPVGPEPVIGVPFSTGRGSLRELLCGGSRTPGRVVR

SEQ ID NO: 26513 - protein, 79 aa, Diabrotica virgifera
  misc_feature: Coding regions on vcDNA: vcDNA=SeqID_6210; Strand=-; Position=3-239
  misc_feature (18)..(18): Xaa can be any naturally occurring amino acid
RYLSRICGHLLRKRRGYXRDLLRVFDTETHFFPAFTILSSTLFYTTLKGLTDLGKPGPGTFSPLTKVVVNLARESVDEF

SEQ ID NO: 26514 - protein, 108 aa, Diabrotica virgifera
  misc_feature: Coding regions on vcDNA: vcDNA=SeqID_6211; Strand=+; Position=3-326
GEKENKTVWGGPVHENSRKSYPSRITHWVDKARHTATKSFLKYVEEADDLLSIFENCKVDCYIELFCLSILPEYRRRGIALTLAKATEELTRQLSHGKPVKQSLDDSD

SEQ ID NO: 26515 - protein, 31 aa, Diabrotica virgifera
  misc_feature: Coding regions on vcDNA: vcDNA=SeqID_6212; Strand=-; Position=130-225
STGHRVIKLPVNCVGHFVVLIEISLQQSKFA

SEQ ID NO: 26516 - protein, 94 aa, Diabrotica virgifera
  misc_feature: Coding regions on vcDNA: vcDNA=SeqID_6213; Strand=-; Position=44-328
  misc_feature: Homolog annotation: Hit_ID=BAC10547.1; Match level="QueryCoverage =92%, HitCoverage=20%, E-value=4e-10, Identity=35%"; Hit description =acid phosphatase [Drosophila virilis]
KLYLYAAHDLTIVHILRSLNLIETLKPGFGATLIFELYANSSIKITYRNFWKDTPKEYHISQCELSCPLQKFKSLLSDMLPTDYTKECVLEQAS

SEQ ID NO: 26517 - protein, 32 aa, Diabrotica virgifera
  misc_feature: Coding regions on vcDNA: vcDNA=SeqID_6214; Strand=-; Position=140-238
  misc_feature (2)..(11): Xaa can be any naturally occurring amino acid
PXXXXXXXXXXNYFILKNRLSYINANELTLEW

SEQ ID NO: 26518 - protein, 53 aa, Diabrotica virgifera
  misc_feature: Coding regions on vcDNA: vcDNA=SeqID_6215; Strand=-; Position=100-261
IFYGISNRNIVIKEVLIQSVLLLIREILIRTGNVFLSHYPTKTSTSKYNRSFE

SEQ ID NO: 26519 - protein, 53 aa, Diabrotica virgifera
  misc_feature: Coding regions on vcDNA: vcDNA=SeqID_6216; Strand=+; Position=1-159
  misc_feature (1)..(17): Xaa can be any naturally occurring amino acid
  misc_feature (29)..(35): Xaa can be any naturally occurring amino acid
XXXXXXXXXXXXXXXXXRPKPLGGGDPLXXXXXXXLFKLGDKGQAKIPFLTLK

SEQ ID NO: 26520 - protein, 111 aa, Diabrotica virgifera
  misc_feature: Coding regions on vcDNA: vcDNA=SeqID_6217; Strand=+; Position=1-333
  misc_feature: Homolog annotation: Hit_ID=NP_725829.2; Match level="QueryCoverage =100%, HitCoverage=22%, E-value=2e-15, Identity=40%"; Hit description= CG15095-PB, isoform B [Drosophila melanogaster] ref|NP_652038.2| CG15095-PA, isoform A [Drosophila
  misc_feature: Gene Ontology Annotation: Molecular function=inorganic phosphate transporter activity; Cellular component=integral to membrane; Biological process=phosphate transport
  misc_feature (84)..(84): Xaa can be any naturally occurring amino acid
KIFNGISGIGAGTSLLVLSFLPVSAVTLSVVMLVSAVGIQSAATAGYTLNHIDLSPNFSGTLQAICNSCGSGLSILAPLSVQFXVGDDETNKLKWRIVFIVAAMMYIVPSI

SEQ ID NO: 26521 - protein, 57 aa, Diabrotica virgifera
  misc_feature: Coding regions on vcDNA: vcDNA=SeqID_6218; Strand=+; Position=132-302
  misc_feature (49)..(49): Xaa can be any naturally occurring amino acid
  misc_feature (53)..(53): Xaa can be any naturally occurring amino acid
FQLHKIKLSLAGSSDKILGIIWSPDQDTFSFKPPVCEVTSPITKRKILXYVSXLFDP

SEQ ID NO: 26522 - protein, 86 aa, Diabrotica virgifera
  misc_feature: Coding regions on vcDNA: vcDNA=SeqID_6219; Strand=-; Position=33-293
  misc_feature (6)..(13): Xaa can be any naturally occurring amino acid
  misc_feature (25)..(25): Xaa can be any naturally occurring amino acid
FNLCLXXXXXXXXKYDEYDPREASXLIQLFFPETTTNTLSLQEKTRITDKITQNCLQYLFGHCPMPGAYGMSLCILREYKNLRSIK

SEQ ID NO: 26523 - protein, 53 aa, Diabrotica virgifera
  misc_feature: Coding regions on vcDNA: vcDNA=SeqID_6220; Strand=-; Position=0-158
  misc_feature (6)..(6): Xaa can be any naturally occurring amino acid
  misc_feature (21)..(21): Xaa can be any naturally occurring amino acid
HTLLPXQYVVAISAKNRPTQXYLFIPFEKKRHFQMAIQVPCQYLEGFLVLFST

SEQ ID NO: 26524 - protein, 35 aa, Diabrotica virgifera
  misc_feature: Coding regions on vcDNA: vcDNA=SeqID_6221; Strand=-; Position=1-105
  misc_feature (16)..(22): Xaa can be any naturally occurring amino acid
  misc_feature (24)..(34): Xaa can be any naturally occurring amino acid
KTPGFKNSILRVWGFXXXXXXXPXXXXXXXXXXXE

SEQ ID NO: 26525 - protein, 74 aa, Diabrotica virgifera
  misc_feature: Coding regions on vcDNA: vcDNA=SeqID_6222; Strand=-; Position=4-228
  misc_feature (63)..(71): Xaa can be any naturally occurring amino acid
LMRQTCVGRVPGVRLCGMRSLNRSHILGLAREYPPPSAEDDIKGIDPFDHRTELVLPEPWNPXXXXXXXXXSPV

SEQ ID NO: 26526 - protein, 75 aa, Diabrotica virgifera
  misc_feature: Coding regions on vcDNA: vcDNA=SeqID_6223; Strand=+; Position=1-228
TQEVHLHQGPDIVFCASFRFSFRARVSVYVRISPVKKQMCVVMLWSLDLTSLCPCLDKQFTYRFHSEADRQKTWM

SEQ ID NO: 26527 - protein, 115 aa, Diabrotica virgifera
  misc_feature: Coding regions on vcDNA: vcDNA=SeqID_6224; Strand=+; Position=2-345
  misc_feature: Homolog annotation: Hit_ID=NP_493497.1; Match level="QueryCoverage =100%, HitCoverage=15%, E-value=2e-12, Identity=36%"; Hit description= predicted CDS, reverse transcriptase family member (1O881) [Caenorhabditis elegans]
  misc_feature (36)..(36): Xaa can be any naturally occurring amino acid
  misc_feature (95)..(95): Xaa can be any naturally occurring amino acid
LEYAFKMLNWDNKGITIDGEKLNHLRFADDIVLIMXDLGEVKEMLNELDAICWKIGLKMSFSKTKSMTNLIPSGQLIKREQDIELVEEYIYLGHXIRIGRDNETCEIKRRITLAW

SEQ ID NO: 26528 - protein, 68 aa, Diabrotica virgifera
  misc_feature: Coding regions on vcDNA: vcDNA=SeqID_6225; Strand=-; Position=44-250
  misc_feature (17)..(17): Xaa can be any naturally occurring amino acid
VHWNFIEIDTVHHTIDXFAGSHENRILYHSNPDRSNSALRQCELGQKTKEEELFRVVIVCIKQNRVRQ

SEQ ID NO: 26529 - protein, 66 aa, Diabrotica virgifera
  misc_feature: Coding regions on vcDNA: vcDNA=SeqID_6226; Strand=+; Position=104-301
  misc_feature (25)..(25): Xaa can be any naturally occurring amino acid
  misc_feature (28)..(30): Xaa can be any naturally occurring amino acid
  misc_feature (58)..(58): Xaa can be any naturally occurring amino acid
IKNTLHENANTETIHTTNSEIVEYXVKXXXMDFCQAQNTHQYTQGFKQEYEYYHQPLXMFHVRIIL

SEQ ID NO: 26530 - protein, 58 aa, Diabrotica virgifera
  misc_feature: Coding regions on vcDNA: vcDNA=SeqID_6227; Strand=+; Position=59-235
  misc_feature (30)..(37): Xaa can be any naturally occurring amino acid
TGKCHFIPGVTIILCFFLKVRNTLWNILAXXXXXXXXSIVDLGFLNIFFFDSFAYVGK

SEQ ID NO: 26531 - protein, 22 aa, Diabrotica virgifera
  misc_feature: Coding regions on vcDNA: vcDNA=SeqID_6228; Strand=-; Position=2-67
KPKSGSLETFAPNMFFELWLPF

SEQ ID NO: 26532 - protein, 61 aa, Diabrotica virgifera
  misc_feature: Coding regions on vcDNA: vcDNA=SeqID_6229; Strand=+; Position=2-184
  misc_feature (1)..(15): Xaa can be any naturally occurring amino acid
XXXXXXXXXXXXXXXHWDQPSGPSSRDDFSIMGGSSTALGGSRIFSWDSGHPLTRSVIGSP

SEQ ID NO: 26533 - protein, 80 aa, Diabrotica virgifera
  misc_feature: Coding regions on vcDNA: vcDNA=SeqID_6230; Strand=-; Position=1-240
  misc_feature: Homolog annotation: Hit_ID=BAA32395.1; Match level="QueryCoverage =100%, HitCoverage=12%, E-value=2e-38, Identity=98%"; Hit description= heat shock 70 kD protein cognate [Bombyx mori]
  misc_feature: Gene Ontology Annotation: Molecular function=ATP binding; Cellular component=endoplasmic reticulum lumen; Biological process=cell organization and biogenesis
KMKETAEAYLGKKVTHAVVTVPAYFNDAQRQATKDAGTIAGLNVMRIINEPTAAAIAYGLDKKEGEKNVLVFDLGGGTFD

SEQ ID NO: 26534 - protein, 76 aa, Diabrotica virgifera
  misc_feature: Coding regions on vcDNA: vcDNA=SeqID_6231; Strand=-; Position=2-229
SKRTYILSVGRYGIFKSAGRCFIWHRQIASVEIVKNNHAVIRRLIDIVIFLSCQELSFSGHDGSKHLLKRETSSLS

SEQ ID NO: 26535 - protein, 76 aa, Diabrotica virgifera
  misc_feature: Coding regions on vcDNA: vcDNA=SeqID_6232; Strand=-; Position=0-227
  misc_feature (45)..(50): Xaa can be any naturally occurring amino acid
  misc_feature (52)..(68): Xaa can be any naturally occurring amino acid
FKLWRKGRGPGGRKGGGYVIRRRRKGVWFIWIELIGGRLNLVWNXXXXXXGXXXXXXXXXXXXXXXXXRLVLSLSL

SEQ ID NO: 26536 - protein, 63 aa, Diabrotica virgifera
  misc_feature: Coding regions on vcDNA: vcDNA=SeqID_6233; Strand=-; Position=55-246
ITLMGKGSRKEVGTKCLHVVGAGAALDRLSCGTFESPAAVSGDHPEHSRWTLGPCLDSLVVLP

SEQ ID NO: 26537 - protein, 64 aa, Diabrotica virgifera
  misc_feature: Coding regions on vcDNA: vcDNA=SeqID_6234; Strand=+; Position=3-194
  misc_feature (34)..(63): Xaa can be any naturally occurring amino acid
HFELCGSQMYRCYIWLNVTKIFFKHCIIISLMVXXXXXXXXXXXXXXXXXXXXXXXXXXXXXXS

SEQ ID NO: 26538 - protein, 98 aa, Diabrotica virgifera
  misc_feature: Coding regions on vcDNA: vcDNA=SeqID_6235; Strand=+; Position=1-294
VADSRINSCPIQWYVLADRDISATHICYDHDDEDVSDYPTYWHNLYVAGYYYTTVWHLFLILRYYGASVIDLILPQWTGRICALTVHTVLSTGPIVDR

SEQ ID NO: 26539 - protein, 72 aa, Diabrotica virgifera
  misc_feature: Coding regions on vcDNA: vcDNA=SeqID_6236; Strand=-; Position=57-275
  misc_feature (11)..(11): Xaa can be any naturally occurring amino acid
CILHDLQENLXSVHGNPKLSNQCKHCQICAHHSPRYFPFDQDCIHVGRHPRLSLSFIYLLELLDTPIHSHLQ

SEQ ID NO: 26540 - protein, 71 aa, Diabrotica virgifera
  misc_feature: Coding regions on vcDNA: vcDNA=SeqID_6237; Strand=+; Position=3-218
TVSSVYLIVFIRISLIFAPRYELCSASLNILSEYKLNNSGDSTQLYLTPETYLGFDTLLKTFFGKIVAYSH

SEQ ID NO: 26541 - protein, 63 aa, Diabrotica virgifera
  misc_feature: Coding regions on vcDNA: vcDNA=SeqID_6238; Strand=+; Position=3-191
  misc_feature (26)..(26): Xaa can be any naturally occurring amino acid
PVLLSPSDTPHAPSIDWRNHRSGLPXSVHTCPPCSQCLRPLSSGICSMGTLWFWIAWTLLWAR

SEQ ID NO: 26542 - protein, 71 aa, Diabrotica virgifera
  misc_feature: Coding regions on vcDNA: vcDNA=SeqID_6239; Strand=+; Position=106-318
  misc_feature (52)..(52): Xaa can be any naturally occurring amino acid
  misc_feature (64)..(64): Xaa can be any naturally occurring amino acid
ENTRTCSDRGRSTINSIHTVEHISQESREYDREMHLIFMDGKSACETANRRXMMEHLQNVGIAXKLRHVLT

SEQ ID NO: 26543 - protein, 67 aa, Diabrotica virgifera
  misc_feature: Coding regions on vcDNA: vcDNA=SeqID_6240; Strand=+; Position=2-205
  misc_feature (20)..(26): Xaa can be any naturally occurring amino acid
  misc_feature (65)..(65): Xaa can be any naturally occurring amino acid
SCRYSPISVLFFIDLRVFDXXXXXXXHLSDTVYDHLIIQTTSSTRLYFDGHDTMTNTSFIHGICXTF

SEQ ID NO: 26544 - protein, 41 aa, Diabrotica virgifera
  misc_feature: Coding regions on vcDNA: vcDNA=SeqID_6241; Strand=+; Position=193-318
TGAVRKTSRYRQFLRLLMNTTKRNGIYTYFTECSLFYSINN

SEQ ID NO: 26545 - protein, 47 aa, Diabrotica virgifera
  misc_feature: Coding regions on vcDNA: vcDNA=SeqID_6242; Strand=-; Position=18-161
FLSHHREAVFLDEFRGRTSPRRALVEVQLKKRKNNQYFVLVVLVLTT

SEQ ID NO: 26546 - protein, 85 aa, Diabrotica virgifera
  misc_feature: Coding regions on vcDNA: vcDNA=SeqID_6243; Strand=+; Position=2-259
  misc_feature (72)..(72): Xaa can be any naturally occurring amino acid
NHKVEGTYIKLRIPEENFLENLINCYQILDLTGSSCKPQITEGGYSHNFMELLLENAKGEMMQYEIQVYTTXPTTENPTTMWNVL

SEQ ID NO: 26547 - protein, 25 aa, Diabrotica virgifera
  misc_feature: Coding regions on vcDNA: vcDNA=SeqID_6244; Strand=+; Position=1-78
LGWTRESLSSLGAKYALSILKSILF

SEQ ID NO: 26548 - protein, 52 aa, Diabrotica virgifera
  misc_feature: Coding regions on vcDNA: vcDNA=SeqID_6245; Strand=+; Position=207-365
  misc_feature (12)..(34): Xaa can be any naturally occurring amino acid
  misc_feature (42)..(42): Xaa can be any naturally occurring amino acid
  misc_feature (52)..(52): Xaa can be any naturally occurring amino acid
NCNKVVLATCKXXXXXXXXXXXXXXXXXXXXXXXVDFFTLLXNYLLFRIIYX

SEQ ID NO: 26549 - protein, 57 aa, Diabrotica virgifera
  misc_feature: Coding regions on vcDNA: vcDNA=SeqID_6246; Strand=-; Position=3-176
  misc_feature (10)..(26): Xaa can be any naturally occurring amino acid
ITTRPPRTGXXXXXXXXXXXXXXXXXHSMTYLLCIFKLLPLILHDYYQSQIRCRTFQ

SEQ ID NO: 26550 - protein, 95 aa, Diabrotica virgifera
  misc_feature: Coding regions on vcDNA: vcDNA=SeqID_6247; Strand=+; Position=1-288
  misc_feature: Homolog annotation: Hit_ID=NP_610332.3; Match level="QueryCoverage =94%, HitCoverage=18%, E-value=7e-15, Identity=41%"; Hit description =CG8791-PA [Drosophila melanogaster] gb|AAF59171.3| CG8791-PA [Drosophila melanogaster]
  misc_feature: Gene Ontology Annotation: Molecular function=sodium-dependent phosphate transporter activity; Cellular component=integral to membrane; Biological process=phosphate transport
KNYAILSIILVSGCQGAGKSGFIVNHMDLAPNFSGAMMGISNGLSVALSSFAPVLAQIIVKDEHNINQWRFIFYFTMGLNLLGVISNTLFTSGKR

SEQ ID NO: 26551 - protein, 31 aa, Diabrotica virgifera
  misc_feature: Coding regions on vcDNA: vcDNA=SeqID_6248; Strand=+; Position=3-98
KRTLQVQLVTLGRKSRARAQHINYLAIDVEF

SEQ ID NO: 26552 - protein, 58 aa, Diabrotica virgifera
  misc_feature: Coding regions on vcDNA: vcDNA=SeqID_6249; Strand=+; Position=2-175
  misc_feature (10)..(17): Xaa can be any naturally occurring amino acid
  misc_feature (20)..(31): Xaa can be any naturally occurring amino acid
  misc_feature (58)..(58): Xaa can be any naturally occurring amino acid
TNANLSAFEXXXXXXXXHNXXXXXXXXXXXXAVFQENLRKIDAHNAKYEKGEDTYYMX

SEQ ID NO: 26553 - protein, 47 aa, Diabrotica virgifera
  misc_feature: Coding regions on vcDNA: vcDNA=SeqID_6250; Strand=+; Position=2-145
  misc_feature (5)..(13): Xaa can be any naturally occurring amino acid
  misc_feature (22)..(38): Xaa can be any naturally occurring amino acid
NDNLXXXXXXXXXKNRQYCLYXXXXXXXXXXXXXXXXXLKGVTPLLA

SEQ ID NO: 26554 - protein, 47 aa, Diabrotica virgifera
  misc_feature: Coding regions on vcDNA: vcDNA=SeqID_6251; Strand=-; Position=132-275
  misc_feature (2)..(19): Xaa can be any naturally occurring amino acid
  misc_feature (29)..(29): Xaa can be any naturally occurring amino acid
  misc_feature (40)..(46): Xaa can be any naturally occurring amino acid
TXXXXXXXXXXXXXXXXXXPTMPNITIPXNFSNIFIKTVXXXXXXXK

SEQ ID NO: 26555 - protein, 43 aa, Diabrotica virgifera
  misc_feature: Coding regions on vcDNA: vcDNA=SeqID_6252; Strand=-; Position=2-130
SVFTKHTCSDYTLTAIEQNKGDILIKILLHMIYVNCYILFWIL

SEQ ID NO: 26556 - protein, 46 aa, Diabrotica virgifera
  misc_feature: Coding regions on vcDNA: vcDNA=SeqID_6253; Strand=-; Position=22-162
QSFIMQENYTARKMSSLVFSGMSRDTLFSRIDLNFGQCVRSIDFAK

SEQ ID NO: 26557 - protein, 76 aa, Diabrotica virgifera
  misc_feature: Coding regions on vcDNA: vcDNA=SeqID_6254; Strand=-; Position=3-230
  misc_feature (6)..(6): Xaa can be any naturally occurring amino acid
  misc_feature (19)..(24): Xaa can be any naturally occurring amino acid
  misc_feature (38)..(44): Xaa can be any naturally occurring amino acid
RVSAHXQNTWELDSFLPQXXXXXXPNIHPNIAGSTFFXXXXXXXHTPLRKVPVSPLVLASSSLIMSCSTVVFLLSL

SEQ ID NO: 26558 - protein, 28 aa, Diabrotica virgifera
  misc_feature: Coding regions on vcDNA: vcDNA=SeqID_6255; Strand=-; Position=3-86
FLRHTECTPLNSIAENANSIKIILSADF

SEQ ID NO: 26559 - protein, 32 aa, Diabrotica virgifera
  misc_feature: Coding regions on vcDNA: vcDNA=SeqID_6256; Strand=-; Position=1-96
DRHIWETAVIYSDDGSTELNHVLGTLIRNWRE

SEQ ID NO: 26560 - protein, 40 aa, Diabrotica virgifera
  misc_feature: Coding regions on vcDNA: vcDNA=SeqID_6257; Strand=-; Position=1-120
DHFNCFTLSGNVKIYKFICMCHFRKLNLSPNLFKKLERHE

SEQ ID NO: 26561 - protein, 47 aa, Diabrotica virgifera
  misc_feature: Coding regions on vcDNA: vcDNA=SeqID_6258; Strand=-; Position=0-140
KGFIFGMEHVNNSRVVQDFWQGVKSKEKQRKEAKEKNIKVELRRQPA

SEQ ID NO: 26562 - protein, 25 aa, Diabrotica virgifera
  misc_feature: Coding regions on vcDNA: vcDNA=SeqID_6259; Strand=+; Position=2-76
YNFNPFSTTLNSYTNYFPSWPFMPP

SEQ ID NO: 26563 - protein, 44 aa, Diabrotica virgifera
  misc_feature: Coding regions on vcDNA: vcDNA=SeqID_6260; Strand=+; Position=3-137
  misc_feature (2)..(16): Xaa can be any naturally occurring amino acid
EXXXXXXXXXXXXXXXSYIYSVKSWFININYSNFHTLTLKTFPQ

SEQ ID NO: 26564 - protein, 43 aa, Diabrotica virgifera
  misc_feature: Coding regions on vcDNA: vcDNA=SeqID_6261; Strand=+; Position=2-130
KYVKAKMGRSTAKVLPLLLKPTLPPKSFPPKFSQFQNPYFPIG

SEQ ID NO: 26565 - protein, 42 aa, Diabrotica virgifera
  misc_feature: Coding regions on vcDNA: vcDNA=SeqID_6262; Strand=-; Position=2-127
  misc_feature (25)..(40): Xaa can be any naturally occurring amino acid
RRKIKWEKQLTFIIKFIQKVPKIFXXXXXXXXXXXXXXXXRD

SEQ ID NO: 26566 - protein, 38 aa, Diabrotica virgifera
  misc_feature: Coding regions on vcDNA: vcDNA=SeqID_6263; Strand=-; Position=1-114
NGLTLSGEFKIYKFICMCHFRKLNFSPNLFKKPPQLRF

SEQ ID NO: 26567 - protein, 61 aa, Diabrotica virgifera
  misc_feature: Coding regions on vcDNA: vcDNA=SeqID_6264; Strand=-; Position=0-182
  misc_feature (3)..(17): Xaa can be any naturally occurring amino acid
PLXXXXXXXXXXXXXXXHVFIKKIQLDIWFSLTFVHVYAHFSYCSEVSYSINIFDVLFISA

SEQ ID NO: 26568 - protein, 49 aa, Diabrotica virgifera
  misc_feature: Coding regions on vcDNA: vcDNA=SeqID_6265; Strand=+; Position=2-148
  misc_feature: Homolog annotation: Hit_ID=AAR09680.1; Match level="QueryCoverage =100%, HitCoverage=29%, E-value=3e-14, Identity=77%"; Hit description= similar to Drosophila melanogaster Ip259 [Drosophila yakuba]
  misc_feature (39)..(39): Xaa can be any naturally occurring amino acid
PIPKVRAQADAEVLKVVKSGKTKRIAWMIMVTKVTFVGXRFTMNPPKFE

SEQ ID NO: 26569 - protein, 91 aa, Diabrotica virgifera
  misc_feature: Coding regions on vcDNA: vcDNA=SeqID_6266; Strand=-; Position=2-274
LNTKYWEVIPKYPDSIRSDDIARNMSTVCLWSTRVINSFSTTFFITKNYARCEQRICIKLQKRYAKYAHTIQTMENPLFMNMSKTAKKLVS

SEQ ID NO: 26570 - protein, 69 aa, Diabrotica virgifera
  misc_feature: Coding regions on vcDNA: vcDNA=SeqID_6267; Strand=+; Position=1-210
  misc_feature (8)..(20): Xaa can be any naturally occurring amino acid
  misc_feature (46)..(53): Xaa can be any naturally occurring amino acid
LVSSFLIXXXXXXXXXXXXXFHVKLFLYLSKFNLQIANNARQVISXXXXXXXXILQYYYLIDTKHIRII

SEQ ID NO: 26571 - protein, 34 aa, Diabrotica virgifera
  misc_feature: Coding regions on vcDNA: vcDNA=SeqID_6268; Strand=+; Position=1-102
  misc_feature (15)..(24): Xaa can be any naturally occurring amino acid
YIRSVRYKFLSFSYXXXXXXXXXXNSASNLVCVN

SEQ ID NO: 26572 - protein, 59 aa, Diabrotica virgifera
  misc_feature: Coding regions on vcDNA: vcDNA=SeqID_6269; Strand=-; Position=2-178
  misc_feature (52)..(56): Xaa can be any naturally occurring amino acid
KKNYKCYKVLWSFRVSFKRSRRKRKFRNRGIFKELVNFSAELDNDLKVHSIXXXXXFKG

SEQ ID NO: 26573 - protein, 86 aa, Diabrotica virgifera
  misc_feature: Coding regions on vcDNA: vcDNA=SeqID_6270; Strand=+; Position=24-281
  misc_feature: Homolog annotation: Hit_ID=AAH70776.1; Match level="QueryCoverage =70%, HitCoverage=10%, E-value=9e-12, Identity=47%"; Hit description =LOC431861 protein [Xenopus laevis]
  misc_feature: Gene Ontology Annotation: Molecular function=fructose-26-bisphosphate 2-phosphatase activity; Cellular component=cellular_component unknown; Biological process=fructose 26-bisphosphate metabolism
  misc_feature (38)..(38): Xaa can be any naturally occurring amino acid
MDLKNRFCRAGAQAPKTKLLRQFGPLLVAMVGLPGRGXSLLATRLSKYLNFTGDNTKVYDISEYRRKHIKQYGSHEMFRADNLPAW

SEQ ID NO: 26574 - protein, 57 aa, Diabrotica virgifera
  misc_feature: Coding regions on vcDNA: vcDNA=SeqID_6271; Strand=-; Position=18-191
PAENVLISRRCVAGQTLIYVNRCSCNCDTAYKFRTLTTKTSHVLCQTELSIDLLPFY

SEQ ID NO: 26575 - protein, 60 aa, Diabrotica virgifera
  misc_feature: Coding regions on vcDNA: vcDNA=SeqID_6272; Strand=-; Position=2-181
FGKGRHRYPSSFYLPNVYWNIRFIKSEFDEKVALVNIEVELGSFSILVVEVIVDDAGSVV

SEQ ID NO: 26576 - protein, 53 aa, Diabrotica virgifera
  misc_feature: Coding regions on vcDNA: vcDNA=SeqID_6273; Strand=+; Position=62-220
MIAILFALRHIFSNEPYRCIIFTDSKSVVDRLTNVHKYQQLILIELEIMTLYK

SEQ ID NO: 26577 - protein, 45 aa, Diabrotica virgifera
  misc_feature: Coding regions on vcDNA: vcDNA=SeqID_6274; Strand=-; Position=1-135
  misc_feature (38)..(44): Xaa can be any naturally occurring amino acid
IKPSYNYLIITKCSPNFSSFYNSHSSQPSNQRYPSKVXXXXXXXH

SEQ ID NO: 26578 - protein, 66 aa, Diabrotica virgifera
  misc_feature: Coding regions on vcDNA: vcDNA=SeqID_6275; Strand=-; Position=74-274
  misc_feature (10)..(10): Xaa can be any naturally occurring amino acid
  misc_feature (31)..(31): Xaa can be any naturally occurring amino acid
KKSTCCLLYXQSCNILKNDFFLRKLDCKINXAKSVKPILIKFTVLFYYIIEFFWVKYEGPLCSKNG

SEQ ID NO: 26579 - protein, 71 aa, Diabrotica virgifera
  misc_feature: Coding regions on vcDNA: vcDNA=SeqID_6276; Strand=-; Position=0-212
  misc_feature (4)..(4): Xaa can be any naturally occurring amino acid
  misc_feature (14)..(23): Xaa can be any naturally occurring amino acid
  misc_feature (32)..(32): Xaa can be any naturally occurring amino acid
  misc_feature (34)..(41): Xaa can be any naturally occurring amino acid
  misc_feature (52)..(62): Xaa can be any naturally occurring amino acid
PIPXYVGFFSKSGXXXXXXXXXXTARGAADTXYXXXXXXXXWTILEIKSSRXXXXXXXXXXXPQTTSLRVA

SEQ ID NO: 26580 - protein, 66 aa, Diabrotica virgifera
  misc_feature: Coding regions on vcDNA: vcDNA=SeqID_6277; Strand=+; Position=1-198
  misc_feature: Homolog annotation: Hit_ID=CAD50590.1; Match level="QueryCoverage =100%, HitCoverage=52%, E-value=9e-15, Identity=57%"; Hit description= LacZ alpha protein [Cloning vector pUvBBAC]
  misc_feature (16)..(16): Xaa can be any naturally occurring amino acid
  misc_feature (41)..(41): Xaa can be any naturally occurring amino acid
ESYYNTVAVVTQCREXENPGVTHLTRRATYPPLAMWCNREXARTYRPSQLSRTQNGEWHIVRVHIV

SEQ ID NO: 26581 - protein, 70 aa, Diabrotica virgifera
  misc_feature: Coding regions on vcDNA: vcDNA=SeqID_6278; Strand=+; Position=54-263
TLAITRSDLPGKYLKTPFHWQPPLYSDYQLTITHLHGCRYEFFAGHQYHSLSTKGRFTSSTKSILSLVLP

SEQ ID NO: 26582 - protein, 95 aa, Diabrotica virgifera
  misc_feature: Coding regions on vcDNA: vcDNA=SeqID_6279; Strand=+; Position=2-286
LVPISALTRADFGPKITICLDLVFWHLYRDRSMCMCSPNMSVVDSSYIYRAIYVNYAMPVGVHWIVFFNNKSFWYSCEISAIPFDFGSIHFDYDL

SEQ ID NO: 26583 - protein, 59 aa, Diabrotica virgifera
  misc_feature: Coding regions on vcDNA: vcDNA=SeqID_6280; Strand=-; Position=0-176
PRARTRGRISCGSPCTQDSHVIRTLLIESPSSLSECYRGEVDGLEHWSGVEIPELEIPR

SEQ ID NO: 26584 - protein, 29 aa, Diabrotica virgifera
  misc_feature: Coding regions on vcDNA: vcDNA=SeqID_6281; Strand=+; Position=1-90
LESAAQRKLKLLLKNIVDCCYFLMKSKSC

SEQ ID NO: 26585 - protein, 20 aa, Diabrotica virgifera
  misc_feature: Coding regions on vcDNA: vcDNA=SeqID_6282; Strand=-; Position=2-61
MLKPISPAHAHYNFVLIGCS

SEQ ID NO: 26586 - protein, 57 aa, Diabrotica virgifera
  misc_feature: Coding regions on vcDNA: vcDNA=SeqID_6283; Strand=+; Position=2-172
ARSHADSGVSSNLFVLYESRLVSAQHVLSRSHNRVVFLPLCLIGSIILVSNSAPGGA

SEQ ID NO: 26587 - protein, 34 aa, Diabrotica virgifera
  misc_feature: Coding regions on vcDNA: vcDNA=SeqID_6284; Strand=-; Position=16-120
GILSKNLLKTLEQYFTNTENIIIIQSLLKLLDAS

SEQ ID NO: 26588 - protein, 123 aa, Diabrotica virgifera
  misc_feature: Coding regions on vcDNA: vcDNA=SeqID_6285; Strand=-; Position=1-369
  misc_feature: Homolog annotation: Hit_ID=XP_375646.1; Match level="QueryCoverage =98%, HitCoverage=67%, E-value=1e-28, Identity=39%"; Hit description =PREDICTED: zinc finger protein 525 [Homo sapiens]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=65.4, E-value =1.6e-16, Copies=4"; Pfam description=Zinc finger, C2H2 type
  misc_feature (10)..(10): Xaa can be any naturally occurring amino acid
  misc_feature (32)..(32): Xaa can be any naturally occurring amino acid
  misc_feature (34)..(34): Xaa can be any naturally occurring amino acid
  misc_feature (54)..(54): Xaa can be any naturally occurring amino acid
  misc_feature (97)..(97): Xaa can be any naturally occurring amino acid
VCGKDFNYAXALTYHMRLHTGEKNTHCEYCPXRXRMINSFNRHVRTHTGEKPYXCQYCGRQFSSKGEVVCHEYIHTGYRPYHCSYCKKGFSKTHNLXIHLLSHRGPHQCTFCNRNFIELEILN

SEQ ID NO: 26589 - protein, 76 aa, Diabrotica virgifera
  misc_feature: Coding regions on vcDNA: vcDNA=SeqID_6286; Strand=-; Position=2-229
  misc_feature (25)..(25): Xaa can be any naturally occurring amino acid
SARGTSANMFQLHVYFSEHTFWDGXKKEDSNIIDYFLTEPVWEMPDMKEALTQDVIDNVTTKITNSVAVLKQVVPN

SEQ ID NO: 26590 - protein, 100 aa, Diabrotica virgifera
  misc_feature: Coding regions on vcDNA: vcDNA=SeqID_6287; Strand=+; Position=1-300
  misc_feature: Homolog annotation: Hit_ID=EAA12210.3; Match level="QueryCoverage =80%, HitCoverage=7%, E-value=5e-32, Identity=82%"; Hit description =ENSANGP00000006566 [Anopheles gambiae str. PEST] ref|XP_554931.1| ENSANGP00000006566 [Anopheles gambiae str
  misc_feature: Pfam annotation: Pfam_ID=TPR_1; Match level="Score=22.4, E-value =0.0014, Copies=1"; Pfam description=Tetratricopeptide repeat
  misc_feature (71)..(71): Xaa can be any naturally occurring amino acid
AYRNSVEKSEGNADTWCSIGVLYQQQNQPMDALQAYICAVQLDKCHSAAWANLGILYEHSLQARDAYACYXNSSRGTIYKQTNDGSVNTNKLPKINFPNG

SEQ ID NO: 26591 - protein, 49 aa, Diabrotica virgifera
  misc_feature: Coding regions on vcDNA: vcDNA=SeqID_6288; Strand=+; Position=16-165
MERAEGDLCPSVDASGLIMMIKNVTVDILCLIKIEVTIYFQISQYTILR

SEQ ID NO: 26592 - protein, 34 aa, Diabrotica virgifera
  misc_feature: Coding regions on vcDNA: vcDNA=SeqID_6289; Strand=-; Position=4-108
  misc_feature (25)..(32): Xaa can be any naturally occurring amino acid
KNAMFIHFKKNVNKSLESPNSYLFXXXXXXXXRD

SEQ ID NO: 26593 - protein, 61 aa, Diabrotica virgifera
  misc_feature: Coding regions on vcDNA: vcDNA=SeqID_6290; Strand=+; Position=2-187
  misc_feature (48)..(48): Xaa can be any naturally occurring amino acid
FVGADRTRGYGTDVNAGLKYNFLQKKNWNGDISGQYGKHFGWPGGTGXPQTGVFLNLNGKS

SEQ ID NO: 26594 - protein, 57 aa, Diabrotica virgifera
  misc_feature: Coding regions on vcDNA: vcDNA=SeqID_6291; Strand=+; Position=3-176
DERHKKNHVGIRIFVDANNYEHIVIIIIRIELTLDASLYNAIACDLAHPVFSYTGCA

SEQ ID NO: 26595 - protein, 59 aa, Diabrotica virgifera
  misc_feature: Coding regions on vcDNA: vcDNA=SeqID_6292; Strand=-; Position=1-177
  misc_feature (2)..(11): Xaa can be any naturally occurring amino acid
  misc_feature (13)..(41): Xaa can be any naturally occurring amino acid
KXXXXXXXXXXLXXXXXXXXXXXXXXXXXXXXXXXXXXXXXTASTNNNSTFISRHRKRN

SEQ ID NO: 26596 - protein, 52 aa, Diabrotica virgifera
  misc_feature: Coding regions on vcDNA: vcDNA=SeqID_6293; Strand=+; Position=16-174
FKYISFYLYHSQINCFTVNIVPLGKGANLAPFIEFQNKFGKPILFNYPTQNN

SEQ ID NO: 26597 - protein, 28 aa, Diabrotica virgifera
  misc_feature: Coding regions on vcDNA: vcDNA=SeqID_6294; Strand=+; Position=38-121
  misc_feature (28)..(28): Xaa can be any naturally occurring amino acid
LNKHFSYPNTFIRSLIFDKKVKMSSQIX

SEQ ID NO: 26598 - protein, 74 aa, Diabrotica virgifera
  misc_feature: Coding regions on vcDNA: vcDNA=SeqID_6295; Strand=-; Position=1-222
  misc_feature (27)..(33): Xaa can be any naturally occurring amino acid
  misc_feature (42)..(74): Xaa can be any naturally occurring amino acid
MGCTHTHLCLAELRNKNFSGKTPGTPXXXXXXXSKGFALEGXXXXXXXXXXXXXXXXXXXXXXXXXXXXXXXXX

SEQ ID NO: 26599 - protein, 49 aa, Diabrotica virgifera
  misc_feature: Coding regions on vcDNA: vcDNA=SeqID_6296; Strand=-; Position=48-197
  misc_feature (5)..(21): Xaa can be any naturally occurring amino acid
EKDMXXXXXXXXXXXXXXXXXSKSFVNHNLIDLVSNYTLGAVRWGFPCI

SEQ ID NO: 26600 - protein, 45 aa, Diabrotica virgifera
  misc_feature: Coding regions on vcDNA: vcDNA=SeqID_6297; Strand=-; Position=2-136
HIDSKRDTGPYCRTHTGLLRSNGRATLSMNKDNSISTFICAGADS

SEQ ID NO: 26601 - protein, 99 aa, Diabrotica virgifera
  misc_feature: Coding regions on vcDNA: vcDNA=SeqID_6298; Strand=-; Position=3-299
  misc_feature (3)..(49): Xaa can be any naturally occurring amino acid
GRXXXXXXXXXXXXXXXXXXXXXXXXXXXXXXXXXXXXXXXXXXXXXXXRLVKVYFITTSQDQIILLSSPNLILSEARSFNAFGKALCSAVFISCRFGT

SEQ ID NO: 26602 - protein, 30 aa, Diabrotica virgifera
  misc_feature: Coding regions on vcDNA: vcDNA=SeqID_6299; Strand=+; Position=3-92
NQNTSIFNKKVCTLPVTFLNYQSGGLRKRE

SEQ ID NO: 26603 - protein, 28 aa, Diabrotica virgifera
  misc_feature: Coding regions on vcDNA: vcDNA=SeqID_6300; Strand=+; Position=1-84
QLGYSNLQGVNNQGVYQADVLASSICRV

SEQ ID NO: 26604 - protein, 62 aa, Diabrotica virgifera
  misc_feature: Coding regions on vcDNA: vcDNA=SeqID_6301; Strand=+; Position=3-191
PICLQVYHHYDYCHPLSRSMAADSTRVPPCLRIILHTTVILLRLASIGYVYMQGGYLHFLLR

SEQ ID NO: 26605 - protein, 47 aa, Diabrotica virgifera
  misc_feature: Coding regions on vcDNA: vcDNA=SeqID_6302; Strand=+; Position=1-144
LVQNSTSILSTRSYLQFRLFLFLTSRALCTHVRPSKDLVHRPGSIPV

SEQ ID NO: 26606 - protein, 62 aa, Diabrotica virgifera
  misc_feature: Coding regions on vcDNA: vcDNA=SeqID_6303; Strand=+; Position=1-186
ESDTNVSKDIEEPISIDNEKVSEAVKTKEIKETDVEAVTDQKNVVLLETVDEVHAESLLKNL

SEQ ID NO: 26607 - protein, 30 aa, Diabrotica virgifera
  misc_feature: Coding regions on vcDNA: vcDNA=SeqID_6304; Strand=-; Position=1-90
TLLGNRSSLRLSHEPLFPSKDLVYWQGSIP

SEQ ID NO: 26608 - protein, 54 aa, Diabrotica virgifera
  misc_feature: Coding regions on vcDNA: vcDNA=SeqID_6305; Strand=+; Position=2-163
  misc_feature (33)..(33): Xaa can be any naturally occurring amino acid
QPEISCLLRLSLVTHNVTAFSSPTGRHVTVRLXCNLNLVGSLRSQIDLPKSPYN

SEQ ID NO: 26609 - protein, 70 aa, Diabrotica virgifera
  misc_feature: Coding regions on vcDNA: vcDNA=SeqID_6306; Strand=-; Position=125-337
  misc_feature (1)..(10): Xaa can be any naturally occurring amino acid
  misc_feature (13)..(26): Xaa can be any naturally occurring amino acid
XXXXXXXXXXGGXXXXXXXXXXXXXXSLTHSREHTKFLLRYLITYIDTHIHVDLKFIIGLAPIFLCLFDF

SEQ ID NO: 26610 - protein, 37 aa, Diabrotica virgifera
  misc_feature: Coding regions on vcDNA: vcDNA=SeqID_6307; Strand=-; Position=7-120
IINIYLLINNNIFKCYTEFEKKFYNYLCYLAIKYTAL

SEQ ID NO: 26611 - protein, 46 aa, Diabrotica virgifera
  misc_feature: Coding regions on vcDNA: vcDNA=SeqID_6308; Strand=+; Position=95-232
  misc_feature (9)..(9): Xaa can be any naturally occurring amino acid
TTKIQRDLXFLGLLAMNGIQTLLYFLVVEFRVFVYYCVAKTQHTHT

SEQ ID NO: 26612 - protein, 41 aa, Diabrotica virgifera
  misc_feature: Coding regions on vcDNA: vcDNA=SeqID_6309; Strand=+; Position=3-128
  misc_feature (35)..(35): Xaa can be any naturally occurring amino acid
  misc_feature (38)..(38): Xaa can be any naturally occurring amino acid
  misc_feature (40)..(40): Xaa can be any naturally occurring amino acid
MISLLITELSFVNIFLLSFFSITLLIILGILSVFXRIXKXM

SEQ ID NO: 26613 - protein, 34 aa, Diabrotica virgifera
  misc_feature: Coding regions on vcDNA: vcDNA=SeqID_6310; Strand=-; Position=2-103
VIEHLHFFIQITRINNKRNKLTQHSLTSHFNQMY

SEQ ID NO: 26614 - protein, 82 aa, Diabrotica virgifera
  misc_feature: Coding regions on vcDNA: vcDNA=SeqID_6311; Strand=+; Position=1-249
  misc_feature (43)..(43): Xaa can be any naturally occurring amino acid
  misc_feature (47)..(47): Xaa can be any naturally occurring amino acid
  misc_feature (56)..(56): Xaa can be any naturally occurring amino acid
  misc_feature (60)..(60): Xaa can be any naturally occurring amino acid
LYVYFHPILCIFLFQFPHHRTEVIFVLCDHFLRTFFSMVSGFXYRNXLNRVWDVDXPCIXHFVVLNGLHIIFPILIATVLFL

SEQ ID NO: 26615 - protein, 31 aa, Diabrotica virgifera
  misc_feature: Coding regions on vcDNA: vcDNA=SeqID_6312; Strand=+; Position=2-97
HKNVCGKLNTKLYHACIKNCFICNLLLKCLL

SEQ ID NO: 26616 - protein, 117 aa, Diabrotica virgifera
  misc_feature: Coding regions on vcDNA: vcDNA=SeqID_6313; Strand=+; Position=1-354
  misc_feature (104)..(104): Xaa can be any naturally occurring amino acid
  misc_feature (107)..(107): Xaa can be any naturally occurring amino acid
NMVKYLVIGIFISFSFILNKYVYCANIPICLNPKEQGTLVADLQIEKNMFDSIYVRIPESGFLDAAISCIKIYDIGNSFAVPVINDGGLGFAYVEISIEHRILXELXYRIQVFKEYH

SEQ ID NO: 26617 - protein, 19 aa, Diabrotica virgifera
  misc_feature: Coding regions on vcDNA: vcDNA=SeqID_6314; Strand=-; Position=0-56
MIKFGHLSETSTTPKRHRA

SEQ ID NO: 26618 - protein, 43 aa, Diabrotica virgifera
  misc_feature: Coding regions on vcDNA: vcDNA=SeqID_6315; Strand=-; Position=45-176
GEFFQHGPKKYSQKKETPPYKVKRPKAPPSVAPLKVLRAPGKK

SEQ ID NO: 26619 - protein, 50 aa, Diabrotica virgifera
  misc_feature: Coding regions on vcDNA: vcDNA=SeqID_6316; Strand=-; Position=2-151
VVIQLPIQKYLKAISSKLMMTLSSSNVYISIPVRILLHIICRVKTEKARA

SEQ ID NO: 26620 - protein, 71 aa, Diabrotica virgifera
  misc_feature: Coding regions on vcDNA: vcDNA=SeqID_6317; Strand=+; Position=3-217
  misc_feature: Homolog annotation: Hit_ID=EAL33853.1; Match level="QueryCoverage =95%, HitCoverage=8%, E-value=1e-10, Identity=47%"; Hit description =GA18377-PA [Drosophila pseudoobscura]
  misc_feature (31)..(31): Xaa can be any naturally occurring amino acid
SRFFKNQALLWTRNLKLPPSQTPWGIPDTFXDYWKGRKKGGGKLEIQVKLKTPIQTQQVEQIQERWLVVDQ

SEQ ID NO: 26621 - protein, 95 aa, Diabrotica virgifera
  misc_feature: Coding regions on vcDNA: vcDNA=SeqID_6318; Strand=+; Position=14-298
  misc_feature: Homolog annotation: Hit_ID=NP_648234.1; Match level="QueryCoverage =100%, HitCoverage=36%, E-value=7e-10, Identity=38%"; Hit description= CG6776-PA [Drosophila melanogaster] gb|AAF50406.1| CG6776-PA [Drosophila melanogaster]
  misc_feature (6)..(23): Xaa can be any naturally occurring amino acid
  misc_feature (90)..(90): Xaa can be any naturally occurring amino acid
KYPENXXXXXXXXXXXXXXXXXXKAGGPQGVFIKIVLGKEEHSAEEWAKLLLEALQPLEEELSQRGTPFFGGDKPGMADYMIWPWAERAXCIGIK

SEQ ID NO: 26622 - protein, 40 aa, Diabrotica virgifera
  misc_feature: Coding regions on vcDNA: vcDNA=SeqID_6319; Strand=+; Position=1-120
  misc_feature (3)..(11): Xaa can be any naturally occurring amino acid
RSXXXXXXXXXKVGPLFGGGGVSHFSLIKFPPPSIFKSKI

SEQ ID NO: 26623 - protein, 70 aa, Diabrotica virgifera
  misc_feature: Coding regions on vcDNA: vcDNA=SeqID_6320; Strand=-; Position=143-355
  misc_feature (15)..(15): Xaa can be any naturally occurring amino acid
LPKCNDGGAPETKNXEQSRPSLEAFLNFVNFFCSQVGFQPEIQDAKVLRLVRSFVRNGSVNVKYQIHYQT

SEQ ID NO: 26624 - protein, 42 aa, Diabrotica virgifera
  misc_feature: Coding regions on vcDNA: vcDNA=SeqID_6321; Strand=-; Position=1-126
  misc_feature (22)..(32): Xaa can be any naturally occurring amino acid
PLIFLFSLSLFLSLFQSLSVGXXXXXXXXXXXTERQRERQRE

SEQ ID NO: 26625 - protein, 48 aa, Diabrotica virgifera
  misc_feature: Coding regions on vcDNA: vcDNA=SeqID_6322; Strand=+; Position=138-281
DGLKFLFWAPHLLMKTIFGKGIQIFVKFPYNCLFQLTQCINNTVLFII

SEQ ID NO: 26626 - protein, 98 aa, Diabrotica virgifera
  misc_feature: Coding regions on vcDNA: vcDNA=SeqID_6323; Strand=-; Position=0-293
  misc_feature (84)..(95): Xaa can be any naturally occurring amino acid
GVGSPPWEKKGGGLLSHFCFWNGAQFPIIFLSLPVWGTPKKGAFWTFVKKDLGSPIPRVPYRKKFGFFKPFGFGGVYNSSPPPXXXXXXXXXXXXSCR

SEQ ID NO: 26627 - protein, 72 aa, Diabrotica virgifera
  misc_feature: Coding regions on vcDNA: vcDNA=SeqID_6324; Strand=-; Position=0-215
  misc_feature (59)..(67): Xaa can be any naturally occurring amino acid
PPPVPNLAQGRAEFGPSNNPIFRKTLGFKMQKFLIKENPIVPHWGPIEINLNAKFLAQXXXXXXXXXRLVFL

SEQ ID NO: 26628 - protein, 54 aa, Diabrotica virgifera
  misc_feature: Coding regions on vcDNA: vcDNA=SeqID_6325; Strand=-; Position=82-246
  misc_feature: Homolog annotation: Hit_ID=XP_396960.1; Match level="QueryCoverage =92%, HitCoverage=27%, E-value=2e-16, Identity=76%"; Hit description =similar to CG9090-PA [Apis mellifera]
  misc_feature: Gene Ontology Annotation: Molecular function=phosphate carrier activity; Cellular component=integral to plasma membrane; Biological process=transport
EIGNGWIWKGLTPRIVMIGTLTALQWFIYDAFKVAMRMPRPPPPEMPESITITN

SEQ ID NO: 26629 - protein, 48 aa, Diabrotica virgifera
  misc_feature: Coding regions on vcDNA: vcDNA=SeqID_6326; Strand=+; Position=3-146
KISNELHTVRTTYCQCAQARGKCTILPSIDSPLKKNIFKNKPTHYYTL

SEQ ID NO: 26630 - protein, 25 aa, Diabrotica virgifera
  misc_feature: Coding regions on vcDNA: vcDNA=SeqID_6327; Strand=-; Position=2-76
TDAPTTAAPVHHLPDFLKMRFNTVW

SEQ ID NO: 26631 - protein, 47 aa, Diabrotica virgifera
  misc_feature: Coding regions on vcDNA: vcDNA=SeqID_6328; Strand=+; Position=45-185
IKTNRWRVRSSSYNLVTLNNFKLIARSRTGDASFKCLPYQLSMVGSA

SEQ ID NO: 26632 - protein, 54 aa, Diabrotica virgifera
  misc_feature: Coding regions on vcDNA: vcDNA=SeqID_6329; Strand=+; Position=1-162
  misc_feature (8)..(13): Xaa can be any naturally occurring amino acid
  misc_feature (44)..(51): Xaa can be any naturally occurring amino acid
GAYFSRRXXXXXXYDIIFLNFVYFVLKLYYTFMEVCVNKFLIKXXXXXXXXQGG

SEQ ID NO: 26633 - protein, 62 aa, Diabrotica virgifera
  misc_feature: Coding regions on vcDNA: vcDNA=SeqID_6330; Strand=-; Position=337-525
  misc_feature (5)..(20): Xaa can be any naturally occurring amino acid
  misc_feature (36)..(41): Xaa can be any naturally occurring amino acid
GRTRXXXXXXXXXXXXXXXXPEFKLKVYQNCLPLKXXXXXXKNHNPPFSIRIVYPQFKNPGG

SEQ ID NO: 26634 - protein, 36 aa, Diabrotica virgifera
  misc_feature: Coding regions on vcDNA: vcDNA=SeqID_6331; Strand=-; Position=2-109
  misc_feature (2)..(9): Xaa can be any naturally occurring amino acid
  misc_feature (22)..(29): Xaa can be any naturally occurring amino acid
HXXXXXXXXENMYLNETLISFXXXXXXXXSLDEPAR

SEQ ID NO: 26635 - protein, 68 aa, Diabrotica virgifera
  misc_feature: Coding regions on vcDNA: vcDNA=SeqID_6332; Strand=-; Position=154-360
SAVFMNLLTFFDTLKRHSSDSRLCVVPNQGRCTLGVAKDGPYGVLVISSAPKPPRVTKSGYNTLILTC

SEQ ID NO: 26636 - protein, 81 aa, Diabrotica virgifera
  misc_feature: Coding regions on vcDNA: vcDNA=SeqID_6333; Strand=-; Position=1-243
  misc_feature (9)..(17): Xaa can be any naturally occurring amino acid
  misc_feature (19)..(25): Xaa can be any naturally occurring amino acid
  misc_feature (35)..(56): Xaa can be any naturally occurring amino acid
  misc_feature (59)..(67): Xaa can be any naturally occurring amino acid
  misc_feature (72)..(78): Xaa can be any naturally occurring amino acid
ANIAWNSAXXXXXXXXXAXXXXXXXLSYLALCSSXXXXXXXXXXXXXXXXXXXXXXLWXXXXXXXXXKAPRXXXXXXXRAA

SEQ ID NO: 26637 - protein, 29 aa, Diabrotica virgifera
  misc_feature: Coding regions on vcDNA: vcDNA=SeqID_6334; Strand=+; Position=2-88
HVGVFKGFIGTLKYLRVYTFKIYSWRRNV

SEQ ID NO: 26638 - protein, 61 aa, Diabrotica virgifera
  misc_feature: Coding regions on vcDNA: vcDNA=SeqID_6335; Strand=-; Position=2-184
SKNIKKSLYDERRKFSSFSKCGRVVMTCTVCIRVKFAICHSCTFPINNKTYYNLHTRAHHF

SEQ ID NO: 26639 - protein, 41 aa, Diabrotica virgifera
  misc_feature: Coding regions on vcDNA: vcDNA=SeqID_6336; Strand=-; Position=28-153
  misc_feature (2)..(9): Xaa can be any naturally occurring amino acid
RXXXXXXXXSGEVLACFKHSNLFKVNVPAHLDTQSRAPRRD

SEQ ID NO: 26640 - protein, 64 aa, Diabrotica virgifera
  misc_feature: Coding regions on vcDNA: vcDNA=SeqID_6337; Strand=-; Position=212-406
VNAGKDNHDGARNAKSSQKPHMSDCINSLVDVSRCRAFYNLILTHRRLSSINNSTAATLQLCFT

SEQ ID NO: 26641 - protein, 29 aa, Diabrotica virgifera
  misc_feature: Coding regions on vcDNA: vcDNA=SeqID_6338; Strand=+; Position=2-88
TLYLSLSMDLSLSLGNGLPKSNTREETHN

SEQ ID NO: 26642 - protein, 64 aa, Diabrotica virgifera
  misc_feature: Coding regions on vcDNA: vcDNA=SeqID_6339; Strand=-; Position=52-246
RGHFLEGPDLALGAILGTGLKILGNRVGVTRVTPSGPGEPILGDLPPEIFPPGGKNRLFKGENF

SEQ ID NO: 26643 - protein, 67 aa, Diabrotica virgifera
  misc_feature: Coding regions on vcDNA: vcDNA=SeqID_6340; Strand=-; Position=0-200
  misc_feature (10)..(27): Xaa can be any naturally occurring amino acid
FFSSSLFVFXXXXXXXXXXXXXXXXXXPGCGLGRGGRERELVRLRARERERRALVSVSLPISCYEPL

SEQ ID NO: 26644 - protein, 61 aa, Diabrotica virgifera
  misc_feature: Coding regions on vcDNA: vcDNA=SeqID_6341; Strand=-; Position=2-184
  misc_feature (15)..(26): Xaa can be any naturally occurring amino acid
PGRIWPKLVPNLAPXXXXXXXXXXXXSSFIKVWAYLYYHYLIKILGVVFLRSSFPQLLNQC

SEQ ID NO: 26645 - protein, 164 aa, Diabrotica virgifera
  misc_feature: Coding regions on vcDNA: vcDNA=SeqID_6342; Strand=+; Position=1-492
  misc_feature: Homolog annotation: Hit_ID=EAA03784.2; Match level="QueryCoverage =98%, HitCoverage=16%, E-value=6e-55, Identity=59%"; Hit description =ENSANGP00000006225 [Anopheles gambiae str. PEST] ref|XP_565521.1| ENSANGP00000006225 [Anopheles gambiae st
  misc_feature: Gene Ontology Annotation: Molecular function=hyaluronoglucosaminidase activity; Biological process=glycoprotein catabolism
LLYDLYSYIWDMRGVISLLNSYVKWLAGGHFPPSMPSYTQGTYTWFSKGWKETFMSGEQEPWVFRGGLTADLQRLVPVDSGNDLFLYKVPEVPTNRVFTIRPYLPTDEETIYNVCIRTCKDGLEDPIPYPDNLKHLHADKIVGPYLTLHPEFCFVMEDDAGVIG

SEQ ID NO: 26646 - protein, 25 aa, Diabrotica virgifera
  misc_feature: Coding regions on vcDNA: vcDNA=SeqID_6343; Strand=+; Position=2-76
SNYAARKSARFGVTTEVQPTVLPKT

SEQ ID NO: 26647 - protein, 151 aa, Diabrotica virgifera
  misc_feature: Coding regions on vcDNA: vcDNA=SeqID_6344; Strand=-; Position=3-455
  misc_feature: Homolog annotation: Hit_ID=EAL30647.1; Match level="QueryCoverage =98%, HitCoverage=28%, E-value=1e-23, Identity=44%"; Hit description =GA20362-PA [Drosophila pseudoobscura]
ELWEADLDPAMQEVLKMQSGDMTIEWSYIPTKDLPGVILHDRLMTDAALGTRPIKTEHSYSLTSDGDSLPDSPTSHHKVDEMDDECFPVISMKTACNNLQHDPLNIKDEPASETDSNHSSCPSSPQSIYVNASDVLLDVEMSPSHEDHLVP

SEQ ID NO: 26648 - protein, 27 aa, Diabrotica virgifera
  misc_feature: Coding regions on vcDNA: vcDNA=SeqID_6345; Strand=+; Position=2-85
SHMQIFFTEFRRKIKILYHISKQTYIT

SEQ ID NO: 26649 - protein, 103 aa, Diabrotica virgifera
  misc_feature: Coding regions on vcDNA: vcDNA=SeqID_6346; Strand=-; Position=1-312
  misc_feature (58)..(66): Xaa can be any naturally occurring amino acid
DRKTSQIFRLPKKGFFLFFYIFFFVLARSLSLIDNLATSRLLPQQSVVYPLTYKYPSXXXXXXXXXDRFTACKKTCCNFLHARLSCKSIAWSFTRLQPGLHPI

SEQ ID NO: 26650 - protein, 122 aa, Diabrotica virgifera
  misc_feature: Coding regions on vcDNA: vcDNA=SeqID_6347; Strand=-; Position=91-459
  misc_feature (94)..(99): Xaa can be any naturally occurring amino acid
SPHSNCHPYVLGWIHNLYIEGRISNRCRSFLVDTGATRTIARPDVVRDHNNYHLAIVKFRQATGELINTYGEANMSVSMGQPPVDHKVLFARFXXXXXXGMTVLRKVGPIWIVQNGVSKIQG

SEQ ID NO: 26651 - protein, 95 aa, Diabrotica virgifera
  misc_feature: Coding regions on vcDNA: vcDNA=SeqID_6348; Strand=+; Position=1-286
  misc_feature: Homolog annotation: Hit_ID=AAM53446.1; Match level="QueryCoverage =98%, HitCoverage=26%, E-value=1e-17, Identity=47%"; Hit description =elongation factor 1-alpha [Holorusia rubiginosa]
  misc_feature (35)..(35): Xaa can be any naturally occurring amino acid
TGRTQDQPTKRTLGFNCQSIGFHHPCPNLNRFTPXLNCPTLNLACNSLEIKKKVTRRSCKTLEKNPKALNSVKAALVNWYPTNPLCVKYFKKFQP

SEQ ID NO: 26652 - protein, 46 aa, Diabrotica virgifera
  misc_feature: Coding regions on vcDNA: vcDNA=SeqID_6349; Strand=+; Position=3-143
WRIPPQPQPGFWQRKVFLCRPSFKGFPQFLNYQKLSSLLKLVPQRY

SEQ ID NO: 26653 - protein, 89 aa, Diabrotica virgifera
  misc_feature: Coding regions on vcDNA: vcDNA=SeqID_6350; Strand=-; Position=3-269
  misc_feature (6)..(6): Xaa can be any naturally occurring amino acid
  misc_feature (62)..(69): Xaa can be any naturally occurring amino acid
VNQMSXLFLTPGGELYYSPIKGVWVGGPPPCVILFLSQLFVLFFCIFSLSNSFFRIVLQIGXXXXXXXXVDFFIFLILVTRSVTKDTPF

SEQ ID NO: 26654 - protein, 158 aa, Diabrotica virgifera
  misc_feature: Coding regions on vcDNA: vcDNA=SeqID_6351; Strand=-; Position=0-473
  misc_feature (3)..(19): Xaa can be any naturally occurring amino acid
  misc_feature (139)..(154): Xaa can be any naturally occurring amino acid
PPXXXXXXXXXXXXXXXXXDTIYLIEISQDPNILSHFVSMCNYLTNYTPKLAVSKWNWFRGTTQGIGPKLILQGNFFHSFGFDGVTNWPSGVGFFKDYQNPFWPVFGSRKGLGSNFFGGSMTFLRFSKEAALNSGGFAXXXXXXXXXXXXXXXXVGWG

SEQ ID NO: 26655 - protein, 80 aa, Diabrotica virgifera
  misc_feature: Coding regions on vcDNA: vcDNA=SeqID_6352; Strand=-; Position=1-240
  misc_feature (9)..(45): Xaa can be any naturally occurring amino acid
  misc_feature (47)..(56): Xaa can be any naturally occurring amino acid
  misc_feature (60)..(67): Xaa can be any naturally occurring amino acid
  misc_feature (70)..(79): Xaa can be any naturally occurring amino acid
PPLGGIGGXXXXXXXXXXXXXXXXXXXXXXXXXXXXXXXXXXXXXYXXXXXXXXXXRHLXXXXXXXXGQXXXXXXXXXXF

SEQ ID NO: 26656 - protein, 41 aa, Diabrotica virgifera
  misc_feature: Coding regions on vcDNA: vcDNA=SeqID_6353; Strand=-; Position=172-297
ILVFYHQSNTQSTFQYRGPTLDPKLYLRLNPVFWLHSSRLK

SEQ ID NO: 26657 - protein, 102 aa, Diabrotica virgifera
  misc_feature: Coding regions on vcDNA: vcDNA=SeqID_6354; Strand=-; Position=1-306
  misc_feature (18)..(20): Xaa can be any naturally occurring amino acid
  misc_feature (38)..(51): Xaa can be any naturally occurring amino acid
  misc_feature (60)..(79): Xaa can be any naturally occurring amino acid
  misc_feature (81)..(88): Xaa can be any naturally occurring amino acid
TNTILHHCINKKIGVRWXXXFFKAPPRVFNTPPPKGYXXXXXXXXXXXXXXICVGEYFWXXXXXXXXXXXXXXXXXXXXEXXXXXXXXPRLGPWAGFGQRLV

SEQ ID NO: 26658 - protein, 87 aa, Diabrotica virgifera
  misc_feature: Coding regions on vcDNA: vcDNA=SeqID_6355; Strand=+; Position=36-296
  misc_feature (86)..(86): Xaa can be any naturally occurring amino acid
FPGVQGPDKFRTKAFKPWVLEKLGHLINGNTCSQKCESMGSYYVGGICYQNDCYCAHLIYICRHRTSILIIYSFTTCKTPKKPPIXF

SEQ ID NO: 26659 - protein, 81 aa, Diabrotica virgifera
  misc_feature: Coding regions on vcDNA: vcDNA=SeqID_6356; Strand=-; Position=138-383
  misc_feature: Homolog annotation: Hit_ID=XP_392648.1; Match level="QueryCoverage =97%, HitCoverage=42%, E-value=2e-11, Identity=40%"; Hit description =similar to CG1927-PA [Apis mellifera]
MIFFHPIMLVFVCVIEIFLHTRIHRKNKELEDLSFYYQSPLHGLTKEVCARCKDEKAKNKIAKLQDKQHEKFKNYIKRVVT

SEQ ID NO: 26660 - protein, 67 aa, Diabrotica virgifera
  misc_feature: Coding regions on vcDNA: vcDNA=SeqID_6357; Strand=+; Position=3-201
  misc_feature: Homolog annotation: Hit_ID=EAL44696.1; Match level="QueryCoverage =98%, HitCoverage=6%, E-value=1e-15, Identity=57%"; Hit description =leucine rich repeat protein [Entamoeba histolytica HM-1:IMSS]
  misc_feature: Gene Ontology Annotation: Molecular function=molecular_function unknown; Cellular component=cellular_component unknown; Biological process=N-linked glycosylation
  misc_feature (54)..(54): Xaa can be any naturally occurring amino acid
AREQEEKRQKQEEKRQKEKEKRKQKEEEKRIKEQQKREEERQRREEERLRREEXKQQKEEEKRRKQE

SEQ ID NO: 26661 - protein, 78 aa, Diabrotica virgifera
  misc_feature: Coding regions on vcDNA: vcDNA=SeqID_6358; Strand=+; Position=156-392
MTCCCFQLLLWGRMRERESFGEEVKLLPVRRKLDHSLTRCFTRALSTFVLGSSWRNVKGGCMKSGVTKRLRVRLVQLT

SEQ ID NO: 26662 - protein, 34 aa, Diabrotica virgifera
  misc_feature: Coding regions on vcDNA: vcDNA=SeqID_6359; Strand=-; Position=0-101
  misc_feature (10)..(17): Xaa can be any naturally occurring amino acid
  misc_feature (19)..(30): Xaa can be any naturally occurring amino acid
FSRERARALXXXXXXXXLXXXXXXXXXXXXRAES

SEQ ID NO: 26663 - protein, 84 aa, Diabrotica virgifera
  misc_feature: Coding regions on vcDNA: vcDNA=SeqID_6360; Strand=+; Position=3-257
  misc_feature (4)..(10): Xaa can be any naturally occurring amino acid
  misc_feature (46)..(56): Xaa can be any naturally occurring amino acid
SLEXXXXXXXLRLFNFMRHYSKFKRGINIFPSLFTQIKLAENPLGXXXXXXXXXXXKGFKLPLCLHTKGGHYNFYLIPFPNFGR

SEQ ID NO: 26664 - protein, 61 aa, Diabrotica virgifera
  misc_feature: Coding regions on vcDNA: vcDNA=SeqID_6361; Strand=-; Position=2-184
  misc_feature (10)..(20): Xaa can be any naturally occurring amino acid
  misc_feature (31)..(39): Xaa can be any naturally occurring amino acid
KGLPLQITLXXXXXXXXXXXNFQIEEKRGGXXXXXXXXXWGRPPPTMLKIIGGALIKLPPP

SEQ ID NO: 26665 - protein, 37 aa, Diabrotica virgifera
  misc_feature: Coding regions on vcDNA: vcDNA=SeqID_6362; Strand=+; Position=1-114
  misc_feature (6)..(24): Xaa can be any naturally occurring amino acid
  misc_feature (29)..(37): Xaa can be any naturally occurring amino acid
KFKLFXXXXXXXXXXXXXXXXXXXPSFQXXXXXXXXX

SEQ ID NO: 26666 - protein, 64 aa, Diabrotica virgifera
  misc_feature: Coding regions on vcDNA: vcDNA=SeqID_6363; Strand=+; Position=48-239
  misc_feature (25)..(52): Xaa can be any naturally occurring amino acid
KFCFKLIVPENNIVHKMIQYKILKXXXXXXXXXXXXXXXXXXXXXXXXXXXXFKGGVKKLRGGV

SEQ ID NO: 26667 - protein, 168 aa, Diabrotica virgifera
  misc_feature: Coding regions on vcDNA: vcDNA=SeqID_6364; Strand=-; Position=1-504
  misc_feature (3)..(67): Xaa can be any naturally occurring amino acid
  misc_feature (71)..(105): Xaa can be any naturally occurring amino acid
  misc_feature (107)..(115): Xaa can be any naturally occurring amino acid
  misc_feature (117)..(165): Xaa can be any naturally occurring amino acid
PPXXXXXXXXXXXXXXXXXXXXXXXXXXXXXXXXXXXXXXXXXXXXXXXXXXXXXXXXXXXXXXXXXGEKXXXXXXXXXXXXXXXXXXXXXXXXXXXXXXXXXXXPXXXXXXXXXPXXXXXXXXXXXXXXXXXXXXXXXXXXXXXXXXXXXXXXXXXXXXXXXXXKLE

SEQ ID NO: 26668 - protein, 40 aa, Diabrotica virgifera
  misc_feature: Coding regions on vcDNA: vcDNA=SeqID_6365; Strand=+; Position=53-175
  misc_feature (1)..(8): Xaa can be any naturally occurring amino acid
XXXXXXXXLKPHSLNRNAVVANLNKRVYYQLSKFEYLARL

SEQ ID NO: 26669 - protein, 90 aa, Diabrotica virgifera
  misc_feature: Coding regions on vcDNA: vcDNA=SeqID_6366; Strand=-; Position=20-292
KRSLMQMFKNFNLHTLHLHLHTQHRPVLITIGISIPIIRSYPRPRWNLRKANWKKFSEQLDRILSWVPPTSKHYERFVGAVISTCQENHP

SEQ ID NO: 26670 - protein, 54 aa, Diabrotica virgifera
  misc_feature: Coding regions on vcDNA: vcDNA=SeqID_6367; Strand=+; Position=3-167
  misc_feature (33)..(40): Xaa can be any naturally occurring amino acid
HECCRTCIWLILHRRGIAITVSYDFVSHRFKLXXXXXXXXALRGACTPYPHYKL

SEQ ID NO: 26671 - protein, 38 aa, Diabrotica virgifera
  misc_feature: Coding regions on vcDNA: vcDNA=SeqID_6368; Strand=+; Position=1-117
  misc_feature (12)..(22): Xaa can be any naturally occurring amino acid
IFNKKSLIVFDXXXXXXXXXXXSKGCNFFYEHICTKVS

SEQ ID NO: 26672 - protein, 76 aa, Diabrotica virgifera
  misc_feature: Coding regions on vcDNA: vcDNA=SeqID_6369; Strand=-; Position=0-227
  misc_feature (6)..(49): Xaa can be any naturally occurring amino acid
  misc_feature (53)..(59): Xaa can be any naturally occurring amino acid
RRAGGXXXXXXXXXXXXXXXXXXXXXXXXXXXXXXXXXXXXXXXXXXXXDQVXXXXXXXIKPISNILFRIRLLELT

SEQ ID NO: 26673 - protein, 31 aa, Diabrotica virgifera
  misc_feature: Coding regions on vcDNA: vcDNA=SeqID_6370; Strand=+; Position=3-98
RAAWNEVKILAQNRTRMRVWLYDPLRSSRTL

SEQ ID NO: 26674 - protein, 106 aa, Diabrotica virgifera
  misc_feature: Coding regions on vcDNA: vcDNA=SeqID_6371; Strand=-; Position=111-431
  misc_feature (4)..(11): Xaa can be any naturally occurring amino acid
  misc_feature (54)..(54): Xaa can be any naturally occurring amino acid
  misc_feature (56)..(106): Xaa can be any naturally occurring amino acid
PPTXXXXXXXXLLLYTSGSTLIVGSTTSKKEGDRSILFSTAAPVLLKKWEEGAXKXXXXXXXXXXXXXXXXXXXXXXXXXXXXXXXXXXXXXXXXXXXXXXXXXXX

SEQ ID NO: 26675 - protein, 164 aa, Diabrotica virgifera
  misc_feature: Coding regions on vcDNA: vcDNA=SeqID_6372; Strand=+; Position=2-496
  misc_feature: Homolog annotation: Hit_ID=NP_573114.2; Match level="QueryCoverage =96%, HitCoverage=50%, E-value=9e-52, Identity=60%"; Hit description =CG9914-PA [Drosophila melanogaster] gb|AAF48586.2| CG9914-PA [Drosophila melanogaster]
  misc_feature: Pfam annotation: Pfam_ID=3HCDH; Match level="Score=78.7, E-value=1.6e- 20, Copies=1"; Pfam description=3-hydroxyacyl-CoA dehydrogenase, C-te
  misc_feature (130)..(136): Xaa can be any naturally occurring amino acid
FGTRVPAPWTDPEVAKKTRAIWEEVGQTPVSLTKEVPGFIINRLQYAVLNEAWHLVTEGVLDVKDVDKVMSEGLGMRYAFLGTLETTHLNEQGFVNYCKRYGDTIYAVSKDFKPTPKFEGPHVLEIAKQXXXXXXXDKLQERRNWRDLCLTKLSQLKTEMNKLK

SEQ ID NO: 26676 - protein, 103 aa, Diabrotica virgifera
  misc_feature: Coding regions on vcDNA: vcDNA=SeqID_6373; Strand=-; Position=123-435
  misc_feature (21)..(21): Xaa can be any naturally occurring amino acid
PPPVKGGGGNPPQSVLKGGGXPFPFSHKGFLVKDPPLGKFWSKRVPPGMSKMAIPGLPVFLGSGEGPQGPFFLPWELFLKGKIFGKIAPLSVGAPKESPTPPF

SEQ ID NO: 26677 - protein, 50 aa, Diabrotica virgifera
  misc_feature: Coding regions on vcDNA: vcDNA=SeqID_6374; Strand=+; Position=2-151
AALNVVVLLKSQIHFGFYTTTLNFLFCIPRRDSIDEPTIHEHVKVGINSF

SEQ ID NO: 26678 - protein, 77 aa, Diabrotica virgifera
  misc_feature: Coding regions on vcDNA: vcDNA=SeqID_6375; Strand=-; Position=2-232
  misc_feature (11)..(11): Xaa can be any naturally occurring amino acid
SFAHFYRYLSXYFIHTRNLNRMHYHIYLIIVVSFCKLLYSITLKRKLFVSAIDLTFVNSSPSRHINSHDSPRAVFGT

SEQ ID NO: 26679 - protein, 40 aa, Diabrotica virgifera
  misc_feature: Coding regions on vcDNA: vcDNA=SeqID_6376; Strand=+; Position=2-124
  misc_feature (1)..(12): Xaa can be any naturally occurring amino acid
XXXXXXXXXXXXVSLYMRGGRSPYPYLSIERHISINSPPM

SEQ ID NO: 26680 - protein, 50 aa, Diabrotica virgifera
  misc_feature: Coding regions on vcDNA: vcDNA=SeqID_6377; Strand=-; Position=2-151
  misc_feature (32)..(40): Xaa can be any naturally occurring amino acid
VIKEILYNPINSIFSFYLYVQKIRICTNKVYXXXXXXXXXNKVCKMYSLP

SEQ ID NO: 26681 - protein, 60 aa, Diabrotica virgifera
  misc_feature: Coding regions on vcDNA: vcDNA=SeqID_6378; Strand=+; Position=1-183
  misc_feature: Homolog annotation: Hit_ID=XP_533292.1; Match level="QueryCoverage =75%, HitCoverage=20%, E-value=2e-11, Identity=60%"; Hit description =PREDICTED: similar to progesterone membrane binding protein [Canis familiaris]
  misc_feature: Gene Ontology Annotation: Molecular function=steroid hormone receptor activity; Cellular component=integral to membrane
DLSTMEMDSIKEWESQFDEEYDFVGRLLKPGEQPTNYSDEEDADESAAGGDKADKEKKED

SEQ ID NO: 26682 - protein, 45 aa, Diabrotica virgifera
  misc_feature: Coding regions on vcDNA: vcDNA=SeqID_6379; Strand=-; Position=17-154
  misc_feature (7)..(14): Xaa can be any naturally occurring amino acid
VRNWARXXXXXXXXFHTQSNRTFLNVVVSHHLILVSHLDESGKNS

SEQ ID NO: 26683 - protein, 83 aa, Diabrotica virgifera
  misc_feature: Coding regions on vcDNA: vcDNA=SeqID_6380; Strand=+; Position=144-392
SIHAMALQSNNSSHGLLQQTFSFVMVILLHDRLPRIFLEPSSASSSHRFLGLPIDVFVSSPAFLHSNIYWKLVFCHPKYMLVQ

SEQ ID NO: 26684 - protein, 20 aa, Diabrotica virgifera
  misc_feature: Coding regions on vcDNA: vcDNA=SeqID_6381; Strand=-; Position=1-60
WCDNANQENQGEPPVLLRYK

SEQ ID NO: 26685 - protein, 32 aa, Diabrotica virgifera
  misc_feature: Coding regions on vcDNA: vcDNA=SeqID_6382; Strand=+; Position=1-96
  misc_feature: Homolog annotation: Hit_ID=A56635; Match level="QueryCoverage=100%, HitCoverage=7%, E-value=2e-10, Identity=96%"; Hit description =tubulin alpha chain, brain-specific isotype (clone pTUB5) - chum salmon
  misc_feature: Gene Ontology Annotation: Molecular function=structural constituent of cytoskeleton; Cellular component=cytoskeleton; Biological process= microtubule cytoskeleton organization and biogenesis
  misc_feature (8)..(8): Xaa can be any naturally occurring amino acid
GLQGFLIXHSFGGGTGSGFTSLLMERLSVDYG

SEQ ID NO: 26686 - protein, 42 aa, Diabrotica virgifera
  misc_feature: Coding regions on vcDNA: vcDNA=SeqID_6383; Strand=+; Position=2-130
MILNQLHCAPLKRGHLNVLSFLIFTNPNCLLLDVCTMFKNMF

SEQ ID NO: 26687 - protein, 49 aa, Diabrotica virgifera
  misc_feature: Coding regions on vcDNA: vcDNA=SeqID_6384; Strand=+; Position=3-152
RELMILSGKSLSNRLSLFNDVGLKLICISFNSLAFVLVLIIIINMIVSG

SEQ ID NO: 26688 - protein, 117 aa, Diabrotica virgifera
  misc_feature: Coding regions on vcDNA: vcDNA=SeqID_6385; Strand=+; Position=205-555
  misc_feature (26)..(55): Xaa can be any naturally occurring amino acid
  misc_feature (57)..(79): Xaa can be any naturally occurring amino acid
  misc_feature (84)..(91): Xaa can be any naturally occurring amino acid
  misc_feature (93)..(112): Xaa can be any naturally occurring amino acid
ILFHLGGGNFFYELELPKKITLFPQXXXXXXXXXXXXXXXXXXXXXXXXXXXXXXPXXXXXXXXXXXXXXXXXXXXXXXFRGFXXXXXXXXLXXXXXXXXXXXXXXXXXXXXLYIQF

SEQ ID NO: 26689 - protein, 73 aa, Diabrotica virgifera
  misc_feature: Coding regions on vcDNA: vcDNA=SeqID_6386; Strand=-; Position=3-221
  misc_feature (30)..(36): Xaa can be any naturally occurring amino acid
  misc_feature (63)..(73): Xaa can be any naturally occurring amino acid
PPPKDIHSNYSFEKLYICLLSNNTNINTLXXXXXXXSSSILFFLNSIFLERTHECSFVSSCLXXXXXXXXXXX

SEQ ID NO: 26690 - protein, 73 aa, Diabrotica virgifera
  misc_feature: Coding regions on vcDNA: vcDNA=SeqID_6387; Strand=-; Position=1-219
  misc_feature (3)..(10): Xaa can be any naturally occurring amino acid
KMXXXXXXXXYNVLIFNALKPYDDPQQHIDVLVESYSGCIVGSTIHFVGSTIQVVPWTVEFVVGGDCSYNEIV

SEQ ID NO: 26691 - protein, 40 aa, Diabrotica virgifera
  misc_feature: Coding regions on vcDNA: vcDNA=SeqID_6388; Strand=-; Position=49-171
  misc_feature (9)..(9): Xaa can be any naturally occurring amino acid
TNIQNNYSXQNTRHLTHVHSSINTLLGYRTKTKILHETCE

SEQ ID NO: 26692 - protein, 33 aa, Diabrotica virgifera
  misc_feature: Coding regions on vcDNA: vcDNA=SeqID_6389; Strand=-; Position=93-194
  misc_feature (21)..(21): Xaa can be any naturally occurring amino acid
GCTGFSTVLVFDIITSVIFFXINTTFPPFFKNS

SEQ ID NO: 26693 - protein, 65 aa, Diabrotica virgifera
  misc_feature: Coding regions on vcDNA: vcDNA=SeqID_6390; Strand=-; Position=285-482
FLVLGVRHLREKPRKFHLSRGKTRCAPYHVNFRLIMVPFIAGRSLDIKLTALLFYIFTTDIISTT

SEQ ID NO: 26694 - protein, 73 aa, Diabrotica virgifera
  misc_feature: Coding regions on vcDNA: vcDNA=SeqID_6391; Strand=+; Position=2-220
  misc_feature (1)..(12): Xaa can be any naturally occurring amino acid
  misc_feature (43)..(51): Xaa can be any naturally occurring amino acid
  misc_feature (59)..(66): Xaa can be any naturally occurring amino acid
XXXXXXXXXXXXYNYFVTGQVNKSYLVLNLPIISIKNENMMLXXXXXXXXXIVYIQYTXXXXXXXXTQLHIII

SEQ ID NO: 26695 - protein, 99 aa, Diabrotica virgifera
  misc_feature: Coding regions on vcDNA: vcDNA=SeqID_6392; Strand=+; Position=3-299
  misc_feature (7)..(7): Xaa can be any naturally occurring amino acid
SFRGRHXNAWGGSHFPHSSLFNHKPGEISLSSSSFSIPSLQLLLGLPLFLLPCGGHAKICLWILSSGILCTWPYRTSWFVFMSSIIDCVTSIIFRILSF

SEQ ID NO: 26696 - protein, 74 aa, Diabrotica virgifera
  misc_feature: Coding regions on vcDNA: vcDNA=SeqID_6393; Strand=-; Position=1-222
  misc_feature (26)..(32): Xaa can be any naturally occurring amino acid
  misc_feature (38)..(47): Xaa can be any naturally occurring amino acid
  misc_feature (55)..(70): Xaa can be any naturally occurring amino acid
GGLGNFNPWGLFLKFFPVNLFGPWSXXXXXXXLKAPGXXXXXXXXXXPPGWVFKXXXXXXXXXXXXXXXXALPN

SEQ ID NO: 26697 - protein, 69 aa, Diabrotica virgifera
  misc_feature: Coding regions on vcDNA: vcDNA=SeqID_6394; Strand=-; Position=80-289
SNTMGSYKSISEVNHIKSSLIFGLFCYLDGIIVLISSVKISSGVIISEFIIKMDSSITVPKIFVWLFNT

SEQ ID NO: 26698 - protein, 29 aa, Diabrotica virgifera
  misc_feature: Coding regions on vcDNA: vcDNA=SeqID_6395; Strand=-; Position=6-95
  misc_feature (3)..(9): Xaa can be any naturally occurring amino acid
SSXXXXXXXNKNIKYTIIILKISTACDGH

SEQ ID NO: 26699 - protein, 79 aa, Diabrotica virgifera
  misc_feature: Coding regions on vcDNA: vcDNA=SeqID_6396; Strand=+; Position=2-238
  misc_feature: Homolog annotation: Hit_ID=CAE47497.1; Match level="QueryCoverage =100%, HitCoverage=25%, E-value=2e-12, Identity=51%"; Hit description= cathepsin L-like proteinase [Diabrotica virgifera virgifera]
  misc_feature (26)..(38): Xaa can be any naturally occurring amino acid
  misc_feature (40)..(47): Xaa can be any naturally occurring amino acid
  misc_feature (56)..(62): Xaa can be any naturally occurring amino acid
  misc_feature (64)..(73): Xaa can be any naturally occurring amino acid
AALIVATSANLGAFEKWTSFKATHNXXXXXXXXXXXXXVXXXXXXXXEEHNAKYEXXXXXXXLXXXXXXXXXXAEFQAM

SEQ ID NO: 26700 - protein, 32 aa, Diabrotica virgifera
  misc_feature: Coding regions on vcDNA: vcDNA=SeqID_6397; Strand=+; Position=35-130
  misc_feature (22)..(30): Xaa can be any naturally occurring amino acid
TDCYGFCVLLSFMHFDCGNPSXXXXXXXXXDI

SEQ ID NO: 26701 - protein, 32 aa, Diabrotica virgifera; identical to SEQ ID NO: 26700
  misc_feature: Coding regions on vcDNA: vcDNA=SeqID_6398; Strand=+; Position=35-130
  misc_feature (22)..(30): Xaa can be any naturally occurring amino acid

SEQ ID NO: 26702 - protein, 63 aa, Diabrotica virgifera
  misc_feature: Coding regions on vcDNA: vcDNA=SeqID_6399; Strand=-; Position=1-189
IDLFHVLYFKHSGIQAKNCTFVCVIKCVSREKFEMSNLEYMILVGTLHSKLVPYWARASRARP

SEQ ID NO: 26703 - protein, 51 aa, Diabrotica virgifera
  misc_feature: Coding regions on vcDNA: vcDNA=SeqID_6400; Strand=+; Position=16-168
IVNDLMRMKHQIEFINKDKSTTSQAKRTHWDARQNKLNYVNPRGGGGLGPP

SEQ ID NO: 26704 - protein, 64 aa, Diabrotica virgifera
  misc_feature: Coding regions on vcDNA: vcDNA=SeqID_6401; Strand=+; Position=3-194
TIKRKRRVIVKENIFRFNYLFPLLIKVFRKNCNIFEIKMAGIKALVTLAFLGSIGMTFVILACA

SEQ ID NO: 26705 - protein, 62 aa, Diabrotica virgifera
  misc_feature: Coding regions on vcDNA: vcDNA=SeqID_6402; Strand=+; Position=77-262
  misc_feature (11)..(22): Xaa can be any naturally occurring amino acid
  misc_feature (39)..(39): Xaa can be any naturally occurring amino acid
  misc_feature (45)..(52): Xaa can be any naturally occurring amino acid
  misc_feature (54)..(54): Xaa can be any naturally occurring amino acid
  misc_feature (58)..(58): Xaa can be any naturally occurring amino acid
YNSPKTIESKXXXXXXXXXXXXHWMYYIYTRDMSCKNCXMNVFVXXXXXXXXSXKLVXYENM

SEQ ID NO: 26706 - protein, 28 aa, Diabrotica virgifera
  misc_feature: Coding regions on vcDNA: vcDNA=SeqID_6403; Strand=-; Position=1-84
FLLAAVFVAVLATKEVSSSDVKVVDDPD

SEQ ID NO: 26707 - protein, 51 aa, Diabrotica virgifera
  misc_feature: Coding regions on vcDNA: vcDNA=SeqID_6404; Strand=+; Position=3-158
  misc_feature (15)..(31): Xaa can be any naturally occurring amino acid
TIDRCTLNSCTIHLXXXXXXXXXXXXXXXXXNIFSSSFVTIEYYKIVSIIY

SEQ ID NO: 26708 - protein, 68 aa, Diabrotica virgifera
  misc_feature: Coding regions on vcDNA: vcDNA=SeqID_6405; Strand=+; Position=3-209
SLYIVSQYLLEMIRRCLIVDPRKDFSLIRSRSHVRPISCNYKAIFAAVCVSRVSCLCSETITSSGGLS

SEQ ID NO: 26709 - protein, 110 aa, Diabrotica virgifera
  misc_feature: Coding regions on vcDNA: vcDNA=SeqID_6406; Strand=+; Position=1-330
  misc_feature (75)..(75): Xaa can be any naturally occurring amino acid
GTSLLCKAIFFFKTKMYSTVFKMLLLVAVLILVTISPSNADNYNKCPETSYQRSLVYQNALEGEFIYVRIPRRGXFNAPINCLLVTDINESFSTPVIEDGGYENEYVVIR

SEQ ID NO: 26710 - protein, 33 aa, Diabrotica virgifera
  misc_feature: Coding regions on vcDNA: vcDNA=SeqID_6407; Strand=+; Position=70-168
TTYWKNINNLILLVDYYLFFIIGRGAQAGIFAV

SEQ ID NO: 26711 - protein, 35 aa, Diabrotica virgifera
  misc_feature: Coding regions on vcDNA: vcDNA=SeqID_6408; Strand=+; Position=1-108
  misc_feature (6)..(6): Xaa can be any naturally occurring amino acid
GTKKLXLYFCSSPSNNKLPPPNLGNYGHSLIVQSP

SEQ ID NO: 26712 - protein, 48 aa, Diabrotica virgifera
  misc_feature: Coding regions on vcDNA: vcDNA=SeqID_6409; Strand=-; Position=4-150
QLGEFSKKGKEDQNNEIKTGGQKNPWFFGGNVKSGSFCLEPKSAPVAQ

SEQ ID NO: 26713 - protein, 25 aa, Diabrotica virgifera
  misc_feature: Coding regions on vcDNA: vcDNA=SeqID_6410; Strand=+; Position=1-75
LSPYPPHLLESEKNEHPLNPNAFPT

SEQ ID NO: 26714 - protein, 19 aa, Diabrotica virgifera
  misc_feature: Coding regions on vcDNA: vcDNA=SeqID_6411; Strand=+; Position=1-57
LNNIYVQPNFNKIKTYPLR

SEQ ID NO: 26715 - protein, 47 aa, Diabrotica virgifera
  misc_feature: Coding regions on vcDNA: vcDNA=SeqID_6412; Strand=-; Position=3-143
NKIFIGISVIILVDRLTNNSGGMEVLLRLRLEVEIGDTFTPNSISQV

SEQ ID NO: 26716 - protein, 41 aa, Diabrotica virgifera
  misc_feature: Coding regions on vcDNA: vcDNA=SeqID_6413; Strand=+; Position=3-125
  misc_feature (17)..(23): Xaa can be any naturally occurring amino acid
RIAHRGAFFIKMSSTVXXXXXXXNLIDLVSLYLNRYLINNN

SEQ ID NO: 26717 - protein, 68 aa, Diabrotica virgifera
  misc_feature: Coding regions on vcDNA: vcDNA=SeqID_6414; Strand=+; Position=119-325
  misc_feature (10)..(10): Xaa can be any naturally occurring amino acid
  misc_feature (35)..(46): Xaa can be any naturally occurring amino acid
AFYVNKNMHXNVVLYVHHHFYGIAHDLNFLTKYDXXXXXXXXXXXXILGLQCPVRADAPRQLPTSLIG

SEQ ID NO: 26718 - protein, 45 aa, Diabrotica virgifera
  misc_feature: Coding regions on vcDNA: vcDNA=SeqID_6415; Strand=+; Position=2-139
  misc_feature (39)..(40): Xaa can be any naturally occurring amino acid
YRAVIVDSCKSSEHFFIKLIIYFVELCINNIKCGYHSQXXIKTKN

SEQ ID NO: 26719 - protein, 140 aa, Diabrotica virgifera
  misc_feature: Coding regions on vcDNA: vcDNA=SeqID_6416; Strand=-; Position=449-871
  misc_feature (14)..(26): Xaa can be any naturally occurring amino acid
  misc_feature (53)..(63): Xaa can be any naturally occurring amino acid
  misc_feature (96)..(101): Xaa can be any naturally occurring amino acid
  misc_feature (104)..(120): Xaa can be any naturally occurring amino acid
  misc_feature (122)..(134): Xaa can be any naturally occurring amino acid
GRPAPICLRGALFXXXXXXXXXXXXXIISRILSENFRSFYVNLMALAEPISQXXXXXXXXXXXNQRNFFCISNSKYMYITNYVTYYYLKKYTVLDXXXXXXIYXXXXXXXXXXXXXXXXXIXXXXXXXXXXXXXFSFFQL

SEQ ID NO: 26720 - protein, 246 aa, Diabrotica virgifera
  misc_feature: Coding regions on vcDNA: vcDNA=SeqID_6417; Strand=+; Position=5-745
  misc_feature: Homolog annotation: Hit_ID=XP_317977.1; Match level="QueryCoverage =99%, HitCoverage=49%, E-value=8e-38, Identity=34%"; Hit description =ENSANGP00000001411 [Anopheles gambiae]
  misc_feature: Pfam annotation: Pfam_ID=Sterile; Match level="Score=59.4, E-value=1e- 14, Copies=1"; Pfam description=Male sterility protein
NRTYTYAKQLGEHVINDMCNGKIPTLIVRPSIVTSAKDEPFPGWNTNFNGPVGMNVAGGKGLLRTVYGYKDAVIDMVPVDYNIKAIIIATDDYNQRNSLELQVYSLAQNDVLGMKQGEILDLGKRLLDDYPFLNILWYPSFTMTDCWYQYYFSVLLFHILPAVFFDVLLRIGKQKPMIVKLQRKIYIANMVVAPFMKNSYQIPNNKILQAIKNVKDEDSAFTLDVIYLNHETQYEYSCNCRIGLTR

SEQ ID NO: 26721 - protein, 236 aa, Diabrotica virgifera
  misc_feature: Coding regions on vcDNA: vcDNA=SeqID_6418; Strand=+; Position=78-785
  misc_feature: Homolog annotation: Hit_ID=NP_996327.1; Match level="QueryCoverage =99%, HitCoverage=40%, E-value=1e-126, Identity=94%"; Hit description= CG3051-PC, isoform C [Drosophila melanogaster] ref|NP_726730.1| CG3051-PB, isoform B [Drosophila
  misc_feature: Gene Ontology Annotation: Molecular function=eukaryotic elongation factor-2 kinase activator activity; Cellular component =intracellular; Biological process=activation of MAPK
  misc_feature: Pfam annotation: Pfam_ID=Pkinase; Match level="Score=278.3, E-value =1.2e-80, Copies=1"; Pfam description=Protein kinase domain
MAEAVKPGAQPLVKIGHYVLGATLGVGTFGKVKIGEHQLTGHKVAVKILNRQKIKSLDVVGKIRREIQNLKLFRHPHIIKLYQVISTPTDIFMIMEYVSGGELFDYIVKHGKLQEHEARRFFQQIISGVDYCHRHMIVHRDLKPENLLLDHNMHVKIADFGLSNMMMDGEFLRTSCGSPNYAAPEVISGKLYAGPEVDIWSCGVILYALLCGTLPFDDEHVPTLFRKIKSGIFPIS

SEQ ID NO: 26722 - protein, 60 aa, Diabrotica virgifera
  misc_feature: Coding regions on vcDNA: vcDNA=SeqID_6419; Strand=+; Position=1-183
  misc_feature (4)..(11): Xaa can be any naturally occurring amino acid
PPPXXXXXXXXQVNLETKMRASEQETSSSSQSWSEHDGYQDSIYSWMPTSLEPLVTPLTS

SEQ ID NO: 26723 - protein, 319 aa, Diabrotica virgifera
  misc_feature: Coding regions on vcDNA: vcDNA=SeqID_6420; Strand=+; Position=2-958
  misc_feature: Homolog annotation: Hit_ID=BAA91404.1; Match level="QueryCoverage =52%, HitCoverage=28%, E-value=3e-12, Identity=30%"; Hit description =unnamed protein product [Homo sapiens]
  misc_feature: Pfam annotation: Pfam_ID=DUF643; Match level="Score=-37.8, E-value =0.026, Copies=1"; Pfam description=Protein of unknown function (DUF643)
  misc_feature (289)..(289): Xaa can be any naturally occurring amino acid
  misc_feature (298)..(298): Xaa can be any naturally occurring amino acid
  misc_feature (313)..(313): Xaa can be any naturally occurring amino acid
LQQETCSNSARQNEKAQNEASSDSEINEDSPKVSKKRKKKHKKSDKNKKSGIVKHNILENEIFKIETKGARELISVNTISRPSAPIYQVKFFLGNTNYKKCKSKNKFKRYYKHLSHEPEVKEDIITQKNVNQIGFAPRDEHFTGFKQEQELSEKTGFFNSYLTGKPEDINVWLEYINFQDTVHQFEKSYRKGSIAKAQRVLGERKLSILDKALISNPNSEKLHRERLNIAVVTFPSDELQIYLRDLVEKDKSNIILWQGYIEATQCSMSHCSTPESISLYTKCLSTLHXLRRTNIMEXHLLEECILKMLYQCXLFLKQA

SEQ ID NO: 26724 - protein, 199 aa, Diabrotica virgifera
  misc_feature: Coding regions on vcDNA: vcDNA=SeqID_6421; Strand=+; Position=116-712
  misc_feature: Homolog annotation: Hit_ID=XP_308304.1; Match level="QueryCoverage =76%, HitCoverage=35%, E-value=2e-52, Identity=65%"; Hit description =ENSANGP00000010750 [Anopheles gambiae]
  misc_feature: Gene Ontology Annotation: Molecular function=molecular_function unknown; Cellular component=cellular_component unknown; Biological process=biological_process unknown
  misc_feature: Pfam annotation: Pfam_ID=DUF171; Match level="Score=-97.7, E-value =0.006, Copies=1"; Pfam description=Uncharacterized ACR, COG2106
MAPTTAPVKKQSWSEKEQNLVKKLEKKKRKEAVDNKLKESNVTVGNISTLSIAVPGSILENAQSQELRTYLAGQIARAACIFQVDEIIVFDDYGDEASAKKSNLDSDAGNVTARHSCIQLGRILQYLECPQYLRKHFFPIHNDLKFCGLLNPLNAPHHLGPKEEFLFREGVVLNKPAKSGSFVNVGLLKEAHVDKLLTP

SEQ ID NO: 26725 - protein, 259 aa, Diabrotica virgifera
  misc_feature: Coding regions on vcDNA: vcDNA=SeqID_6422; Strand=+; Position=1-777
  misc_feature (4)..(13): Xaa can be any naturally occurring amino acid
  misc_feature (67)..(259): Xaa can be any naturally occurring amino acid
LKAXXXXXXXXXXHPSAMLGAVARATSSLLAGKSIEKVGSESLKIVSSYNVQKRDFAAKAAAGKAQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 26726 - protein, 95 aa, Diabrotica virgifera
  misc_feature: Coding regions on vcDNA: vcDNA=SeqID_6423; Strand=-; Position=378-667
  misc_feature (27)..(27): Xaa can be any naturally occurring amino acid
  misc_feature (35)..(35): Xaa can be any naturally occurring amino acid
  misc_feature (37)..(37): Xaa can be any naturally occurring amino acid
  misc_feature (48)..(48): Xaa can be any naturally occurring amino acid
  misc_feature (68)..(68): Xaa can be any naturally occurring amino acid
MRKHNRWSQCLTHRRDSKNIWRSRRTXIVRSLIKXIXEEENMTKDWTXALIYPIYKKGDILACENYRXDTLFDTYYKILAQSTLTNPVGWGILWY

SEQ ID NO: 26727 - protein, 204 aa, Diabrotica virgifera
  misc_feature: Coding regions on vcDNA: vcDNA=SeqID_6424; Strand=+; Position=1-615
  misc_feature: Homolog annotation: Hit_ID=EAL30409.1; Match level="QueryCoverage =96%, HitCoverage=57%, E-value=2e-77, Identity=67%"; Hit description =GA19900-PA [Drosophila pseudoobscura]
  misc_feature: Gene Ontology Annotation: Biological process=growth
KVAYQEAEKRVWMAEQKAEAYKKKQEELRQQYEKEQDLHDNKAMLSKESKDKLSISFMYEPPPGARKEREREDNEPEYKFEWQRKYNAPRESYCKGDQEIRDQPFGIQVRNVRCIKCHKWGHINTDKECPMYSLSMSAARSLENATVMDQKSLEQQMLDDGLALKKQHVNTVETNKHLLVSEDEDANEETPFLKSLYQEAQKKL

SEQ ID NO: 26728 - protein, 43 aa, Diabrotica virgifera
  misc_feature: Coding regions on vcDNA: vcDNA=SeqID_6425; Strand=-; Position=3-131
IGGMPDELLCPLLDDWRTVNWSEYHPERIIGKNNRWGFVTTNP

SEQ ID NO: 26729 - protein, 47 aa, Diabrotica virgifera
  misc_feature: Coding regions on vcDNA: vcDNA=SeqID_6426; Strand=+; Position=2-145
GLLFEGRDKEGPILLGGFFRAQLYLAWLLTHYFTALHLQAYCFFNFI

SEQ ID NO: 26730 - protein, 240 aa, Diabrotica virgifera
  misc_feature: Coding regions on vcDNA: vcDNA=SeqID_6427; Strand=+; Position=89-809
  misc_feature: Homolog annotation: Hit_ID=NP_476772.1; Match level="QueryCoverage =92%, HitCoverage=49%, E-value=1e-119, Identity=95%"; Hit description= CG1913-PA [Drosophila melanogaster] gb|EAL28889.1| GA15128-PA [Drosophila
  misc_feature: Gene Ontology Annotation: Molecular function=GTP binding; Cellular component=microtubule; Biological process=microtubule-based process
  misc_feature: Pfam annotation: Pfam_ID=Tubulin; Match level="Score=203.8, E-value =3.4e-58, Copies=1"; Pfam description=Tubulin/FtsZ family, GTPase domain
  misc_feature (103)..(110): Xaa can be any naturally occurring amino acid
  misc_feature (235)..(235): Xaa can be any naturally occurring amino acid
FCFICGISVHVAQAGVQIGNAANNYARGHYTIGKEIVDLVLDRIRKLADQCTGLQGFLIFHSFGGGTGSGFTSLLMERLSVDYGKKSKLEFAIYPAPQVSTAXXXXXXXXLTTHTTLEHSDCAFMVDNEAIYDICRRNLDIERPTYTNLNRLIGQIVSSITASLRFDGALNVDLTEFQTNLVPYPRIHFPLVTYAPVISAEKAYHEQLSVAEITNACFEPANQMVKCDPRHGKYXACCML

SEQ ID NO: 26731 - protein, 22 aa, Diabrotica virgifera
  misc_feature: Coding regions on vcDNA: vcDNA=SeqID_6428; Strand=-; Position=0-65
KFLIPADIKDGYIVFTCFEFRG

SEQ ID NO: 26732 - protein, 66 aa, Diabrotica virgifera
  misc_feature: Coding regions on vcDNA: vcDNA=SeqID_6429; Strand=+; Position=48-248
LPRGCDFLTSSIKHTNAVHWTDPSFEMMARAWPCHMNNLDFNPAVLILKIITKKSTPNTLTLYYIP

SEQ ID NO: 26733 - protein, 150 aa, Diabrotica virgifera
  misc_feature: Coding regions on vcDNA: vcDNA=SeqID_6430; Strand=+; Position=818-1267
  misc_feature (81)..(99): Xaa can be any naturally occurring amino acid
  misc_feature (104)..(111): Xaa can be any naturally occurring amino acid
  misc_feature (124)..(131): Xaa can be any naturally occurring amino acid
ILKIGNRPVSRFFLPGGPFKMELIFFPLYENLKIWLGSAPISNTSKSFYGILPENFQLSTSLKGGTLKTNLLKIFFPYFYXXXXXXXXXXXXXXXXXXXVFFKXXXXXXXXLLFPHNLSLNFSXXXXXXXXLPSPLSFTTGGEPNNIFVI

SEQ ID NO: 26734 - protein, 167 aa, Diabrotica virgifera
  misc_feature: Coding regions on vcDNA: vcDNA=SeqID_6431; Strand=+; Position=147-647
  misc_feature: Homolog annotation: Hit_ID=EAL31547.1; Match level="QueryCoverage =97%, HitCoverage=25%, E-value=9e-28, Identity=42%"; Hit description =GA17626-PA [Drosophila pseudoobscura]
  misc_feature (160)..(165): Xaa can be any naturally occurring amino acid
MDGGPSDFPFEEQPTGKRWDPLGAPDLKKFGDDCGLNDQEVLEKIRTLEEEQELLNSSLFALTTHFAQVQFRLRQVVNAPSEDKEELLKSLEEFAFRGIPDVGHVQEHIDEASLADAVRLRRSQQKELIDKLKSQLRELEQYAFENGEAGIPQDMVLERXXXXXXEL

SEQ ID NO: 26735 - protein, 146 aa, Diabrotica virgifera
  misc_feature: Coding regions on vcDNA: vcDNA=SeqID_6432; Strand=+; Position=232-672
  misc_feature (3)..(12): Xaa can be any naturally occurring amino acid
  misc_feature (14)..(31): Xaa can be any naturally occurring amino acid
  misc_feature (44)..(52): Xaa can be any naturally occurring amino acid
  misc_feature (55)..(67): Xaa can be any naturally occurring amino acid
  misc_feature (81)..(91): Xaa can be any naturally occurring amino acid
  misc_feature (103)..(109): Xaa can be any naturally occurring amino acid
SLXXXXXXXXXXRXXXXXXXXXXXXXXXXXXMQGWMKTTLSIFXXXXXXXXXQKXXXXXXXXXXXXXFMKLLIPFFDISFXXXXXXXXXXXLKTNSTFFTSLXXXXXXXPQPFLIITINLPSKDNRRNFYWRVPIHNKDCDLPEGI

SEQ ID NO: 26736 - protein, 25 aa, Diabrotica virgifera
  misc_feature: Coding regions on vcDNA: vcDNA=SeqID_6433; Strand=-; Position=1-75
GGPIGGVRRCQPGVVNLDPFERPPF

SEQ ID NO: 26737 - protein, 275 aa, Diabrotica virgifera
  misc_feature: Coding regions on vcDNA: vcDNA=SeqID_6434; Strand=+; Position=1-828
  misc_feature: Homolog annotation: Hit_ID=XP_317850.1; Match level="QueryCoverage =94%, HitCoverage=32%, E-value=2e-23, Identity=28%"; Hit description =ENSANGP00000014482 [Anopheles gambiae]
GPWVEDNDDLDKNLKSKYSNLCDLCGPEKCNVNYKTPFNDSLNCLESGGDVAVTSLSRALVFLNKSTNADRYQYLCPNGTISTTIPCVWTKQLNRLIVTGRTRVNEVSDYLKKNLPANTAFASQSLGMLPIKDSLLELLKMKSTDKINYLPDTSLSKHVAGIRSIPSLSNNTRCKEVVNWCTLNDKEQQKCKWFAQAALNVGLEPVVDCKQSSDNDTVSCLIDLQNNKSDVMYSDVTYGYIALKKGLQPIAYPETFKTNISYVVIAVKNAQALRS

SEQ ID NO: 26738 - protein, 58 aa, Diabrotica virgifera
  misc_feature: Coding regions on vcDNA: vcDNA=SeqID_6435; Strand=+; Position=40-216
AVPQLELPLFQCSHISRFVRLDTVRLLTNFQLTFINQIFFGTRDPGSRSNMQNEHLWV

SEQ ID NO: 26739 - protein, 70 aa, Diabrotica virgifera
  misc_feature: Coding regions on vcDNA: vcDNA=SeqID_6436; Strand=+; Position=1-210
  misc_feature (3)..(67): Xaa can be any naturally occurring amino acid
IIXXXXXXXXXXXXXXXXXXXXXXXXXXXXXXXXXXXXXXXXXXXXXXXXXXXXXXXXXXXXXXXXXIFL

SEQ ID NO: 26740 - protein, 236 aa, Diabrotica virgifera
  misc_feature: Coding regions on vcDNA: vcDNA=SeqID_6437; Strand=+; Position=2-712
  misc_feature: Homolog annotation: Hit_ID=XP_395334.1; Match level="QueryCoverage =98%, HitCoverage=58%, E-value=2e-30, Identity=35%"; Hit description =similar to SRp25 nuclear protein [Apis mellifera]
  misc_feature: Gene Ontology Annotation: Molecular function=protein binding; Cellular component=nucleolus; Biological process=nucleobase, nucleoside, nucleotide and nucleic acid metabolism
  misc_feature (127)..(133): Xaa can be any naturally occurring amino acid
KQQTHRNIEKTKGKRKRKADTSDSEEEQLENKRKKRHKEESTSSSSPSSSCSSSSSSSSTTDTSCSDEEASQKKIKTKVRKKRKSSPSTSSTSSSSELSEEELNSKKKKKVLTKKRPRKQSSSSSTXXXXXXXSLSSDDKSKKPSKTSSKKKKPKQEDESMDIPISLMEKSKAMAPMTKEEWDKNQSTVKRVFDESTGRLRLIKGNGEVLEEIVSKDRHKENQQMATQGDGEYFPK

SEQ ID NO: 26741 - protein, 171 aa, Diabrotica virgifera
  misc_feature: Coding regions on vcDNA: vcDNA=SeqID_6438; Strand=+; Position=326-841
  misc_feature: Homolog annotation: Hit_ID=XP_319416.1; Match level="QueryCoverage =93%, HitCoverage=23%, E-value=4e-63, Identity=75%"; Hit description =ENSANGP00000002842 [Anopheles gambiae]
  misc_feature: Gene Ontology Annotation: Molecular function=biotin binding; Cellular component=mitochondrial matrix; Biological process=biotin metabolism
  misc_feature: Pfam annotation: Pfam_ID=CPSase_L_chain; Match level="Score=40.0, E -value=7e-09, Copies=1"; Pfam description=Carbamoyl-phosphate synthase L chain,
FFLRFSNFVHKADEAYRIGPATASQSYLRGDKLLEVAKKSGSQAIHPGYGFLSENVEFAERCQKEGIIFIGPPSSAIKDMGIKSTSKAIMSAAGVPIVEGYHGEDQSIETLKKEAKRIGFPVMIKAVRGGGGKGMRIALTEEDFEEALESAKTESQKAFADSGILLKKVGY

SEQ ID NO: 26742 - protein, 57 aa, Diabrotica virgifera
  misc_feature: Coding regions on vcDNA: vcDNA=SeqID_6439; Strand=+; Position=2-175
GCFPCCPFFAMRFKYAKNLAHAREPNNLVNMNVFKARFTLITASSTIRYPLLFIWKV

SEQ ID NO: 26743 - protein, 84 aa, Diabrotica virgifera
  misc_feature: Coding regions on vcDNA: vcDNA=SeqID_6440; Strand=-; Position=2-253
  misc_feature (32)..(37): Xaa can be any naturally occurring amino acid
GESGLSDLGCSSLGRIAWRLDLLAAQQHFHKXXXXXXFCTYSVHVAFIKLLPEENLVFGSVVPGTRSYVFPNAWYRPRKGQFYL

SEQ ID NO: 26744 - protein, 48 aa, Diabrotica virgifera
  misc_feature: Coding regions on vcDNA: vcDNA=SeqID_6441; Strand=+; Position=3-146
  misc_feature (17)..(26): Xaa can be any naturally occurring amino acid
AQGVNIQLGTPTGGKNXXXXXXXXXXVFPKGLRPFLKVFVYWGGGIFS

SEQ ID NO: 26745 - protein, 124 aa, Diabrotica virgifera
  misc_feature: Coding regions on vcDNA: vcDNA=SeqID_6442; Strand=+; Position=51-422
KKHILKTEVRLSAKVSVMNYAPFLASQLGIQGVKKEQRQFFVNIIGSTAEHRRNHNVRREDSLQLTTNLLDPPEDGADHLTFRPCRQPTSPSLLAAPSSTSSSATMTAALCGPREPCRIGRHTS

SEQ ID NO: 26746 - protein, 102 aa, Diabrotica virgifera
  misc_feature: Coding regions on vcDNA: vcDNA=SeqID_6443; Strand=-; Position=0-305
  misc_feature (1)..(1): Xaa can be any naturally occurring amino acid
  misc_feature (6)..(6): Xaa can be any naturally occurring amino acid
  misc_feature (22)..(22): Xaa can be any naturally occurring amino acid
  misc_feature (40)..(41): Xaa can be any naturally occurring amino acid
  misc_feature (54)..(54): Xaa can be any naturally occurring amino acid
  misc_feature (57)..(57): Xaa can be any naturally occurring amino acid
  misc_feature (65)..(65): Xaa can be any naturally occurring amino acid
  misc_feature (73)..(74): Xaa can be any naturally occurring amino acid
  misc_feature (76)..(76): Xaa can be any naturally occurring amino acid
XSFYSXSNNLKLLTYSPFLSFXLIFLFLFHLLSFLFLFLXXFLSFSPHLLFLYXSLXFFRGKSSXLTIFSILXXFXFPHPPLLFLWDRRGKYPRAGGAFMYG

SEQ ID NO: 26747 - protein, 83 aa, Diabrotica virgifera
  misc_feature: Coding regions on vcDNA: vcDNA=SeqID_6444; Strand=-; Position=2-250
QSYTGPSRVLTFPCSFHDRVVLKKTRKRRSIFTLKHVCISRRLTLKCALVCERTSHIKLSQIRVKLALILFYFNYLSQVTPNM

SEQ ID NO: 26748 - protein, 88 aa, Diabrotica virgifera
  misc_feature: Coding regions on vcDNA: vcDNA=SeqID_6445; Strand=+; Position=968-1231
  misc_feature (10)..(28): Xaa can be any naturally occurring amino acid
  misc_feature (46)..(59): Xaa can be any naturally occurring amino acid
  misc_feature (72)..(88): Xaa can be any naturally occurring amino acid
LFKLGLSKLXXXXXXXXXXXXXXXXXXXILTTYFFKVIPPFLGFAXXXXXXXXXXXXXXGFPKSLPQKNTHXXXXXXXXXXXXXXXXX

SEQ ID NO: 26749 - protein, 306 aa, Diabrotica virgifera
  misc_feature: Coding regions on vcDNA: vcDNA=SeqID_6446; Strand=+; Position=2-919
  misc_feature: Homolog annotation: Hit_ID=CAG32060.1; Match level="QueryCoverage =98%, HitCoverage=29%, E-value=1e-118, Identity=67%"; Hit description= hypothetical protein [Gallus gallus]
  misc_feature: Gene Ontology Annotation: Molecular function=molecular_function unknown; Cellular component=nucleus; Biological process=biological _process unknown
  misc_feature (274)..(274): Xaa can be any naturally occurring amino acid
  misc_feature (293)..(293): Xaa can be any naturally occurring amino acid
KDSGAATGRTLHEVTLNESIRYKPGDDVETWLVKLLCLDSTSVSPILSGCPPPDSCDLYYINRDTLFCYHKASEEFLQRLVALYVASHYKNTPNDLQMMSDAPAHHLFCLLGPVDPKKRTLPEVLVIIQVCLEGEISKNSILDGFSRGKRAAGDLIPWTIGQQYQDADFPKLAGARIVRIATHPDYQGMGYGARALDILKQYYEFKIPSLDEDSQLPKQEIDNVEDSEVGLLEETVEPRNSLPPLLFKLSERPPEKLDYLGVSFGLTDQLMKFXKKAGYIPVYLRQTTNDLTXGEHSCIMVNGVNT

SEQ ID NO: 26750 - protein, 59 aa, Diabrotica virgifera
  misc_feature: Coding regions on vcDNA: vcDNA=SeqID_6447; Strand=-; Position=38-217
  misc_feature (10)..(16): Xaa can be any naturally occurring amino acid
SCGYCDIQGXXXXXXXHFSPTFSQFDLYITYSGFYNRTFEIKTMNLKYFIVYLFQILLP

SEQ ID NO: 26751 - protein, 166 aa, Diabrotica virgifera
  misc_feature: Coding regions on vcDNA: vcDNA=SeqID_6448; Strand=+; Position=151-649
  misc_feature: Homolog annotation: Hit_ID=CAH90775.1; Match level="QueryCoverage =61%, HitCoverage=56%, E-value=1e-25, Identity=56%"; Hit description =hypothetical protein [Pongo pygmaeus]
  misc_feature: Gene Ontology Annotation: Molecular function=aminopeptidase activity; Cellular component=cellular_component unknown; Biological process =proteolysis and peptidolysis
  misc_feature (19)..(25): Xaa can be any naturally occurring amino acid
  misc_feature (72)..(72): Xaa can be any naturally occurring amino acid
MSPPKSTTKLLQQLRALMXXXXXXXEPISAYIVPSSDAHNSEYLAECDEYRAFITGFTGSAGTAIITDKEAXLWTDGRYYFTKPVSSWISNWELMKEGLAQPTPPPRAIGFLRNLNNKDPKEGVDSKRNIPKGKFQPLFKFQNLEALGPTKLGSPIGYRIFIKNWI

SEQ ID NO: 26752 - protein, 79 aa, Diabrotica virgifera
  misc_feature: Coding regions on vcDNA: vcDNA=SeqID_6449; Strand=+; Position=2-241
  misc_feature (15)..(22): Xaa can be any naturally occurring amino acid
FVRAEIKKIADAITXXXXXXXXWRRIYLLYVSVSLTSELKTTKKHRRKYRRLLFTGDPCHWTIHLCCIFDPLKVIRESR

SEQ ID NO: 26753 - protein, 160 aa, Diabrotica virgifera
  misc_feature: Coding regions on vcDNA: vcDNA=SeqID_6450; Strand=+; Position=710-1192
  misc_feature (14)..(20): Xaa can be any naturally occurring amino acid
  misc_feature (22)..(29): Xaa can be any naturally occurring amino acid
  misc_feature (49)..(56): Xaa can be any naturally occurring amino acid
  misc_feature (69)..(74): Xaa can be any naturally occurring amino acid
  misc_feature (77)..(84): Xaa can be any naturally occurring amino acid
  misc_feature (112)..(125): Xaa can be any naturally occurring amino acid
  misc_feature (132)..(138): Xaa can be any naturally occurring amino acid
  misc_feature (143)..(158): Xaa can be any naturally occurring amino acid
NHSVKQNLPKTRRXXXXXXXNXXXXXXXXPDRRKTKKHNMILITDNTFXXXXXXXXKMAPNFQRPKLKXXXXXXGVXXXXXXXXGKMGNFLPLAPNTTGFFPKKHTPGGKFXXXXXXXXXXXXXXKFFSPQXXXXXXXSSYYXXXXXXXXXXXXXXXXLF

SEQ ID NO: 26754 - protein, 171 aa, Diabrotica virgifera
  misc_feature: Coding regions on vcDNA: vcDNA=SeqID_6451; Strand=+; Position=7-522
  misc_feature: Homolog annotation: Hit_ID=XP_396263.1; Match level="QueryCoverage =68%, HitCoverage=14%, E-value=2e-28, Identity=55%"; Hit description =similar to ENSANGP00000024503 [Apis mellifera]
  misc_feature: Gene Ontology Annotation: Molecular function=transporter activity; Cellular component=cytoplasm; Biological process=negative regulation of locomotion
  misc_feature (77)..(77): Xaa can be any naturally occurring amino acid
  misc_feature (118)..(118): Xaa can be any naturally occurring amino acid
  misc_feature (135)..(135): Xaa can be any naturally occurring amino acid
  misc_feature (146)..(146): Xaa can be any naturally occurring amino acid
AQTRRADKKSTFFTATTPTTTRRPPRRGDQKKQRTKFLERRTGKNPLKTGRTTRSEETDLAQLFVQPQASYYAISEXRETGCAQFTDIHDEVNAFQTKLVNEVRRCDESERQLRYIEXEVRKDDVHFPDVNELPXTSNPRELIDFXAPLEHTDRDIKNLSESGVALMTISL

SEQ ID NO: 26755 - protein, 92 aa, Diabrotica virgifera
  misc_feature: Coding regions on vcDNA: vcDNA=SeqID_6452; Strand=-; Position=2-280
  misc_feature (1)..(7): Xaa can be any naturally occurring amino acid
  misc_feature (23)..(30): Xaa can be any naturally occurring amino acid
  misc_feature (34)..(51): Xaa can be any naturally occurring amino acid
  misc_feature (53)..(62): Xaa can be any naturally occurring amino acid
  misc_feature (68)..(74): Xaa can be any naturally occurring amino acid
  misc_feature (76)..(87): Xaa can be any naturally occurring amino acid
XXXXXXXERLMIMLRWRGQDTAXXXXXXXXGRGXXXXXXXXXXXXXXXXXXAXXXXXXXXXXLNIEFXXXXXXXVXXXXXXXXXXXXEIYEE

SEQ ID NO: 26756 - protein, 49 aa, Diabrotica virgifera
  misc_feature: Coding regions on vcDNA: vcDNA=SeqID_6453; Strand=+; Position=1-147
  misc_feature (8)..(16): Xaa can be any naturally occurring amino acid
LIIKILFXXXXXXXXXQESVVNFSYRIFMYEAELLQDSDLLIGNRPNFI

SEQ ID NO: 26757 - protein, 95 aa, Diabrotica virgifera
  misc_feature: Coding regions on vcDNA: vcDNA=SeqID_6454; Strand=+; Position=2-289
  misc_feature (1)..(59): Xaa can be any naturally occurring amino acid
  misc_feature (83)..(89): Xaa can be any naturally occurring amino acid
XXXXXXXXXXXXXXXXXXXXXXXXXXXXXXXXXXXXXXXXXXXXXXXXXXXXXXXXXXXWDNTGIFIWKIQNHNKKLQPPCLXXXXXXXVKTILF

SEQ ID NO: 26758 - protein, 69 aa, Diabrotica virgifera
  misc_feature: Coding regions on vcDNA: vcDNA=SeqID_6455; Strand=+; Position=2-211
MIDDDVPPRFAVNPDQTTEIVMEDSLEPSVLKVSYNSYDPQESFSAEGGLAIDYSVKQHSEDPPRLPLN

SEQ ID NO: 26759 - protein, 47 aa, Diabrotica virgifera
  misc_feature: Coding regions on vcDNA: vcDNA=SeqID_6456; Strand=+; Position=3-146
  misc_feature (1)..(15): Xaa can be any naturally occurring amino acid
  misc_feature (17)..(24): Xaa can be any naturally occurring amino acid
XXXXXXXXXXXXXXXRXXXXXXXXDRNQPGSHRFKLRSCKILKVEQT

SEQ ID NO: 26760 - protein, 139 aa, Diabrotica virgifera
  misc_feature: Coding regions on vcDNA: vcDNA=SeqID_6457; Strand=+; Position=404-823
  misc_feature (67)..(87): Xaa can be any naturally occurring amino acid
QRYTANYRVYPFNVLFNDDMVNLALKYLRLATKRNNTKLDIWFISQCLNHKVIPNFCRVKTSKNVPXXXXXXXXXXXXXXXXXXXXXKLNYLNCQLKVMYDSLLEIIGFININNFMSDVQDKVEISNSIKFNRVNNKFN

SEQ ID NO: 26761 - protein, 91 aa, Diabrotica virgifera
  misc_feature: Coding regions on vcDNA: vcDNA=SeqID_6458; Strand=-; Position=125-400
YRRKKKPAKFSLFLFSFNVGEPLFASPGTSPGHFIYFNAANSEGRELQRFATNLTTKVSILNITSTFDGARYAPTFRRKSGELSPMATSGG

SEQ ID NO: 26762 - protein, 264 aa, Diabrotica virgifera
  misc_feature: Coding regions on vcDNA: vcDNA=SeqID_6459; Strand=-; Position=275-1069
  misc_feature (2)..(23): Xaa can be any naturally occurring amino acid
  misc_feature (26)..(82): Xaa can be any naturally occurring amino acid
  misc_feature (84)..(119): Xaa can be any naturally occurring amino acid
  misc_feature (122)..(215): Xaa can be any naturally occurring amino acid
KXXXXXXXXXXXXXXXXXXXXXXFKXXXXXXXXXXXXXXXXXXXXXXXXXXXXXXXXXXXXXXXXXXXXXXXXXXXXXXXXXSXXXXXXXXXXXXXXXXXXXXXXXXXXXXXXXXXXXXKYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFYFVYFIITQTLLNTSITLFSINGNVVFQAMPSTRFQFDCDVGVVNSTI

SEQ ID NO: 26763 - protein, 100 aa, Diabrotica virgifera
  misc_feature: Coding regions on vcDNA: vcDNA=SeqID_6460; Strand=-; Position=1-300
  misc_feature (1)..(9): Xaa can be any naturally occurring amino acid
  misc_feature (11)..(40): Xaa can be any naturally occurring amino acid
  misc_feature (44)..(59): Xaa can be any naturally occurring amino acid
  misc_feature (67)..(73): Xaa can be any naturally occurring amino acid
  misc_feature (91)..(98): Xaa can be any naturally occurring amino acid
XXXXXXXXXVXXXXXXXXXXXXXXXXXXXXXXXXXXXXXXTKKXXXXXXXXXXXXXXXXCGPPLLEXXXXXXXWPHPHPAARPGGEPPPPXXXXXXXXRG

SEQ ID NO: 26764 - protein, 107 aa, Diabrotica virgifera
  misc_feature: Coding regions on vcDNA: vcDNA=SeqID_6461; Strand=+; Position=246-569
KFMLREKTENCLLRVCEKCQETVITYKDHDKNKPVKYYKWSTKKEGYYDPKSNTSKTTIKTIKLLVPITLGSLINEFESKLTAFLAHEARICHQFRALRSNCHRNLS

SEQ ID NO: 26765 - protein, 63 aa, Diabrotica virgifera
  misc_feature: Coding regions on vcDNA: vcDNA=SeqID_6462; Strand=-; Position=302-493
LFIEGFYNPFRGCSSRLMINDDDDFLPLYRCFILVTMAIYSNCLRACSMSKSVFLKTFSAHTI

SEQ ID NO: 26766 - protein, 133 aa, Diabrotica virgifera
  misc_feature: Coding regions on vcDNA: vcDNA=SeqID_6463; Strand=+; Position=66-468
  misc_feature: Homolog annotation: Hit_ID=XP_392332.1; Match level="QueryCoverage =62%, HitCoverage=4%, E-value=5e-12, Identity=48%"; Hit description =similar to CG13598-PB [Apis mellifera]
  misc_feature (75)..(75): Xaa can be any naturally occurring amino acid
MVLIKNNIFSYLLENKSVMGGSQEDIQVPPKVFTNEGMPPVTVSPMVTTVTSSVGTVIPIVDQQVLGQQAASVNXFQHPSVLQPGVTIDMDGVPVDPNLQLPQFVTGNLIQQPIQIDHSDTRRGTTTTVVGPD

SEQ ID NO: 26767 - protein, 22 aa, Diabrotica virgifera
  misc_feature: Coding regions on vcDNA: vcDNA=SeqID_6464; Strand=+; Position=1-66
IRGRVWVGLARYSVREIPGGDP

SEQ ID NO: 26768 - protein, 173 aa, Diabrotica virgifera
  misc_feature: Coding regions on vcDNA: vcDNA=SeqID_6465; Strand=-; Position=66-587
  misc_feature (25)..(30): Xaa can be any naturally occurring amino acid
  misc_feature (67)..(97): Xaa can be any naturally occurring amino acid
  misc_feature (99)..(122): Xaa can be any naturally occurring amino acid
  misc_feature (126)..(148): Xaa can be any naturally occurring amino acid
  misc_feature (155)..(161): Xaa can be any naturally occurring amino acid
TPGPPAPVLNPPNHGKNLKKGETGXXXXXXVSPTNYKLLIPPRGGPNFYFLGWNFPQKKLPLFSLKXXXXXXXXXXXXXXXXXXXXXXXXXXXXXXXPXXXXXXXXXXXXXXXXXXXXXXXXGSLXXXXXXXXXXXXXXXXXXXXXXXHQPSSHXXXXXXXCYLARQNTAPFK

SEQ ID NO: 26769 - protein, 36 aa, Diabrotica virgifera
  misc_feature: Coding regions on vcDNA: vcDNA=SeqID_6466; Strand=-; Position=65-175
NASGKSFILSRECSLNYSARISSIELLNQHITSRVS

SEQ ID NO: 26770 - protein, 64 aa, Diabrotica virgifera
  misc_feature: Coding regions on vcDNA: vcDNA=SeqID_6467; Strand=-; Position=5-199
  misc_feature (45)..(54): Xaa can be any naturally occurring amino acid
GMRLSRFLPRPANSTPQAKSLNSGAAPVQLSRLIPPYLLLLPLEXXXXXXXXXXEYLCIFSRIF

SEQ ID NO: 26771 - protein, 139 aa, Diabrotica virgifera
  misc_feature: Coding regions on vcDNA: vcDNA=SeqID_6468; Strand=+; Position=59-475
  misc_feature: Homolog annotation: Hit_ID=EAL33574.1; Match level="QueryCoverage =95%, HitCoverage=3%, E-value=1e-14, Identity=36%"; Hit description =GA16365-PA [Drosophila pseudoobscura]
  misc_feature (9)..(10): Xaa can be any naturally occurring amino acid
  misc_feature (17)..(17): Xaa can be any naturally occurring amino acid
  misc_feature (20)..(20): Xaa can be any naturally occurring amino acid
  misc_feature (53)..(53): Xaa can be any naturally occurring amino acid
  misc_feature (70)..(70): Xaa can be any naturally occurring amino acid
  misc_feature (74)..(74): Xaa can be any naturally occurring amino acid
  misc_feature (96)..(96): Xaa can be any naturally occurring amino acid
  misc_feature (100)..(100): Xaa can be any naturally occurring amino acid
  misc_feature (109)..(109): Xaa can be any naturally occurring amino acid
  misc_feature (115)..(115): Xaa can be any naturally occurring amino acid
  misc_feature (117)..(117): Xaa can be any naturally occurring amino acid
  misc_feature (119)..(120): Xaa can be any naturally occurring amino acid
  misc_feature (123)..(124): Xaa can be any naturally occurring amino acid
  misc_feature (130)..(132): Xaa can be any naturally occurring amino acid
GEGTRRKKXXKTAASSXTSXEFGKQRHDPRNNESEATETEAEAEEGTEPEERXRTRPDRAKDKEQKPREXSEAXRSQRPRSTKRNRAQQDNDRGRXEKGXQGAEGTQKXQKNPPXNXEXXEEXXQDHREXXXDQDSHKS

SEQ ID NO: 26772 - protein, 230 aa, Diabrotica virgifera
  misc_feature: Coding regions on vcDNA: vcDNA=SeqID_6469; Strand=+; Position=8-697
  misc_feature: Homolog annotation: Hit_ID=NP_726072.1; Match level="QueryCoverage =68%, HitCoverage=75%, E-value=1e-33, Identity=49%"; Hit description =CG10497-PC, isoform C [Drosophila melanogaster] ref|NP_726071.1| CG10497-PB, isoform B [Drosophila
  misc_feature: Gene Ontology Annotation: Cellular component=integral to membrane
  misc_feature: Pfam annotation: Pfam_ID=Syndecan; Match level="Score=-55.2, E-value =0.00075, Copies=1"; Pfam description=Syndecan domain
  misc_feature (45)..(50): Xaa can be any naturally occurring amino acid
WVVFFVVPYYYCYYYLSYSKYKFKDCRLLVMYFRIQRLLFLAVLXXXXXXAQNNQRSSSDITFKDEDSAIEGSGYNGEVTHDLESSGSGFGPDDEDDHDNDKQDRIIEPKISPPQEPSFPRNIPELETEKDKDKETKGSPNTTLDPTVRMNSNDRPTSFFTQPGMMAAVVGGAVVGLLCAILVVMFIVYRMRKKDEGSYAVGDPKQSPNSNSYSRATTNKKFFCLKVALL

SEQ ID NO: 26773 - protein, 157 aa, Diabrotica virgifera
  misc_feature: Coding regions on vcDNA: vcDNA=SeqID_6470; Strand=+; Position=178-648
TDIMMSGPLLGIQLKMSTLKLMSEQLLNKQSQKRCQENQKLKETKKVVVFLESLKRNQNLSKEISTDEIESIKPDLKDSGEIIITKVTTTITNISPEQTKSIVVRKQQLKQLDARQQFSLNFANLKSIHDVTTSSFQENPFIKQSQVISSNLCLKQK

SEQ ID NO: 26774 - protein, 123 aa, Diabrotica virgifera
  misc_feature: Coding regions on vcDNA: vcDNA=SeqID_6471; Strand=+; Position=384-755
  misc_feature (22)..(28): Xaa can be any naturally occurring amino acid
  misc_feature (43)..(43): Xaa can be any naturally occurring amino acid
  misc_feature (80)..(92): Xaa can be any naturally occurring amino acid
WSAPHSTPLHCIPLCLGFSILXXXXXXXSITSKLLPKNNIDNXILSISKICQSVIIMLLREIQSVRNTFCLYHHVLQMLXXXXXXXXXXXXXSNRFSCGPTGLMTVRISFFGKGSWLNGTGNL

SEQ ID NO: 26775 - protein, 216 aa, Diabrotica virgifera
  misc_feature: Coding regions on vcDNA: vcDNA=SeqID_6472; Strand=+; Position=1-648
  misc_feature (20)..(215): Xaa can be any naturally occurring amino acid
QTSGWCDFISRKYQIAALQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXS

SEQ ID NO: 26776 - protein, 277 aa, Diabrotica virgifera
  misc_feature: Coding regions on vcDNA: vcDNA=SeqID_6473; Strand=+; Position=67-900
  misc_feature: Homolog annotation: Hit_ID=AAF81410.1; Match level="QueryCoverage =75%, HitCoverage=44%, E-value=2e-37, Identity=38%"; Hit description =unknown [Drosophila melanogaster]
  misc_feature: Pfam annotation: Pfam_ID=PRE_C2HC; Match level="Score=59.7, E-value =8.3e-15, Copies=1"; Pfam description=Associated with zinc fingers
  misc_feature (31)..(31): Xaa can be any naturally occurring amino acid
  misc_feature (64)..(64): Xaa can be any naturally occurring amino acid
  misc_feature (137)..(137): Xaa can be any naturally occurring amino acid
  misc_feature (186)..(186): Xaa can be any naturally occurring amino acid
  misc_feature (198)..(198): Xaa can be any naturally occurring amino acid
SNPSQGEQHSKPPPIFIHGVQDYQKMVQKLXDVAESEEYHTKSLTNNVVKLSCGRPDTYRKMVXILMNITFYHHTYQLKQDQAYRVVIKYLHHSTNTEDIKNELLKLGHKVRNIINAQHRITKEPLNWFFVDLEPGXNSKDIYNLRGLQNRVIEIEPPRTTKNRIIQCMRCQQYGHSKSYCNKPFXCVQCGGAPSTPXKCGLCGADHPANYKGCEHFQKSSNLNYGNPYQKNGLNPGNKTNILPHPKKFTPPPNSQFRMERYPSRYRQKLYFPKFPK

SEQ ID NO: 26777 - protein, 30 aa, Diabrotica virgifera
  misc_feature: Coding regions on vcDNA: vcDNA=SeqID_6474; Strand=-; Position=1-90
WASGGYRHFLLFNRVVTVAHTHIKPLKRGG

SEQ ID NO: 26778 - protein, 68 aa, Diabrotica virgifera
  misc_feature: Coding regions on vcDNA: vcDNA=SeqID_6475; Strand=+; Position=1-204
FRPARFFYWKPLKTPLAGQIHTAIMEDNNVYHNNTKSRPHRAGDLFSKKQQSHYCEGTSSPHGPHSKI

SEQ ID NO: 26779 - protein, 46 aa, Diabrotica virgifera
  misc_feature: Coding regions on vcDNA: vcDNA=SeqID_6476; Strand=-; Position=1-138
  misc_feature (21)..(33): Xaa can be any naturally occurring amino acid
LKADHCIVAFGEGINKKHGLXXXXXXXXXXXXXIRGYFFHLDPRGD

SEQ ID NO: 26780 - protein, 214 aa, Diabrotica virgifera
  misc_feature: Coding regions on vcDNA: vcDNA=SeqID_6477; Strand=+; Position=1-645
  misc_feature: Homolog annotation: Hit_ID=AAV91017.1; Match level="QueryCoverage =92%, HitCoverage=35%, E-value=6e-52, Identity=51%"; Hit description =hemolymph proteinase 19 [Manduca sexta]
  misc_feature: Gene Ontology Annotation: Molecular function=serine-type endopeptidase activity; Cellular component=integral to plasma membrane; Biological process=Tl signaling pathway
  misc_feature: Pfam annotation: Pfam_ID=Trypsin; Match level="Score=95.6, E-value =1.3e-25, Copies=1"; Pfam description=Trypsin
GEFPWHAALYHARGIDLTYICGATLITRYHLITVAHCVTRLKTQNALSPSSLMVYLGKYYLKVWSNAGIQDRQIEKIIVHQNYNSRTFNHDIAILKLIEPAEITNYVRPACLWEDNTSLESVIGRQGTVVGWGFDETGRVTEQLTKAHMPVVSQETCIYSFPEFYSRFTSDHTYCAGFPRSGSSPNNPHLGDKGNGVHKCGVTKSIPDVIHRIM

SEQ ID NO: 26781 - protein, 116 aa, Diabrotica virgifera
  misc_feature: Coding regions on vcDNA: vcDNA=SeqID_6478; Strand=+; Position=114-461
  misc_feature (13)..(19): Xaa can be any naturally occurring amino acid
TPSLYRINYSLLXXXXXXXGNNLNTLNPCSPKRARLTSIRNCQNGSVSRVKRNTVIHRHLLRNLHTRIFTARYLGQTITNFSEKRGTSTTTCHLAQDMTTSTTTSIKMILQNRTCF

SEQ ID NO: 26782 - protein, 128 aa, Diabrotica virgifera
  misc_feature: Coding regions on vcDNA: vcDNA=SeqID_6479; Strand=-; Position=292-678
  misc_feature (49)..(53): Xaa can be any naturally occurring amino acid
KDTGDHSYEIKNSYEKNHRFFNILRKIPCNLSLSINIRIRILRCYVFSXXXXXVERWSLTEDAIKRLEAFEMWCYRRMLRVSYRVINLRDKVQYIRHYKIYEKKPLTKVTDTLNVHTLKPVRNTQGPP

SEQ ID NO: 26783 - protein, 17 aa, Diabrotica virgifera
  misc_feature: Coding regions on vcDNA: vcDNA=SeqID_6480; Strand=+; Position=2-52
TPPFWLFFFYKSISKYS

SEQ ID NO: 26784 - protein, 182 aa, Diabrotica virgifera
  misc_feature: Coding regions on vcDNA: vcDNA=SeqID_6481; Strand=+; Position=3-551
  misc_feature (15)..(21): Xaa can be any naturally occurring amino acid
RDISWQDCQEIVEVXXXXXXXMEHKFNTFSQRHWDFAVLSLVSWATNCLKFKDSYDSLQYQAILCSVVSLYVNTDNKIKELKQKDVSSSFVDEWQDVLVESIHSDLLQTWLYFADKLKDKKDIMKYIPLIQELSKLLDNINCDTIFKLSESELPKWTKFLKQGCVLLVNSQPNLQSWGYKWC

SEQ ID NO: 26785 - protein, 225 aa, Diabrotica virgifera
  misc_feature: Coding regions on vcDNA: vcDNA=SeqID_6482; Strand=+; Position=3-679
  misc_feature: Homolog annotation: Hit_ID=AAT70410.1; Match level="QueryCoverage =67%, HitCoverage=7%, E-value=2e-21, Identity=36%"; Hit description =quattro [Danio rerio] ref|NP_001004109.1| quattro [Danio rerio]
  misc_feature: Gene Ontology Annotation: Molecular function=guanyl-nucleotide exchange factor activity; Cellular component=actin cytoskeleton; Biological process=transmembrane receptor protein tyrosine phosphatase signaling pathway
  misc_feature: Pfam annotation: Pfam_ID=RhoGEF; Match level="Score=18.0, E-value =5.4e-07, Copies=1"; Pfam description=RhoGEF domain
  misc_feature (92)..(92): Xaa can be any naturally occurring amino acid
SSAVTSQESSVFDTYDEGIELGRNKEVYSSVRRETFCDDKGIVRIERVAFSDNHPFPSFVTRSESTASLKRLEYIIDEIKSTERKYVEDLAXVVKTYKPWIERHTPVELKDYHGYLFGNIDKIHRRQRKFLEDLNKCGRDVNEVVGCFIKHELLFEMYPHYFRNKPKADNLLKEFSPIIKEMQEKYGERLDFSAYLLTPVQRLGKYIFIVRTDLKNIGKIGIACG

SEQ ID NO: 26786 - protein, 185 aa, Diabrotica virgifera
  misc_feature: Coding regions on vcDNA: vcDNA=SeqID_6483; Strand=+; Position=1-558
  misc_feature (4)..(64): Xaa can be any naturally occurring amino acid
  misc_feature (68)..(83): Xaa can be any naturally occurring amino acid
  misc_feature (86)..(128): Xaa can be any naturally occurring amino acid
  misc_feature (130)..(137): Xaa can be any naturally occurring amino acid
  misc_feature (148)..(169): Xaa can be any naturally occurring amino acid
TLLXXXXXXXXXXXXXXXXXXXXXXXXXXXXXXXXXXXXXXXXXXXXXXXXXXXXXXXXXXXXXNFYXXXXXXXXXXXXXXXXFLXXXXXXXXXXXXXXXXXXXXXXXXXXXXXXXXXXXXXXXXXXXFXXXXXXXXKSSYFTICNYXXXXXXXXXXXXXXXXXXXXXXNFIMMIILYQKLRIFS

SEQ ID NO: 26787 - protein, 41 aa, Diabrotica virgifera
  misc_feature: Coding regions on vcDNA: vcDNA=SeqID_6484; Strand=-; Position=3-125
  misc_feature (24)..(39): Xaa can be any naturally occurring amino acid
LKEYLTYSYSSIQFFNKTRILHDXXXXXXXXXXXXXXXXGR

SEQ ID NO: 26788 - protein, 95 aa, Diabrotica virgifera
  misc_feature: Coding regions on vcDNA: vcDNA=SeqID_6485; Strand=+; Position=545-832
  misc_feature (56)..(63): Xaa can be any naturally occurring amino acid
LIFFCRNCPKTTHITIFELFSAKKQSHFSRYISKQIRPGLIRFYSGLGLLKQLFPXXXXXXXXWNNKEIRRGFAIRLGMKKMVLFSIKNGGTPPP

SEQ ID NO: 26789 - protein, 234 aa, Diabrotica virgifera
  misc_feature: Coding regions on vcDNA: vcDNA=SeqID_6486; Strand=+; Position=2-703
  misc_feature: Homolog annotation: Hit_ID=NP_608565.1; Match level="QueryCoverage =99%, HitCoverage=17%, E-value=8e-32, Identity=33%"; Hit description =CG4644-PA [Drosophila melanogaster] gb|AAF51421.1| CG4644-PA [Drosophila melanogaster]
GLFTSSTLTDRIDKQIRMEKDGYVTIQSIVSKAEVSDEVERHRNSLAEHYKMWEEEALKAFNRDLATLTAQRSAINMEPYIRSIPAKDCIAIIVEEAKKMSQGSETYSPTVSMLYKELGSKVYARYKIICKQKNGVLDKVTNIHKTYCSNYANTHKPLDILPEKEVTVNPRQIWQWIDHGLKKKGATIEMDHQQWAPAVLTFIGKFLYHIVMYDIQVDVNVLRNTKHKNYLPAF

SEQ ID NO: 26790 - protein, 132 aa, Diabrotica virgifera
  misc_feature: Coding regions on vcDNA: vcDNA=SeqID_6487; Strand=+; Position=681-1079
  misc_feature (17)..(23): Xaa can be any naturally occurring amino acid
EWSHNPYCKGSPNFKKXXXXXXXGIIFFSGPKLLKNISGKNKFPSSYLYFSGNLVQKFPRIKNLSLFKYVFSTKEILKPTLAIKEIFHHIPPPHLYISLLKQFLDPPCGEKQRAPPLIIILWCFFRSCDHPL

SEQ ID NO: 26791 - protein, 67 aa, Diabrotica virgifera
  misc_feature: Coding regions on vcDNA: vcDNA=SeqID_6488; Strand=+; Position=203-403
VFVPLYLETFFSQKFMFCSIIFYFCKHILHLYLYWLSLACGVIVLLIWGIISKIKMFKDCYIKIKYL

SEQ ID NO: 26792 - protein, 64 aa, Diabrotica virgifera
  misc_feature: Coding regions on vcDNA: vcDNA=SeqID_6489; Strand=+; Position=3-197
  misc_feature (3)..(30): Xaa can be any naturally occurring amino acid
  misc_feature (32)..(39): Xaa can be any naturally occurring amino acid
SSXXXXXXXXXXXXXXXXXXXXXXXXXXXXVXXXXXXXXIETNLAHTGLNSDHVNFKSRTDLII

SEQ ID NO: 26793 - protein, 120 aa, Diabrotica virgifera
  misc_feature: Coding regions on vcDNA: vcDNA=SeqID_6490; Strand=+; Position=126-488
  misc_feature: Homolog annotation: Hit_ID=NP_958907.1; Match level="QueryCoverage =100%, HitCoverage=27%, E-value=3e-50, Identity=81%"; Hit description= isocitrate dehydrogenase 1 (NADP+), soluble [Danio rerio] gb|AAH46894.1| Isocitrate
  misc_feature: Gene Ontology Annotation: Molecular function=isocitrate dehydrogenase (NADP+) activity; Cellular component=cytosol; Biological process =glutathione metabolism
TSVLISPDGKTVEAEAAHGTVTRHFRMHQQGKETSTNPIASIFAWTRGLLHRAKLDNNQELNKFAPALEQVCVETIESGSMTKDLAICIKGMSKVTREDYLETFQFIHKLAENLKKKLNA

SEQ ID NO: 26794 - protein, 138 aa, Diabrotica virgifera
  misc_feature: Coding regions on vcDNA: vcDNA=SeqID_6491; Strand=+; Position=37-453
  misc_feature: Homolog annotation: Hit_ID=XP_321341.1; Match level="QueryCoverage =44%, HitCoverage=13%, E-value=7e-25, Identity=82%"; Hit description =ENSANGP00000013266 [Anopheles gambiae]
  misc_feature: Gene Ontology Annotation: Molecular function=cytochrome c oxidase activity; Cellular component=mitochondrion; Biological process =respiratory gaseous exchange
MINLCRYCRSSSLIPTAKQLFKVNTNSLVRNGQHRLYNKSFLKPQSFSRNMLLSSFLRGSGTVSVQLSSSAPKGQNAVGYWLLTCSGMVFVAVVLGGVTRLTESGLSMVTWKLLGEKMPRTEVQWQEEFERYKQNSRI

SEQ ID NO: 26795 - protein, 88 aa, Diabrotica virgifera
  misc_feature: Coding regions on vcDNA: vcDNA=SeqID_6492; Strand=+; Position=742-1008
IFQFLPVLFHLNLEIFPEALPGFRNFLIPNLNRNLSFGVWKISPRHYCNEAEGLHKIILPQSPLGLFPEIKKGNLLKKKFNTGPARAS

SEQ ID NO: 26796 - protein, 235 aa, Diabrotica virgifera
  misc_feature: Coding regions on vcDNA: vcDNA=SeqID_6493; Strand=+; Position=59-767
  misc_feature: Homolog annotation: Hit_ID=XP_396642.1; Match level="QueryCoverage =98%, HitCoverage=61%, E-value=7e-47, Identity=45%"; Hit description =similar to CG6073-PA [Apis mellifera]
  misc_feature: Pfam annotation: Pfam_ID=DUF383; Match level="Score=18.1, E-value =3.4e-08, Copies=1"; Pfam description=Domain of unknown function (DUF383)
  misc_feature (180)..(180): Xaa can be any naturally occurring amino acid
  misc_feature (211)..(211): Xaa can be any naturally occurring amino acid
  misc_feature (218)..(218): Xaa can be any naturally occurring amino acid
MNDSLEELIKFVQLGSRLDFLAIAVETILGLTGSDEGLKSLIEKPQLLVSLITLLEDKSVPIAKDASMCLMNISANEKGATALVNLDTKEYCPPLQRPPEHIVKQVLSSIFNTTSRIADQCCMILSNLSRPPHLLQKIIDNIEDSNHTFDDIINIFTKVEYNKSGAKLHYLRPGLSNPFXQSHRVRSFILDKDKCVAQRLLPFTENQASFXRRGGGIXTLKNCWFEKDFHEWKLK

SEQ ID NO: 26797 - protein, 122 aa, Diabrotica virgifera
  misc_feature: Coding regions on vcDNA: vcDNA=SeqID_6494; Strand=+; Position=711-1079
  misc_feature (2)..(7): Xaa can be any naturally occurring amino acid
  misc_feature (34)..(69): Xaa can be any naturally occurring amino acid
  misc_feature (72)..(88): Xaa can be any naturally occurring amino acid
  misc_feature (90)..(121): Xaa can be any naturally occurring amino acid
SXXXXXXRISFIKPIYFLLKISIFLLLISFFISXXXXXXXXXXXXXXXXXXXXXXXXXXXXXXXXXXXXFYXXXXXXXXXXXXXXXXXPXXXXXXXXXXXXXXXXXXXXXXXXXXXXXXXXD

SEQ ID NO: 26798 - protein, 41 aa, Diabrotica virgifera
  misc_feature: Coding regions on vcDNA: vcDNA=SeqID_6495; Strand=-; Position=38-163
TNNLDQPHRFARQQHRKKKAQGSQSDYTISETSPRNLALEI

SEQ ID NO: 26799 - protein, 114 aa, Diabrotica virgifera
  misc_feature: Coding regions on vcDNA: vcDNA=SeqID_6496; Strand=+; Position=119-463
  misc_feature: Homolog annotation: Hit_ID=XP_313183.1; Match level="QueryCoverage =98%, HitCoverage=37%, E-value=4e-11, Identity=34%"; Hit description =ENSANGP00000013975 [Anopheles gambiae]
RVPKMSSEKLTSEQKSFLEECNLEFSERYTDADVEFMKIFDSEIPPPPIVSPWYGRQRFNNRDRDRPGGSYNNYRNRDTSRDYSENHRGREYRHHHQRDDREYRHPQQDRFRPY

SEQ ID NO: 26800 - protein, 256 aa, Diabrotica virgifera
  misc_feature: Coding regions on vcDNA: vcDNA=SeqID_6497; Strand=-; Position=3-770
  misc_feature: Homolog annotation: Hit_ID=NP_510230.2; Match level="QueryCoverage =85%, HitCoverage=27%, E-value=9e-22, Identity=28%"; Hit description =putative endoplasmic reticulum protein, with 2 coiled coil-4 domains, of bilaterial origin
MMEYFSKRRETPSCGVLNPVLKVGDISSSVAGVGSGTLMFAGAVTSVIVPPVLIGAAAVGAVAGVYSITRSAFGLHDKITHDEDLSIFNSEARGIYINIVAGSLGFVGAGANMAVSQLISRGVNIGQGVGLAVNAISMANIGISGIGIINSSYDVFDMWINHKQAPSALTILQLASSVLFFGNAVYNFKTVGQIIDETQGRVLEDYHDSLRSNRHRKTFDRLLKTTILDNDGNVIKGRAEVIKAIRNIPNKDDVFA

SEQ ID NO: 26801 - protein, 177 aa, Diabrotica virgifera
  misc_feature: Coding regions on vcDNA: vcDNA=SeqID_6498; Strand=+; Position=42-575
ILIYMECKLLCVAVAVASIAVVSSDKSCWGHKVVAEVRELFPYCKDIITTNSISENDGLNLDTKDSSEELCQNIRKWLDKSHSDLGKISQFNICMSLNNDGLEFYQMKKVFECLPVLNNSVFEKNSKEIVYEHITDRRVFRSVRIYLNQEKTEENQKSVNDFLACIGYQPDSVFNRH

SEQ ID NO: 26802 - protein, 131 aa, Diabrotica virgifera
  misc_feature: Coding regions on vcDNA: vcDNA=SeqID_6499; Strand=-; Position=1-393
  misc_feature (1)..(131): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 26803 - protein, 246 aa, Diabrotica virgifera
  misc_feature: Coding regions on vcDNA: vcDNA=SeqID_6500; Strand=+; Position=39-779
  misc_feature: Homolog annotation: Hit_ID=NP_523893.1; Match level="QueryCoverage =89%, HitCoverage=69%, E-value=2e-75, Identity=60%"; Hit description =CG2101-PA [Drosophila melanogaster] gb|AAF47688.1| CG2101-PA [Drosophila melanogaster]
  misc_feature (101)..(106): Xaa can be any naturally occurring amino acid
  misc_feature (246)..(246): Xaa can be any naturally occurring amino acid
TTANRAKTIERHQPPNEEKTLSCFYANTDAKAEIRDEFRALNIRNQKGVQERRQRRPPNIIPPRTNEMPVDQDWGNVWPGPRSFHPASVPLPVRQGYTKKXXXXXXYANAELIKIPNFLHLTPPVIERQCKALKQFCTPWPKALDTDEKCEKHFPFELTFSDYCFSSPSIRNPLARIVTLRFKLKSLNLNQRANDKFLRLVGDRYDEATDTVTIVTDRCPLRKENYDYALYLITALYHESWNVEPX

SEQ ID NO: 26804 - protein, 181 aa, Diabrotica virgifera
  misc_feature: Coding regions on vcDNA: vcDNA=SeqID_6501; Strand=+; Position=215-757
  misc_feature (44)..(50): Xaa can be any naturally occurring amino acid
  misc_feature (144)..(144): Xaa can be any naturally occurring amino acid
EEMEEFIKELREKLDRMEDRGMRIEEKLDGIQSELEQLKNTNQXXXXXXXLLKQELHQHKNRIEQIERDMKRKNLIIHGLEETSDEDTQILVNKVQDIINKMEIPCKANQEVTEIRRIGDKTRNSKRPVLVELRSANTRTEILXATWKIKGSKWFVNEDYPKNIIEQRQNPYKTPERGKDE

SEQ ID NO: 26805 - protein, 178 aa, Diabrotica virgifera
  misc_feature: Coding regions on vcDNA: vcDNA=SeqID_6502; Strand=+; Position=138-674
  misc_feature: Homolog annotation: Hit_ID=EAL28204.1; Match level="QueryCoverage =85%, HitCoverage=30%, E-value=1e-09, Identity=31%"; Hit description =GA10244-PA [Drosophila pseudoobscura]
  misc_feature (117)..(125): Xaa can be any naturally occurring amino acid
  misc_feature (136)..(142): Xaa can be any naturally occurring amino acid
IFRKMEPVKKISFGFSKTNKKPLIFNKSLDKKVDYIVSLEGQSVKLKDESKEVEKAPLVIPLKDNQTDLLQRVRDMKAKQQNTRKNSNDPVEEDNRPDSDLTIEELAAREIVKEAKXXXXXXXXXGSKNFVIFTKXXXXXXXEGKMESTLVDYENIPVNEYWKKYSQDFSCESTRSET

SEQ ID NO: 26806 - protein, 151 aa, Diabrotica virgifera
  misc_feature: Coding regions on vcDNA: vcDNA=SeqID_6503; Strand=+; Position=3-458
  misc_feature (24)..(24): Xaa can be any naturally occurring amino acid
  misc_feature (101)..(101): Xaa can be any naturally occurring amino acid
  misc_feature (109)..(109): Xaa can be any naturally occurring amino acid
KEGEDKTPPKEEKPDDKRRTFRRXPPPGEKGRGRKRQKPEPRPRPSPKNTHDADSAKPLRGQSQQKRQPQQGERSQQKHIPQKNRAGEHRQEEQKNTNQSXNQNHRQQXGQTPANQPQENTKTRKRTTRRRKPLKKTRTPNCSKKLPIKKK

SEQ ID NO: 26807 - protein, 100 aa, Diabrotica virgifera
  misc_feature: Coding regions on vcDNA: vcDNA=SeqID_6504; Strand=+; Position=387-686
TPLPLRNRGCHPYCTASARNIKLSERDTLFLLLSGNNNRSFFHPQPPRSRISPPPLKRARLPSSFPVPLAPQPVPPPRSLLSHPFPPHLHPRGGFSSNPP

SEQ ID NO: 26808 - protein, 66 aa, Diabrotica virgifera
  misc_feature: Coding regions on vcDNA: vcDNA=SeqID_6505; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PFXXXXXXXXXXXTNLAHTGLNXXXXXXXXSNXXXXXXXXXXXXXXPTSRSXXXXXXXXXXXXXXV

SEQ ID NO: 26809 - protein, 56 aa, Diabrotica virgifera
  misc_feature: Coding regions on vcDNA: vcDNA=SeqID_6506; Strand=+; Position=274-444
KFKSCSKPLHLFIFAYFCYSPSLRVQAFVVNSGTLTVSGSLHSQTKPWLTYTTTST

SEQ ID NO: 26810 - protein, 29 aa, Diabrotica virgifera
  misc_feature: Coding regions on vcDNA: vcDNA=SeqID_6507; Strand=-; Position=0-86
  misc_feature (6)..(27): Xaa can be any naturally occurring amino acid
KKKVGXXXXXXXXXXXXXXXXXXXXXXTP

SEQ ID NO: 26811 - protein, 60 aa, Diabrotica virgifera
  misc_feature: Coding regions on vcDNA: vcDNA=SeqID_6508; Strand=+; Position=64-246
DNISCEERAPTVKGGYYPIMNLQGICRSSATKLDAENTDLTKYLFLMIEYCKNNRDYTLL

SEQ ID NO: 26812 - protein, 89 aa, Diabrotica virgifera
  misc_feature: Coding regions on vcDNA: vcDNA=SeqID_6509; Strand=-; Position=2-271
GKCNVYKRCVTLHQWKLDVYRRSVRQRGNHNKNSQNLKAWSHDEEQRDIWTAVPNFTGKSRRKTMTRKAKDFLAEECTYVVQHNNRKSG

SEQ ID NO: 26813 - protein, 208 aa, Diabrotica virgifera
  misc_feature: Coding regions on vcDNA: vcDNA=SeqID_6510; Strand=+; Position=6-632
  misc_feature: Homolog annotation: Hit_ID=XP_312568.1; Match level="QueryCoverage =78%, HitCoverage=35%, E-value=2e-16, Identity=32%"; Hit description =ENSANGP00000014917 [Anopheles gambiae]
MNITDVTTAFDIWDCVKTEDNVGFSLPAWTKSIYPEPLRTTIGKFFEVFTYTTNMKRIIIGPFLNEVVEYLESMAANSSSSHKYKMYSAHESNMGAILNAFGAFNPSSPPAFASTVYIELHKENWKYTVKVFNKELDNIRQVSVNGCDLNCPLDSFKENLSDFIIDADTRDTECNSVEEKKLLAGSAAATIGKYSAEELEQKFAGFST

SEQ ID NO: 26814 - protein, 92 aa, Diabrotica virgifera
  misc_feature: Coding regions on vcDNA: vcDNA=SeqID_6511; Strand=+; Position=256-534
NERRCVYTFCILYTIYLLHTSAYVSLSVLTWFDLKWVVPRGKVIANGLYICMYNRERQQTSPKHNMYMHMYAVCNHAMITYRTYIRLQGATS

SEQ ID NO: 26815 - protein, 147 aa, Diabrotica virgifera
  misc_feature: Coding regions on vcDNA: vcDNA=SeqID_6512; Strand=-; Position=6-448
  misc_feature: Homolog annotation: Hit_ID=S36442; Match level="QueryCoverage=89%, HitCoverage=88%, E-value=2e-15, Identity=37%"; Hit description =reverse transcriptase-like protein - bovine (fragment)
  misc_feature (80)..(80): Xaa can be any naturally occurring amino acid
AFCVNWFRYLSNLGDELTEAIQILRGVRQGCILSPILFNLYSKEIFSEALENCEHGVLLNEERLNNIRYADDTVIFAESXEQFTASNKLNEVSERFGLQVNISKTKFMVISKNKIRDAQLLIKNTPVDRVKEYTHLGTTVNEQWDHS

SEQ ID NO: 26816 - protein, 112 aa, Diabrotica virgifera
  misc_feature: Coding regions on vcDNA: vcDNA=SeqID_6513; Strand=+; Position=1-338
  misc_feature: Homolog annotation: Hit_ID=AAC37262.1; Match level="QueryCoverage =81%, HitCoverage=8%, E-value=5e-21, Identity=58%"; Hit description =vitellogenin convertase pir||T30347 vitellogenin convertase - yellow fever mosquito
  misc_feature: Gene Ontology Annotation: Molecular function=furin activity; Cellular component=plasma membrane; Biological process=cell-cell signaling
  misc_feature (23)..(23): Xaa can be any naturally occurring amino acid
  misc_feature (82)..(82): Xaa can be any naturally occurring amino acid
LRLNKTKIAIHNVHSSRYLNRGXGLDMNVIPACIEGTYRKRRCSFLYYIHRLEEDHPDLEQHYDPTASYDGNGKDPDDKPSXDMIDSNRLGTTCAAAATSTSNNSVCAPTIC

SEQ ID NO: 26817 - protein, 304 aa, Diabrotica virgifera
  misc_feature: Coding regions on vcDNA: vcDNA=SeqID_6514; Strand=+; Position=5-916
  misc_feature: Homolog annotation: Hit_ID=XP_319935.1; Match level="QueryCoverage =90%, HitCoverage=34%, E-value=6e-79, Identity=51%"; Hit description =ENSANGP00000016749 [Anopheles gambiae]
  misc_feature: Gene Ontology Annotation: Molecular function=prolyl oligopeptidase activity; Cellular component=nucleus; Biological process=protein metabolism
  misc_feature: Pfam annotation: Pfam_ID=Peptidase_S9_N; Match level="Score=109.1, E -value=1.1e-29, Copies=1"; Pfam description=Prolyl oligopeptidase, N -terminal bet
  misc_feature (191)..(198): Xaa can be any naturally occurring amino acid
  misc_feature (244)..(244): Xaa can be any naturally occurring amino acid
  misc_feature (262)..(262): Xaa can be any naturally occurring amino acid
  misc_feature (272)..(272): Xaa can be any naturally occurring amino acid
GKRLHNSWNYPKMSTPFRHGTKYYQFRNTGLQDQGIIYTMDKLDDEGKIFLNPNTFSEDGTVALSGTSFSEDGKTFAYGLSSSGSDWVEIKFRNVETGTDHDEILKKVKYSPMAWMHDNIGFFYGGYLHQTGKTDGSETKSSEYQKLYYHRLGTDQSKDVMAVEFDDHQLRMGAHVSHCGDYLIVTPIKGXXXXXXXXSKFNRTRTITGKLDLTPIVTSFEADYEYVTNVDTKFYFRTNKNAPXNYRIIVIDLGNPAEKYWXNRFPEHPKGXLDWGSIGKQKYAGKFAISGEVKKGLEQLKIPP

SEQ ID NO: 26818 - protein, 167 aa, Diabrotica virgifera
  misc_feature: Coding regions on vcDNA: vcDNA=SeqID_6515; Strand=+; Position=23-526
  misc_feature: Homolog annotation: Hit_ID=XP_392145.1; Match level="QueryCoverage =70%, HitCoverage=19%, E-value=3e-18, Identity=42%"; Hit description =similar to ENSANGP00000015188 [Apis mellifera]
  misc_feature: Gene Ontology Annotation: Biological process=reproduction
SIQKRISLAVEVKIGEKIVTLKAKKEIILSAGAINSPQVLMLSGLGPKEHLQELGIPVIKNLPVGYNLEDHVIHIGFDVRLKVESLLIPNKLGTICKYFRHNEGELAGIRIDELIQTSYIPRTIPHIQTFVTIISFAHLLILNYFLKWLKFPGLTDDISLSKKDARI

SEQ ID NO: 26819 - protein, 270 aa, Diabrotica virgifera
  misc_feature: Coding regions on vcDNA: vcDNA=SeqID_6516; Strand=+; Position=3-812
  misc_feature: Homolog annotation: Hit_ID=XP_394629.1; Match level="QueryCoverage =98%, HitCoverage=8%, E-value=1e-124, Identity=76%"; Hit description =similar to ENSANGP00000020021 [Apis mellifera]
  misc_feature: Gene Ontology Annotation: Molecular function=heparin binding; Cellular component=integral to plasma membrane; Biological process =negative regulation of cell proliferation
  misc_feature: Pfam annotation: Pfam_ID=RHS_repeat; Match level="Score=25.9, E-value= 0.00013, Copies=2"; Pfam description=RHS Repeat
LEYRWDYQYTGGLLLEERIDFGAKTGLSNAKFTYDYDNNYRLITAQGRIGGQNLPQHNLGYNHKTGSLEMIGPFKIIKLRINETNVYDGTALFSSTVNSRLLETRVALTIHGMEVFRMEFSHDIHGRISQTRTYTKNVGVNTYTNVKNYTWDCDGQLLGVEAQEPWGFRYDDNGNMLSLTYRGNTIPMEYNPMDRIIKFGEGQYKYDSRGLVIQNAREEKFHYNSKGLLIRATKRGRFDVRYYYDHMDRFICRKDNFGNVTQFFYTHALN

SEQ ID NO: 26820 - protein, 191 aa, Diabrotica virgifera
  misc_feature: Coding regions on vcDNA: vcDNA=SeqID_6517; Strand=+; Position=8-583
  misc_feature: Homolog annotation: Hit_ID=AAH56222.1; Match level="QueryCoverage =91%, HitCoverage=31%, E-value=1e-09, Identity=25%"; Hit description =Zinc finger protein 263 [Mus musculus]
  misc_feature: Gene Ontology Annotation: Molecular function=transcriptional repressor activity
  misc_feature: Pfam annotation: Pfam_ID=zf-C2H2; Match level="Score=69.8, E-value =7.6e-18, Copies=4"; Pfam description=Zinc finger, C2H2 type
MNRCTKCNINFTKYYNMRAHAKRKHPDMLDILLPNNVQQSKSTVPCLECNKKFSNLGNLRLHVKRQHPDKLDEIAPVNKKTYVCSSCSESFHNLKKLVSHKQTHNNALTKLKCTLCQYNNSGRENLILHYRSDHFINIENNYLEFDTFEDFESWKCKVEEETFSSFVKMYGSKKTSNCTTTNYSCHRSGIY

SEQ ID NO: 26821 - protein, 117 aa, Diabrotica virgifera
  misc_feature: Coding regions on vcDNA: vcDNA=SeqID_6518; Strand=+; Position=204-552
  misc_feature: Homolog annotation: Hit_ID=NP_652046.1; Match level="QueryCoverage =97%, HitCoverage=31%, E-value=5e-11, Identity=37%"; Hit description =CG11899-PA [Drosophila melanogaster] gb|AAF56874.1| CG11899-PA [Drosophila melanogaster]
  misc_feature (45)..(45): Xaa can be any naturally occurring amino acid
  misc_feature (110)..(110): Xaa can be any naturally occurring amino acid
CDAHIQGIYPTLQIFTLEIVMELANGTDTDKILLMHGDEGGAFDXVDISLLNTISTDDYATTGTWFDTPHKEASFYRNVNIALPTARIPGNDPPHNTSKIDSNAYCEYYXCENETVN

SEQ ID NO: 26822 - protein, 221 aa, Diabrotica virgifera
  misc_feature: Coding regions on vcDNA: vcDNA=SeqID_6519; Strand=+; Position=1-666
  misc_feature: Homolog annotation: Hit_ID=XP_309421.1; Match level="QueryCoverage =84%, HitCoverage=50%, E-value=5e-48, Identity=48%"; Hit description =ENSANGP00000011252 [Anopheles gambiae]
  misc_feature: Gene Ontology Annotation: Molecular function=receptor binding; Cellular component=extracellular space; Biological process =opsinization
  misc_feature: Pfam annotation: Pfam_ID=Fibrinogen_C; Match level="Score=207.3, E -value=3.1e-59, Copies=1"; Pfam description=Fibrinogen beta and gamma chains, C-t
NPVAKNLENNYLRSCREILEAGNNKSGVYVIKPRTSNKPFAVLCDMETKGGGWTHIQKRFDGSQDFYLPWRDYKFGFGDLNVEFWIGLENIYHMTAFDRNELLVEVTETNKNISYAKYSSFSIGSEMDGYPLKELTGYSGNAGDGLANHIGLKFTTVDVDQDKSSGNCAQIFEGAWWYNNCHSSNLNGKFMTVVLPEAYKAHGLNWHPLKRRPCKFGWFPE

SEQ ID NO: 26823 - protein, 204 aa, Diabrotica virgifera
  misc_feature: Coding regions on vcDNA: vcDNA=SeqID_6520; Strand=+; Position=221-832
  misc_feature (126)..(133): Xaa can be any naturally occurring amino acid
  misc_feature (146)..(152): Xaa can be any naturally occurring amino acid
  misc_feature (154)..(161): Xaa can be any naturally occurring amino acid
  misc_feature (182)..(189): Xaa can be any naturally occurring amino acid
MEVKQEISDDSCKVETEYNDLDDALLVLDGFKCELKLKEESSGLSTRGTYDYLDLKEHSIKTEIEKLGSKLSPFEKNHQNETDFLQDTKMEIMETLPEHSSHEANYTNPHAEAKTLTKYMNERPYXXXXXXXXFSEASRLEVHLRXXXXXXXYXXXXXXXXFTQPGILKRHLLVHTGGKTQXXXXXXXXFNLASYLKKHMRVHT

SEQ ID NO: 26824 - protein, 183 aa, Diabrotica virgifera
  misc_feature: Coding regions on vcDNA: vcDNA=SeqID_6521; Strand=-; Position=108-659
  misc_feature: Homolog annotation: Hit_ID=CAG12184.1; Match level="QueryCoverage =87%, HitCoverage=32%, E-value=9e-25, Identity=36%"; Hit description =unnamed protein product [Tetraodon nigroviridis]
  misc_feature: Gene Ontology Annotation: Molecular function=receptor binding; Cellular component=lipid raft; Biological process=extracellular matrix organization and biogenesis
  misc_feature: Pfam annotation: Pfam_ID=Fibrinogen_C; Match level="Score=-41.1, E -value=5.9e-08, Copies=1"; Pfam description=Fibrinogen beta and gamma chains, C-te
  misc_feature (41)..(41): Xaa can be any naturally occurring amino acid
  misc_feature (82)..(82): Xaa can be any naturally occurring amino acid
GGWAPHSNRIEGSEDFFEIGPDFQIGFGNWEGGFWMGLETXFYLPALEVRELRVEFNSRKTIKSSMEVWDGFWNGPELDGFXLKVPRLYSGTAGDNRDYHLGQKFTTKDLDQDKWPQDNCANFSMGGWWYNNCYASNPNGQHRNMKHFEEIKRKGMNWGQNFISRWILFIWNSNVSKTKTLET

SEQ ID NO: 26825 - protein, 282 aa, Diabrotica virgifera
  misc_feature: Coding regions on vcDNA: vcDNA=SeqID_6522; Strand=+; Position=66-912
  misc_feature: Homolog annotation: Hit_ID=AAH00750.4; Match level="QueryCoverage =94%, HitCoverage=54%, E-value=4e-88, Identity=59%"; Hit description =PPP5C protein [Homo sapiens] gb|AAH01831.4| PPP5C protein [Homo sapiens]
  misc_feature: Gene Ontology Annotation: Molecular function=protein serine/threonine phosphatase activity; Cellular component=nucleus; Biological process =mitosis
  misc_feature: Pfam annotation: Pfam_ID=TPR_1; Match level="Score=81.1, E-value=2.9e- 21, Copies=3"; Pfam description=Tetratricopeptide repeat
  misc_feature (152)..(163): Xaa can be any naturally occurring amino acid
  misc_feature (253)..(253): Xaa can be any naturally occurring amino acid
MTTEEQTQQSVTAEDAKIAEKYKSEANEYFKKQDFDNAIELYTKAIEKNPTVAIYYANRSFAYLKTECFGYALTDASKSVELDKTYVKGYYRRAAAHMSLGKFKEALKDYEYVTKVRPNDKDAKMKYMECNKVVKKLAFEKAIAVEDNKKNXXXXXXXXXXXXENEYTGPELEDGKVTLNFMKELMELYKNQGKLHRKYAYTILLDIRSYFTKQPTLVDVPIGDEDKFTVCGDIHGQFYDLMNIFELNGLPSXETNPYLVLWENSSDRGSFSVKRIFTPIRF

SEQ ID NO: 26826 - protein, 92 aa, Diabrotica virgifera
  misc_feature: Coding regions on vcDNA: vcDNA=SeqID_6523; Strand=+; Position=44-322
RSPSNEKCHRTQYSSDFLFRCGISLPKIRVESPSDIALFSFGWEFDIDRRSTRMYYLHDSRFLLRSGPDIRGAGWAATRGPHISGAPTKPHT

SEQ ID NO: 26827 - protein, 24 aa, Diabrotica virgifera
  misc_feature: Coding regions on vcDNA: vcDNA=SeqID_6524; Strand=-; Position=1-72
  misc_feature (6)..(22): Xaa can be any naturally occurring amino acid
GLINLXXXXXXXXXXXXXXXXXPK

SEQ ID NO: 26828 - protein, 98 aa, Diabrotica virgifera
  misc_feature: Coding regions on vcDNA: vcDNA=SeqID_6525; Strand=+; Position=3-299
CFQLLPDLQVVGEQHDLVEQKLVSSYFLIYKQLVQLVQQGDLVPQELIAQQQLIHQQVVLLLQRGVLPQQSALNQLVSQEQQLSLRQPQIYQRVPRVY

SEQ ID NO: 26829 - protein, 317 aa, Diabrotica virgifera
  misc_feature: Coding regions on vcDNA: vcDNA=SeqID_6526; Strand=+; Position=3-955
  misc_feature: Homolog annotation: Hit_ID=XP_394632.1; Match level="QueryCoverage =72%, HitCoverage=30%, E-value=7e-27, Identity=32%"; Hit description =similar to ENSANGP00000015403 [Apis mellifera]
  misc_feature: Pfam annotation: Pfam_ID=I-set; Match level="Score=-4.9, E-value =0.0023, Copies=1"; Pfam description=Immunoglobulin I-set domain
  misc_feature (14)..(14): Xaa can be any naturally occurring amino acid
  misc_feature (43)..(43): Xaa can be any naturally occurring amino acid
GKFPPGSTLKDRTXYKIYGDPTPAVDWINNGLIIERDPRKDKXQNIFTCYSKPSSGYTWNNLTIVNLNYKDKGEYKCIAKNPGGYTERNITLDILPGALTGGGIVGTLSTSTTLVIGLTVGLIILLFLVLIALFCFCRRSTHGFYFFRRPNATTSEEYINMSTGQAEIKKGLITDVNPVTKPPRTSVSPSVVSGGTEVSDVKKTLLDNESVFDGDEDSRSFDFDQPHRKGQIMLDTGPNHYPPDLLPFPPRLGQVSPCWKFCIYCCRYNPSFTKLMGPQSPLPSPIYDQLNLLPYFALLQNPFSVWRTPRLEYLQTG

SEQ ID NO: 26830 - protein, 189 aa, Diabrotica virgifera
  misc_feature: Coding regions on vcDNA: vcDNA=SeqID_6527; Strand=-; Position=206-775
  misc_feature (55)..(78): Xaa can be any naturally occurring amino acid
  misc_feature (105)..(152): Xaa can be any naturally occurring amino acid
  misc_feature (180)..(187): Xaa can be any naturally occurring amino acid
RLPLFFLAVSFVGSALSRFETCTFLIKLFKFTAHKTATNNADENCQIPSTYRLTXXXXXXXXXXXXXXXXXXXXXXXXQWILRRKTLAAPDFFDSLIFYFLSICXXXXXXXXXXXXXXXXXXXXXXXXXXXXXXXXXXXXXXXXXXXXXXXXTMDFKKKNSRCSRFLRFIDFLFLVYMSXXXXXXXXTS

SEQ ID NO: 26831 - protein, 53 aa, Diabrotica virgifera
  misc_feature: Coding regions on vcDNA: vcDNA=SeqID_6528; Strand=-; Position=2-160
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
PFXXXXXXXXXXXTNLAHTGLNXXXXXXXXSNXXXXXXXXXXXXXXPTWLTPV

SEQ ID NO: 26832 - protein, 154 aa, Diabrotica virgifera
  misc_feature: Coding regions on vcDNA: vcDNA=SeqID_6529; Strand=+; Position=2-466
  misc_feature: Homolog annotation: Hit_ID=AAV88529.1; Match level="QueryCoverage =97%, HitCoverage=39%, E-value=2e-80, Identity=100%"; Hit description= cadherin-like protein [Diabrotica virgifera virgifera]
QNLASTLRSEQKLNLDSFETNSKSGNSEAALRAWLIGVSVVLGILVLLLLITLILKTRQLSNRIKKLTTPQFGSQESGLNRMGINAPTTNKHAIEGTNPVYNNNEIKKPKNMNDFDTHSIRSGDSDLVGIENNPEFDYNFNTNEDKTTYLLCLA

SEQ ID NO: 26833 - protein, 208 aa, Diabrotica virgifera
  misc_feature: Coding regions on vcDNA: vcDNA=SeqID_6530; Strand=+; Position=1-627
  misc_feature: Homolog annotation: Hit_ID=XP_393906.1; Match level="QueryCoverage =94%, HitCoverage=32%, E-value=2e-31, Identity=36%"; Hit description =similar to RIKEN cDNA 4930415J21 protein [Apis mellifera]
  misc_feature (41)..(48): Xaa can be any naturally occurring amino acid
  misc_feature (91)..(97): Xaa can be any naturally occurring amino acid
EIHKNLVRADFFNDLKDHWSKDEKLSSPDVEIITEPFKVCXXXXXXXXEDVLDNVRQEFNELDWNMRNMDLYEFFQSKDLKYLSSDYINAXXXXXXXEAMEWVANLTGYSLTHISATCSLYSNTDYLLVHDDQREDRMVAFVLYLTGKNGWNESKGGALQLFNKSETDQPQVCVRNIFPANNQLVLFPVTSDSYHQEAEVTDHRRLQT

SEQ ID NO: 26834 - protein, 65 aa, Diabrotica virgifera
  misc_feature: Coding regions on vcDNA: vcDNA=SeqID_6531; Strand=+; Position=3-200
KGETTPRPNINRPGNQRQTGYQQYGGYPQTNKPSSGTSISDKITSGLKSIGLFCVVLVYTRLFSI

SEQ ID NO: 26835 - protein, 207 aa, Diabrotica virgifera
  misc_feature: Coding regions on vcDNA: vcDNA=SeqID_6532; Strand=+; Position=57-682
  misc_feature: Homolog annotation: Hit_ID=AAS79482.1; Match level="QueryCoverage =29%, HitCoverage=5%, E-value=6e-11, Identity=50%"; Hit description =transcription factor [Xenopus laevis]
  misc_feature: Gene Ontology Annotation: Molecular function=molecular_function unknown; Cellular component=nucleus; Biological process=organogenesis
  misc_feature: Pfam annotation: Pfam_ID=zf-C2H2; Match level="Score=23.6, E-value =0.00059, Copies=2"; Pfam description=Zinc finger, C2H2 type
  misc_feature (143)..(143): Xaa can be any naturally occurring amino acid
MFNQSEVKEEVGETTCKREIDNEVDEVLEDTCKIEIKDEPIRESTNDTFDYLEVKKCPIKAEIKQDDGFSCNDMKTAASNLVTHHARTDSNFKQYITSTTNVNTEGQRFICIICKKPLSSNSRLELHIRIHTGKKPFACEILXKQFSTKGNLKAHMNSAYLMKNHSSVKICAQTIFHQRGILKSTYDSASLVKFFSASKSFEWEILQ

SEQ ID NO: 26836 - protein, 204 aa, Diabrotica virgifera
  misc_feature: Coding regions on vcDNA: vcDNA=SeqID_6533; Strand=+; Position=77-691
  misc_feature: Homolog annotation: Hit_ID=XP_422861.1; Match level="QueryCoverage =75%, HitCoverage=8%, E-value=8e-13, Identity=35%"; Hit description =PREDICTED: similar to mKIAA1606 protein [Gallus gallus]
  misc_feature (40)..(46): Xaa can be any naturally occurring amino acid
MSDNESCNKDESEENSDDNLHIAIESPSRKRKPSPVPTEXXXXXXXYIEDELEHKLEEKAAKSNLNVTNVKNIIKHVLTSEDVLNLIKDAEGSKSGENISPLFELKWTRSKVKELSSASGLPLPPVNLTAPKPASEVQVLFTEELQEDSSGDEYIPGMGDEDKDDMEESEDDPDNSLFSDPPSIEPETPPEQHVASPPPHPNLT

SEQ ID NO: 26837 - protein, 264 aa, Diabrotica virgifera
  misc_feature: Coding regions on vcDNA: vcDNA=SeqID_6534; Strand=-; Position=1-792
  misc_feature (3)..(258): Xaa can be any naturally occurring amino acid
RPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKLKTF

SEQ ID NO: 26838 - protein, 63 aa, Diabrotica virgifera
  misc_feature: Coding regions on vcDNA: vcDNA=SeqID_6535; Strand=+; Position=2-193
  misc_feature (19)..(25): Xaa can be any naturally occurring amino acid
  misc_feature (56)..(61): Xaa can be any naturally occurring amino acid
FMNETLGPDTLVSVRHELXXXXXXXIYLPVTVKLTTGKLKKNQWKIRTKLSEFVTXXXXXXLV

SEQ ID NO: 26839 - protein, 102 aa, Diabrotica virgifera
  misc_feature: Coding regions on vcDNA: vcDNA=SeqID_6536; Strand=+; Position=393-698
  misc_feature (34)..(40): Xaa can be any naturally occurring amino acid
  misc_feature (93)..(102): Xaa can be any naturally occurring amino acid
FLQFITHHLRSPIFTNDSRYEIYVNLTISINNMXXXXXXXVYVKKFARCVRYWDRASSEKRHLVSSLCTFIRTFNYVGQSYGPGCWIIVQAIXXXXXXXXXX

SEQ ID NO: 26840 - protein, 242 aa, Diabrotica virgifera
  misc_feature: Coding regions on vcDNA: vcDNA=SeqID_6537; Strand=+; Position=145-870
  misc_feature: Homolog annotation: Hit_ID=XP_320673.1; Match level="QueryCoverage =54%, HitCoverage=34%, E-value=9e-15, Identity=30%"; Hit description =ENSANGP00000021204 [Anopheles gambiae]
  misc_feature: Pfam annotation: Pfam_ID=Cytochrom_B561; Match level="Score=-71.1, E -value=0.013, Copies=1"; Pfam description=Cytochrome b561
  misc_feature (211)..(211): Xaa can be any naturally occurring amino acid
MAGLENENVQMISTKIQITSENPSPQRTDTEYDSTSTRVQPFDIESQSHIDFAPVNNQNQNNCDSLDAKEMSATKEQQSTLGGADKEKKHKKGPRPPPPPGLKDDLTTIAHVSVVIFVGLILYLCFARPFEFFTWHPLLMSVGWMLMMIEGVLFISKENPIGRRLNLGRLLKVRFHWIALTISSILVTIGFVIVVISKNNHGKEHFKSLHXDFGLIGLLGCIPAFINGTVALFDVELKRYIK

SEQ ID NO: 26841 - protein, 52 aa, Diabrotica virgifera
  misc_feature: Coding regions on vcDNA: vcDNA=SeqID_6538; Strand=-; Position=173-331
HIVIEEIETNDATVRYKAKGTTVHYNIIIIGSEMTHKISNAVPTLERRIIIG

SEQ ID NO: 26842 - protein, 119 aa, Diabrotica virgifera
  misc_feature: Coding regions on vcDNA: vcDNA=SeqID_6539; Strand=-; Position=3-359
  misc_feature (8)..(25): Xaa can be any naturally occurring amino acid
  misc_feature (49)..(56): Xaa can be any naturally occurring amino acid
  misc_feature (91)..(119): Xaa can be any naturally occurring amino acid
VGGVLFFXXXXXXXXXXXXXXXXXXTRGPPTRGLISRNTCKKFKKVGTXXXXXXXXPPNLKTFNPTLGGGHSLLWDLNSPNKNYAGYPLGXXXXXXXXXXXXXXXXXXXXXXXXXXXXX

SEQ ID NO: 26843 - protein, 41 aa, Diabrotica virgifera
  misc_feature: Coding regions on vcDNA: vcDNA=SeqID_6540; Strand=-; Position=1-123
  misc_feature (2)..(26): Xaa can be any naturally occurring amino acid
  misc_feature (31)..(41): Xaa can be any naturally occurring amino acid
PXXXXXXXXXXXXXXXXXXXXXXXXXLLGSXXXXXXXXXXX

SEQ ID NO: 26844 - protein, 242 aa, Diabrotica virgifera
  misc_feature: Coding regions on vcDNA: vcDNA=SeqID_6541; Strand=-; Position=1-726
  misc_feature (1)..(242): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 26845 - protein, 56 aa, Diabrotica virgifera
  misc_feature: Coding regions on vcDNA: vcDNA=SeqID_6542; Strand=-; Position=54-224
  misc_feature (4)..(29): Xaa can be any naturally occurring amino acid
LLRXXXXXXXXXXXXXXXXXXXXXXXXXXKCLYIFNNYNKYFNNKLQIKQFLIHAW

SEQ ID NO: 26846 - protein, 275 aa, Diabrotica virgifera
  misc_feature: Coding regions on vcDNA: vcDNA=SeqID_6543; Strand=+; Position=3-827
  misc_feature: Homolog annotation: Hit_ID=XP_317471.1; Match level="QueryCoverage =99%, HitCoverage=43%, E-value=1e-113, Identity=72%"; Hit description= ENSANGP00000011857 [Anopheles gambiae]
  misc_feature: Gene Ontology Annotation: Molecular function=molecular_function unknown; Cellular component=membrane; Biological process=G-protein coupled receptor protein signaling pathway
  misc_feature: Pfam annotation: Pfam_ID=Ras; Match level="Score=19.6, E-value=8.3e -11, Copies=1"; Pfam description=Ras family
RILLVGDSGVGKTSLILSLVSEEFPENVPSKAEEITIPADVTPEQVPTNIVDYSSAEQTEDDLDEQIRKASVVCIVYSVDDDDSIERITSYWMPLIRQNHPDGTCPVVLVGNKIDLVEYSTIDGIFEIMEEFSEIETCIECSAKTLKNISEMFYYAQKAVLHPTSPIYSVDKADLSEGCKNALIRIFKICDIDCDGLLNDIELNNFQSRCFNAPLQPQVLDDVKAVLRKNLEDGVCHNCVTLNGFLYLHNLFIQRGRNETTWTVLRKFGYNDNLD

SEQ ID NO: 26847 - protein, 271 aa, Diabrotica virgifera
  misc_feature: Coding regions on vcDNA: vcDNA=SeqID_6544; Strand=+; Position=1-816
  misc_feature: Pfam annotation: Pfam_ID=GILT; Match level="Score=-30.5, E-value =0.013, Copies=1"; Pfam description=Gamma interferon inducible lysosomal t
  misc_feature (256)..(271): Xaa can be any naturally occurring amino acid
PPKKPNEIMLDKMKSPMVYFIIGIVSFFMYAAAQLEKQQVIHLVIFYEDLPFCAHTKDFILQEVQPLLDAGLSKYVKFELLPYETDAVRDSTHSWTCNADRRTACSLGLFDYTKVKYPDHYHPNTECLGSTINYLRYFQDIFQKEIIDTDVKRCKLGDIGQIYPNSMKDKGIKLGSYYPYVNSTLKEEVGNFLNNLTTEILGVKDFKDNTFSIIKWQTENECLERSRNSAIDTNNLPSNILWVMVSTITLILLDCXXXXXXXXXXXXXXXX

SEQ ID NO: 26848 - protein, 179 aa, Diabrotica virgifera
  misc_feature: Coding regions on vcDNA: vcDNA=SeqID_6545; Strand=-; Position=423-962
  misc_feature (3)..(23): Xaa can be any naturally occurring amino acid
  misc_feature (25)..(49): Xaa can be any naturally occurring amino acid
  misc_feature (55)..(61): Xaa can be any naturally occurring amino acid
  misc_feature (64)..(115): Xaa can be any naturally occurring amino acid
  misc_feature (133)..(149): Xaa can be any naturally occurring amino acid
KLXXXXXXXXXXXXXXXXXXXXXPXXXXXXXXXXXXXXXXXXXXXXXXXLWGVLXXXXXXXLLXXXXXXXXXXXXXXXXXXXXXXXXXXXXXXXXXXXXXXXXXXXXXXXXXXXXFIYNTKSHVVSNQAKKMXXXXXXXXXXXXXXXXXLILILSALLDANNIELYFNKQFIGNNNNNM

SEQ ID NO: 26849 - protein, 291 aa, Diabrotica virgifera
  misc_feature: Coding regions on vcDNA: vcDNA=SeqID_6546; Strand=+; Position=3-878
  misc_feature: Homolog annotation: Hit_ID=XP_394034.1; Match level="QueryCoverage =81%, HitCoverage=48%, E-value=2e-85, Identity=31%"; Hit description =similar to CG8561-PA [Apis mellifera]
  misc_feature: Gene Ontology Annotation: Molecular function=insulin-like growth factor binding; Cellular component=soluble fraction; Biological process=signal transduction
  misc_feature: Pfam annotation: Pfam_ID=LRR_1; Match level="Score=98.0, E-value=2.4e- 26, Copies=10"; Pfam description=Leucine Rich Repeat
KRIGTIDLARNRLKKLDYQMFFELNFIEILNLAENQIKEIQKLAFKDLYLTDINLSKNQINKIENGAFENCANITVLDLSFNELASLPKKAFDETTYATELQLSHNYFSNLSQIPLHNMTGIKILNVSHNFITTIPKKTFPKLYELHTIDISHNNLTDVFNSVFQTLFSLRNLNMSYNNLATIKPSMFGSIPTLLELDLSYNDLESVSRGSLTRLASTRQLNLRGNNLRNLFQLPISGSHFGLWLITKKKKLPTGHPGPGNEFLGGVWDLKLTIPLGTILERGKVFQIWWT

SEQ ID NO: 26850 - protein, 190 aa, Diabrotica virgifera
  misc_feature: Coding regions on vcDNA: vcDNA=SeqID_6547; Strand=+; Position=55-627
  misc_feature: Homolog annotation: Hit_ID=XP_307993.1; Match level="QueryCoverage =55%, HitCoverage=18%, E-value=5e-10, Identity=34%"; Hit description =ENSANGP00000013456 [Anopheles gambiae]
MVRNVDHAKREQVLTAILDHVFPFDLIPVSYWVEDDFVFFLGRNCGSAIEKLCNGNLVVPNPKSTTPIDDIDSLQHLTELNLTDLFLDGNPLCSKYGPEEYFAKISKHLKYLTHLDGLPLRKDGFPVSRRHYMCDLGAADLINQFIEYYFYLYDLPNRDILKMAYQKDAMFSLTASYIADQISSSRTKMP

SEQ ID NO: 26851 - protein, 217 aa, Diabrotica virgifera
  misc_feature: Coding regions on vcDNA: vcDNA=SeqID_6548; Strand=-; Position=1-651
  misc_feature (1)..(217): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 26852 - protein, 217 aa, Diabrotica virgifera
  misc_feature: Coding regions on vcDNA: vcDNA=SeqID_6549; Strand=+; Position=91-745
  misc_feature: Homolog annotation: Hit_ID=XP_394441.1; Match level="QueryCoverage =78%, HitCoverage=29%, E-value=5e-62, Identity=63%"; Hit description =similar to CG10338-PA [Apis mellifera]
  misc_feature: Pfam annotation: Pfam_ID=DUF647; Match level="Score=-69.4, E-value =8.1e-10, Copies=1"; Pfam description=Protein of unknown function, DUF647
  misc_feature (203)..(203): Xaa can be any naturally occurring amino acid
MENCEILVSEQNISVGDATFYIKKPGKNEIKHINKTGSMSLTFRSVTNFIREIFLPVGYPESVSEDYWNYQVWDTAQAFCSTIIGAFTTRSILKGVGVGNQEANALSAAVTWILKDGMGMIGRIVFAWWKGSFLDTDCKTWRFFADILNDAAMCIELCLPYFSNYSKELLCVTSSMKSIVGVAGGATRASITHHQAIKDNMAXISAKDGTQETIGKF

SEQ ID NO: 26853 - protein, 189 aa, Diabrotica virgifera
  misc_feature: Coding regions on vcDNA: vcDNA=SeqID_6550; Strand=+; Position=3-572
  misc_feature (2)..(15): Xaa can be any naturally occurring amino acid
  misc_feature (19)..(56): Xaa can be any naturally occurring amino acid
  misc_feature (58)..(122): Xaa can be any naturally occurring amino acid
  misc_feature (124)..(149): Xaa can be any naturally occurring amino acid
WXXXXXXXXXXXXXXDPGXXXXXXXXXXXXXXXXXXXXXXXXXXXXXXXXXXXXXXKXXXXXXXXXXXXXXXXXXXXXXXXXXXXXXXXXXXXXXXXXXXXXXXXXXXXXXXXXXXXXXXXXIXXXXXXXXXXXXXXXXXXXXXXXXXXQWRKILTITKWVFSQKNLWVKKGIPQLFSPGFQNLPFWIK

SEQ ID NO: 26854 - protein, 82 aa, Diabrotica virgifera
  misc_feature: Coding regions on vcDNA: vcDNA=SeqID_6551; Strand=+; Position=1-249
  misc_feature: Homolog annotation: Hit_ID=XP_319019.1; Match level="QueryCoverage =82%, HitCoverage=14%, E-value=2e-24, Identity=75%"; Hit description =ENSANGP00000014772 [Anopheles gambiae]
NRNSGHGNFNPFLGAFISLVGAVCLSMLGLIFPSIFELVTFYEDPGLGRFNWRLWKNMFLIMFGLLGFVTGTYVSIQEIIQG

SEQ ID NO: 26855 - protein, 33 aa, Diabrotica virgifera
  misc_feature: Coding regions on vcDNA: vcDNA=SeqID_6552; Strand=-; Position=76-177
HYLFHVEIGSVLLVIQLNPTSKITEAKANQLYS

SEQ ID NO: 26856 - protein, 54 aa, Diabrotica virgifera
  misc_feature: Coding regions on vcDNA: vcDNA=SeqID_6553; Strand=+; Position=1-162
  misc_feature (6)..(11): Xaa can be any naturally occurring amino acid
  misc_feature (27)..(33): Xaa can be any naturally occurring amino acid
  misc_feature (41)..(46): Xaa can be any naturally occurring amino acid
NFFPWXXXXXXFFVMVGGKLSPILTPXXXXXXXFRPHNLFXXXXXXGKIPSPLL

SEQ ID NO: 26857 - protein, 89 aa, Diabrotica virgifera
  misc_feature: Coding regions on vcDNA: vcDNA=SeqID_6554; Strand=+; Position=2-268
  misc_feature (7)..(7): Xaa can be any naturally occurring amino acid
PPLEGEXISCGEQTRDPRGTTKDNRGDDEDARQADDQGPRFPQTRGRRRRSTPGRLPRKPRAHRGSTEAGRATKTQETDRKRRPRDHTG

SEQ ID NO: 26858 - protein, 71 aa, Diabrotica virgifera
  misc_feature: Coding regions on vcDNA: vcDNA=SeqID_6555; Strand=-; Position=188-403
QASPVMGLLLKLWIGCVLPVVTWPRWLCPSPLCKPAAILHRSTAPRWWVHNFRLLTFYDVISCFLPLLNHW

SEQ ID NO: 26859 - protein, 161 aa, Diabrotica virgifera
  misc_feature: Coding regions on vcDNA: vcDNA=SeqID_6556; Strand=+; Position=186-670
  misc_feature: Homolog annotation: Hit_ID=EAA11440.2; Match level="QueryCoverage =96%, HitCoverage=33%, E-value=2e-58, Identity=70%"; Hit description =ENSANGP00000002547 [Anopheles gambiae str. PEST] ref|XP_557218.1| ENSANGP00000002547 [Anopheles gambiae st
  misc_feature: Gene Ontology Annotation: Molecular function=electron transporter activity; Biological process=UDP-glucose metabolism
  misc_feature: Pfam annotation: Pfam_ID=UDPG_MGDP_dh_N; Match level="Score=130.2, E -value=4.8e-36, Copies=1"; Pfam description=UDP-glucose/GDP-mannose dehydrogenase
  misc_feature (126)..(126): Xaa can be any naturally occurring amino acid
MTIKNICCLGAGYVGGPTCSVIALKCKDIKVTVADLSEERIAQWNSDRLPIYEPGLDKVVQECRGRNLFFTTNLTPAILDADLIFISVNTPTKLNGNGKGRAPDLKYLEGAARIIADTAQTNKIVXEKSTGPVRAAESNSDILTANKKAKVTHQILSNPNF

SEQ ID NO: 26860 - protein, 296 aa, Diabrotica virgifera
  misc_feature: Coding regions on vcDNA: vcDNA=SeqID_6557; Strand=+; Position=2-889
  misc_feature (3)..(216): Xaa can be any naturally occurring amino acid
  misc_feature (218)..(232): Xaa can be any naturally occurring amino acid
  misc_feature (234)..(242): Xaa can be any naturally occurring amino acid
  misc_feature (247)..(255): Xaa can be any naturally occurring amino acid
  misc_feature (259)..(282): Xaa can be any naturally occurring amino acid
YVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXXXXRXXXXXXXXXHKFFXXXXXXXXXFTWXXXXXXXXXXXXXXXXXXXXXXXXINYLGIQRILLRVN

SEQ ID NO: 26861 - protein, 86 aa, Diabrotica virgifera
  misc_feature: Coding regions on vcDNA: vcDNA=SeqID_6558; Strand=+; Position=2-259
  misc_feature (17)..(25): Xaa can be any naturally occurring amino acid
  misc_feature (28)..(53): Xaa can be any naturally occurring amino acid
  misc_feature (62)..(71): Xaa can be any naturally occurring amino acid
SSASSVPFILSLISNSXXXXXXXXXKWXXXXXXXXXXXXXXXXXXXXXXXXXXFTNGGVSTXXXXXXXXXXPKKWVKAHSHLPAYS

SEQ ID NO: 26862 - protein, 64 aa, Diabrotica virgifera
  misc_feature: Coding regions on vcDNA: vcDNA=SeqID_6559; Strand=-; Position=2-193
PHVLKRFASSTPWTYLRRLHRCCIGIRIPYPYQPQKPVQYIGLFRLLTHKGSCQAIFVVYERTI

SEQ ID NO: 26863 - protein, 253 aa, Diabrotica virgifera
  misc_feature: Coding regions on vcDNA: vcDNA=SeqID_6560; Strand=-; Position=0-758
  misc_feature (1)..(239): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKSSYLIFSGYKIA

SEQ ID NO: 26864 - protein, 224 aa, Diabrotica virgifera
  misc_feature: Coding regions on vcDNA: vcDNA=SeqID_6561; Strand=+; Position=85-760
  misc_feature: Homolog annotation: Hit_ID=EAA09916.3; Match level="QueryCoverage =98%, HitCoverage=55%, E-value=6e-84, Identity=66%"; Hit description =ENSANGP00000016260 [Anopheles gambiae str. PEST] ref|XP_558093.1| ENSANGP00000016260 [Anopheles gambiae st
  misc_feature: Gene Ontology Annotation: Molecular function=general RNA polymerase II transcription factor activity; Cellular component=transcription factor TFIIH complex; Biological process=negative regulation of transcription from Pol II
  misc_feature: Pfam annotation: Pfam_ID=Ssl1; Match level="Score=270.0, E-value=4e -78, Copies=1"; Pfam description=Ssl1-like
  misc_feature (3)..(3): Xaa can be any naturally occurring amino acid
  misc_feature (190)..(190): Xaa can be any naturally occurring amino acid
NIXDEDGKEYRWETGYEKTWEAIKEDDEGFLQASVADIVQRAKRKRQALKHGSQKLGMMRHLFLLLDCSEAMASQDLKPTRLICTLKLLEIFLEEFFDQNPISQLGIILMQNKRAERISELAGNCRKHIKMLSNLNRTSLQGEPSLQNGLEMALSSLKLLPSHASREILVVMGSLTTCDPGDITKSIENXKQESVRCSVIGLAAEVHVCRQLANQTHGIYNVIL

SEQ ID NO: 26865 - protein, 215 aa, Diabrotica virgifera
  misc_feature: Coding regions on vcDNA: vcDNA=SeqID_6562; Strand=+; Position=4-651
  misc_feature (41)..(45): Xaa can be any naturally occurring amino acid
MLTNQGLQNFQNNQQTQQGGPKPATLTAGIEEARESPKSSXXXXXSVSTQTAVNQNVQAIITNTSCQTSTISAASPPDTTTMSPVPVASEMQSPILADTTTHTDDGLSPVPLSCTAVRHDNVRSESQSCTMAMVHCISSSEPDPSDGQNPDHPDWKQTLQTNNSNINETYTGGMGHLGKMSSSSTQLVSAESSSSVTSLHYSASDQEPISSSQTF

SEQ ID NO: 26866 - protein, 165 aa, Diabrotica virgifera
  misc_feature: Coding regions on vcDNA: vcDNA=SeqID_6563; Strand=-; Position=59-555
  misc_feature: Homolog annotation: Hit_ID=NP_477379.1; Match level="QueryCoverage =86%, HitCoverage=54%, E-value=1e-21, Identity=36%"; Hit description =CG5277-PA [Drosophila melanogaster] gb|AAF52940.2| CG5277-PA [Drosophila melanogaster]
  misc_feature: Gene Ontology Annotation: Molecular function=molecular_function unknown; Cellular component=nucleus; Biological process=protein biosynthesis
  misc_feature (25)..(25): Xaa can be any naturally occurring amino acid
  misc_feature (44)..(44): Xaa can be any naturally occurring amino acid
  misc_feature (68)..(68): Xaa can be any naturally occurring amino acid
  misc_feature (82)..(82): Xaa can be any naturally occurring amino acid
  misc_feature (109)..(109): Xaa can be any naturally occurring amino acid
PTLREKRGEWGLPIPKGKPHPFAGXVKIVHSGKLQRKAGEGNVXKILLFRRGSSGGPPAFEKFLEPKXLVLERPPSPLPERXPPLRFPSQECQKNPNSPTFPPFGVFSXGAGFEAHTSEMGLVSPTGEGVWGKFPPATHNPAKNGGNNRGPLPLVCFSWFGVKPR

SEQ ID NO: 26867 - protein, 66 aa, Diabrotica virgifera; identical to SEQ ID NO: 26808
  misc_feature: Coding regions on vcDNA: vcDNA=SeqID_6564; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 26868 - protein, 152 aa, Diabrotica virgifera
  misc_feature: Coding regions on vcDNA: vcDNA=SeqID_6565; Strand=+; Position=20-479
  misc_feature: Homolog annotation: Hit_ID=DAA01877.1; Match level="QueryCoverage =96%, HitCoverage=97%, E-value=1e-55, Identity=75%"; Hit description =TPA: troponin C type IIb [Apis mellifera]
  misc_feature: Pfam annotation: Pfam_ID=efhand; Match level="Score=77.3, E-value =4.2e-20, Copies=4"; Pfam description=EF hand
  misc_feature (136)..(136): Xaa can be any naturally occurring amino acid
MTESLDDEQVKLLKRAFSMFDSSKKGNIDLEKVRTILTTLGHHYDDSELDALLSGEDPENTGTVNFDSFCRVAGHFLENEDDETLQKELKDAFRLYDKEGNGYIPTSSLREILAALDDQLTNDQLNEMISEIDTDXSGTVDFQKFMEMMTGK

SEQ ID NO: 26869 - protein, 207 aa, Diabrotica virgifera
  misc_feature: Coding regions on vcDNA: vcDNA=SeqID_6566; Strand=+; Position=2-622
  misc_feature: Homolog annotation: Hit_ID=CAG11252.1; Match level="QueryCoverage =76%, HitCoverage=28%, E-value=5e-47, Identity=60%"; Hit description =unnamed protein product [Tetraodon nigroviridis]
  misc_feature: Gene Ontology Annotation: Molecular function=ATPase activity; Cellular component=spliceosome complex; Biological process=RNA splicing
  misc_feature: Pfam annotation: Pfam_ID=DEAD; Match level="Score=-6.4, E-value=6.9e -05, Copies=1"; Pfam description=DEAD/DEAH box helicase
AEWPGQIGVCEPRRVAAISLANRVADETGTLVQQDTVGYAVRFDACYNKPKIKYMIEAEWPGQIGVCEPRRVAAISLANRVADETGTLVQQDTVGYAVRFDACYNKPKIKYMTEGILLREMMSDPLLKGYSAIMLDEAHERSLYTDILMGLMKKILKRRKDLRLIVASATLDAKELQDFFNNNTTDDKINDTARIMSVEGRQFPVEI

SEQ ID NO: 26870 - protein, 73 aa, Diabrotica virgifera
  misc_feature: Coding regions on vcDNA: vcDNA=SeqID_6567; Strand=+; Position=109-330
  misc_feature (45)..(55): Xaa can be any naturally occurring amino acid
QPPYFANLNGVTHYVWPMWRKKLKFLFYLILIHPGDPYSCSALTXXXXXXXXXXXQKIWVHYQTSSLIVSQKI

SEQ ID NO: 26871 - protein, 73 aa, Diabrotica virgifera
  misc_feature: Coding regions on vcDNA: vcDNA=SeqID_6568; Strand=-; Position=3-224
  misc_feature (4)..(24): Xaa can be any naturally occurring amino acid
  misc_feature (28)..(35): Xaa can be any naturally occurring amino acid
  misc_feature (43)..(73): Xaa can be any naturally occurring amino acid
IYLXXXXXXXXXXXXXXXXXXXXXVFCXXXXXXXXMNKFNSKXXXXXXXXXXXXXXXXXXXXXXXXXXXXXXX

SEQ ID NO: 26872 - protein, 151 aa, Diabrotica virgifera
  misc_feature: Coding regions on vcDNA: vcDNA=SeqID_6569; Strand=+; Position=8-463
  misc_feature: Homolog annotation: Hit_ID=XP_393193.1; Match level="QueryCoverage =66%, HitCoverage=35%, E-value=2e-16, Identity=42%"; Hit description =similar to ENSANGP00000012540 [Apis mellifera]
MFTRKSFIVLFLVSVGLDIAFCVQINYVNVPVAEKNDSNVSDIMDCNYSLRPDDTELDVKWYLNDDLVYQWIPPQLPQSFGKLKDRVDLEYAATDDPKSVYRAMKIFNPTDEIAGEYKCFVSTFTDEDFFIKTMRVFVPEKIFGRFQKWMR

SEQ ID NO: 26873 - protein, 51 aa, Diabrotica virgifera
  misc_feature: Coding regions on vcDNA: vcDNA=SeqID_6570; Strand=+; Position=421-576
  misc_feature (26)..(26): Xaa can be any naturally occurring amino acid
GLEATGSRTIVHERWLPKINAIYIMXLFVWRQRLPRFPKILNGEKFIYQDS

SEQ ID NO: 26874 - protein, 257 aa, Diabrotica virgifera
  misc_feature: Coding regions on vcDNA: vcDNA=SeqID_6571; Strand=+; Position=1-774
  misc_feature: Homolog annotation: Hit_ID=AAB01149.1; Match level="QueryCoverage =97%, HitCoverage=44%, E-value=1e-46, Identity=39%"; Hit description =alpha esterase [Drosophila melanogaster]
  misc_feature: Gene Ontology Annotation: Molecular function=carboxylesterase activity; Cellular component=extracellular space; Biological process= ceramide catabolism
  misc_feature: Pfam annotation: Pfam_ID=COesterase; Match level="Score=-30.8, E -value=7.2e-10, Copies=1"; Pfam description=Carboxylesterase
GDLRFKAPQPADNWEGVLDTVENRKVCVSQGVVDDPALEETEDCLYLNVYTPRYPSSNESLPVIFFIYGGGFVVGYATFDEIGPHYMMEHDVIVVTANYRVGLMGFLSTEDESIPGNFGLKDQHLAFKWVQENIKAFGGNPARVTIMGHSAGSASVAYQLMSKKNQGLFWGGVMLSGSSLSPWSYQRNARKYAYMMAKSLNSSIDENTPSREVRDLFLRVSANDLKHASWKLPAFEDQLISGFMFAPCIEPEGEDAL

SEQ ID NO: 26875 - protein, 40 aa, Diabrotica virgifera
  misc_feature: Coding regions on vcDNA: vcDNA=SeqID_6572; Strand=-; Position=0-119
  misc_feature (2)..(25): Xaa can be any naturally occurring amino acid
  misc_feature (28)..(37): Xaa can be any naturally occurring amino acid
PXXXXXXXXXXXXXXXXXXXXXXXXIGXXXXXXXXXXLFT

SEQ ID NO: 26876 - protein, 93 aa, Diabrotica virgifera
  misc_feature: Coding regions on vcDNA: vcDNA=SeqID_6573; Strand=+; Position=2-283
YYVVFSIFRLVTLFIDRLLLGIRTALYNIPVYSIFLWILNTSSVAGNIHITWKSYDEEGNVTIEAKLEKLPFITSIVKFAPDSVSTTTNQVQN

SEQ ID NO: 26877 - protein, 271 aa, Diabrotica virgifera
  misc_feature: Coding regions on vcDNA: vcDNA=SeqID_6574; Strand=+; Position=18-830
  misc_feature (41)..(261): Xaa can be any naturally occurring amino acid
IYPNYIPRSTSALLQMRSEPIGPHQSRLPRMANAKRPVAPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEYGAPKENRG

SEQ ID NO: 26878 - protein, 75 aa, Diabrotica virgifera
  misc_feature: Coding regions on vcDNA: vcDNA=SeqID_6575; Strand=-; Position=2-226
  misc_feature (1)..(7): Xaa can be any naturally occurring amino acid
  misc_feature (9)..(15): Xaa can be any naturally occurring amino acid
  misc_feature (43)..(50): Xaa can be any naturally occurring amino acid
  misc_feature (54)..(72): Xaa can be any naturally occurring amino acid
XXXXXXXPXXXXXXXFIEKNVEFLKKPILRMFIKSFYWGFFLXXXXXXXXFLTXXXXXXXXXXXXXXXXXXXPFI

SEQ ID NO: 26879 - protein, 263 aa, Diabrotica virgifera
  misc_feature: Coding regions on vcDNA: vcDNA=SeqID_6576; Strand=+; Position=18-809
  misc_feature: Homolog annotation: Hit_ID=XP_308390.1; Match level="QueryCoverage =82%, HitCoverage=50%, E-value=7e-33, Identity=36%"; Hit description =ENSANGP00000009437 [Anopheles gambiae]
  misc_feature: Gene Ontology Annotation: Molecular function=glucose transporter activity; Cellular component=plasma membrane; Biological process =glucose transport
MQKSEKSDGDDDDEKIWPQVLAILIASLGAFSQGVAFAWTSPFIVKLVEDKVNYDISEEEASNLTIVQPLTVIFTCLIFSKIPDIIGRKKTLLLLSIPHITFLIIAAFAKSIYVFYISRMFVGLANSFLWTAMPMYIGEVASPKIRGALGTAITFGLNVGQFGVNVVGSYNDVFTTSCIFLPVPILFVALFSLMPDTPYYYLIKHEDEAARKSLRFLTRKSNVEADLKKLKSDVERQMSEQGTWKDLFLYRKAQKSSLSWIFF

SEQ ID NO: 26880 - protein, 239 aa, Diabrotica virgifera
  misc_feature: Coding regions on vcDNA: vcDNA=SeqID_6577; Strand=+; Position=149-864
  misc_feature: Homolog annotation: Hit_ID=NP_068750.2; Match level="QueryCoverage =88%, HitCoverage=30%, E-value=3e-70, Identity=61%"; Hit description =DEAH (Asp-Glu-Ala-His) box polypeptide 35 [Homo sapiens] emb|CAI22035.1| GD:DDX35 [Homo
  misc_feature: Gene Ontology Annotation: Molecular function=pre-mRNA splicing factor activity; Cellular component=spliceosome complex; Biological process =RNA splicing
  misc_feature: Pfam annotation: Pfam_ID=DEAD; Match level="Score=27.0, E-value=1.1e -07, Copies=1"; Pfam description=DEAD/DEAH box helicase
  misc_feature (218)..(218): Xaa can be any naturally occurring amino acid
MSEFRPKFLKPSDTTSFLDRDDSYSVETTDFVYNRYLSQSIQTQRQRLPIFNNRNHILYLLEKYQTLILIGETGCGKSTQIPQYMIEAEWPGQIGVCEPRRVAAISLANRVADETGTLVQQDTVGYAVRFDACYNKPKIKYMTEGILLREMMSDPLLKGYSAIMLDEAHERSLYTDILMGLMKKILKRRKDLRLIVASATLDAKELQDFFNNNTTDDXKNDTAVIMSVEGRQFPVEIFY

SEQ ID NO: 26881 - protein, 137 aa, Diabrotica virgifera
  misc_feature: Coding regions on vcDNA: vcDNA=SeqID_6578; Strand=+; Position=40-453
  misc_feature: Homolog annotation: Hit_ID=XP_311766.1; Match level="QueryCoverage =67%, HitCoverage=29%, E-value=9e-17, Identity=47%"; Hit description =ENSANGP00000014264 [Anopheles gambiae]
FGSIMAGPKKKSRVPSKSESEGSSNDESDSGTYHGQKEIQATFEGRNPEVQDFHGIKQLLSQLFLKAHIDLSQMSDLLISQHGVGSVLTQSYGDSDRWGRRCSRIRREACERSLRSDKVSFCCQLDIQKLQARREEA

SEQ ID NO: 26882 - protein, 47 aa, Diabrotica virgifera
  misc_feature: Coding regions on vcDNA: vcDNA=SeqID_6579; Strand=+; Position=2-145
  misc_feature (2)..(15): Xaa can be any naturally occurring amino acid
  misc_feature (20)..(20): Xaa can be any naturally occurring amino acid
  misc_feature (27)..(27): Xaa can be any naturally occurring amino acid
  misc_feature (39)..(46): Xaa can be any naturally occurring amino acid
NXXXXXXXXXXXXXXATSMXGLKFIIXCSSYIKLSLVRXXXXXXXXV

SEQ ID NO: 26883 - protein, 78 aa, Diabrotica virgifera
  misc_feature: Coding regions on vcDNA: vcDNA=SeqID_6580; Strand=+; Position=299-532
ENLQDTFLVQNDRQNSDIYVPEKGSVIFCICLKKMLEQFLPKNSCPAPFRFCLRAICLSTDAQETDSAVFSDWKGHHL

SEQ ID NO: 26884 - protein, 139 aa, Diabrotica virgifera
  misc_feature: Coding regions on vcDNA: vcDNA=SeqID_6581; Strand=-; Position=1-417
  misc_feature: Homolog annotation: Hit_ID=NP_886491.1; Match level="QueryCoverage =92%, HitCoverage=19%, E-value=3e-55, Identity=82%"; Hit description =biotin carboxylase subunit of acetyl-CoA carboxylase [Bordetella parapertussis 12822]
  misc_feature: Gene Ontology Annotation: Molecular function=biotin binding; Cellular component=mitochondrion; Biological process=biotin metabolism
  misc_feature: Pfam annotation: Pfam_ID=CPSase_L_chain; Match level="Score=-5.9, E -value=0.0018, Copies=1"; Pfam description=Carbamoyl-phosphate synthase L chain,
  misc_feature (48)..(54): Xaa can be any naturally occurring amino acid
HLVAPCDVAVHIGGPEPRASYLRADAILQAARDTGAGAIHPGYGFLSXXXXXXXAAEQAGIAFVGPPASAIAAMGSKSAAKSLMEKAGVPLVPGYHGDNQDPQFLKEQADAIGYPVLKKASAGGGGKGMRVKGSTPGNS

SEQ ID NO: 26885 - protein, 141 aa, Diabrotica virgifera
  misc_feature: Coding regions on vcDNA: vcDNA=SeqID_6582; Strand=+; Position=391-813
  misc_feature: Homolog annotation: Hit_ID=CAD22154.1; Match level="QueryCoverage =98%, HitCoverage=51%, E-value=3e-19, Identity=37%"; Hit description =pherophorin-dz1 protein [Volvox carteri f. nagariensis]
  misc_feature: Gene Ontology Annotation: Cellular component=extracellular space; Biological process=cell proliferation
  misc_feature (126)..(133): Xaa can be any naturally occurring amino acid
MRPPPGPNERHCSPTTAEEVHRPTLGGAPPIMHHHQRPQTTPHLHQPRQPHPHTQDPDDRPNSRPRLPTPPEPEPRPNAPTVPPSPPASPAGEAPPLTTPTTPPPPTPLPPHPPTTPQPPPTPPPXXXXXXXXPPPRTTPP

SEQ ID NO: 26886 - protein, 32 aa, Diabrotica virgifera
  misc_feature: Coding regions on vcDNA: vcDNA=SeqID_6583; Strand=-; Position=1-96
TERETPYVLFPCSFDIDEPIEIVINAAREMPR

SEQ ID NO: 26887 - protein, 232 aa, Diabrotica virgifera
  misc_feature: Coding regions on vcDNA: vcDNA=SeqID_6584; Strand=+; Position=119-817
  misc_feature: Homolog annotation: Hit_ID=XP_394394.1; Match level="QueryCoverage =87%, HitCoverage=43%, E-value=4e-75, Identity=68%"; Hit description =similar to DNA binding protein [Apis mellifera]
  misc_feature: Gene Ontology Annotation: Molecular function=transcription factor activity; Cellular component=nucleus; Biological process=leg morphogenesis (sensu Holometabola)
  misc_feature: Pfam annotation: Pfam_ID=BTB; Match level="Score=128.3, E-value=1.8e -35, Copies=1"; Pfam description=BTB/POZ domain
MSSQPYRFLPQIPYFKPGIASPAPVMSSQRFCLRWNNHQSNLLSVFDQLLHDESFVDVTLAVEGQLLKAHKMVLSACSPYFQALFMNHPDKHPIVILKDVPYNDMKCLLDFMYRGEVSVDQDRLTAFLRVAESLKIKGLTEVNEEKCDSIASSLTQQNLHNLPNLQRLQQTKRFGNSLNMLSNALLQPKRKRGRPRKLSGCSNGPDDYDKDIVQGSPEMLEVKMGMDNFTGK

SEQ ID NO: 26888 - protein, 59 aa, Diabrotica virgifera
  misc_feature: Coding regions on vcDNA: vcDNA=SeqID_6585; Strand=-; Position=368-547
VCAKTVIERIIIPKWRWAGHIPGTTDGRWAKELLDWRPRKDKIGRPTTRWTDELKRLKT

SEQ ID NO: 26889 - protein, 102 aa, Diabrotica virgifera
  misc_feature: Coding regions on vcDNA: vcDNA=SeqID_6586; Strand=+; Position=282-590
  misc_feature: Homolog annotation: Hit_ID=BAA86911.1; Match level="QueryCoverage =84%, HitCoverage=16%, E-value=2e-10, Identity=41%"; Hit description =homologue of Sarcophaga 26,29kDa proteinase [Periplaneta americana]
  misc_feature (48)..(56): Xaa can be any naturally occurring amino acid
MAAVGSDGTEHDPDTPHSILPDLQGFEYPGIQDYGDRELEVWFLKTVXXXXXXXXXLWVARDEHGKAIPVKYDMKGYHSLSASPYDHYYLLYTSKPNMTSLF

SEQ ID NO: 26890 - protein, 62 aa, Diabrotica virgifera
  misc_feature: Coding regions on vcDNA: vcDNA=SeqID_6587; Strand=+; Position=1-186
  misc_feature (16)..(23): Xaa can be any naturally occurring amino acid
TLRLITMFYIGKSYFXXXXXXXXSRSLGYLLRNLLRRDVRSIRSLTRLSRSSCGAIGDSLRG

SEQ ID NO: 26891 - protein, 37 aa, Diabrotica virgifera
  misc_feature: Coding regions on vcDNA: vcDNA=SeqID_6588; Strand=-; Position=60-170
  misc_feature (37)..(37): Xaa can be any naturally occurring amino acid
YQNNDLLLPSFLQTLSAFYDGMASGELLSKVSISLVX

SEQ ID NO: 26892 - protein, 189 aa, Diabrotica virgifera
  misc_feature: Coding regions on vcDNA: vcDNA=SeqID_6589; Strand=+; Position=58-627
IMESEAYIQWKRLFDDNVLQSYNNEKKELQNAAMLLTALKTEFQNVSRVLELQFDRLKRQLKDNTELKEQITSPGQPILQSIHNSPKLELKVDLPNNETDHRPGLSDLESPDIFINQSLKPVEQVSPTSVIDLSKSDDDTSIEDSPTLISKRKKDVTKKDKIDCLKKNIFRGIDKENFYIEVYSRSQIP

SEQ ID NO: 26893 - protein, 37 aa, Diabrotica virgifera
  misc_feature: Coding regions on vcDNA: vcDNA=SeqID_6590; Strand=-; Position=3-113
  misc_feature (30)..(36): Xaa can be any naturally occurring amino acid
IVFHLRIGHCMALFTKVCKLLSLNITIFLXXXXXXXE

SEQ ID NO: 26894 - protein, 109 aa, Diabrotica virgifera
  misc_feature: Coding regions on vcDNA: vcDNA=SeqID_6591; Strand=+; Position=107-433
LPLPPDAFLVVHEKQYLRALINSDKPNVRYRYRMSHDTSNLPSYALSADSKLHQTAKRLTLQLDYSGGGAATVGGYGSGCGIEKVLRFTHHRIRQKPYPRTNNIVSYAI

SEQ ID NO: 26895 - protein, 175 aa, Diabrotica virgifera
  misc_feature: Coding regions on vcDNA: vcDNA=SeqID_6592; Strand=+; Position=227-751
  misc_feature: Homolog annotation: Hit_ID=EAL28714.1; Match level="QueryCoverage =88%, HitCoverage=36%, E-value=3e-44, Identity=55%"; Hit description =GA20891-PA [Drosophila pseudoobscura]
  misc_feature: Gene Ontology Annotation: Molecular function=3-methyl-2-oxobutanoate dehydrogenase (lipoamide) activity; Cellular component=alpha -ketoglutarate dehydrogenase complex (sensu Eukarya)
  misc_feature (118)..(118): Xaa can be any naturally occurring amino acid
  misc_feature (158)..(158): Xaa can be any naturally occurring amino acid
MTLHNSVCVLLRTFTIKSNLTISVVKKYSSAPLLPGATTTWTEKLEFTGPHTYAPIPVYRVLYRQGNIINTKDDPNLSEDILIKMYKDMTLLGVMDIILYDAQRQGIISFYMTNYGEXASHIGSAAALTNEDVCYGQYREAGVLLWRGSTLQQFVDQXYGNKDNLEKGKSMPVHY

SEQ ID NO: 26896 - protein, 88 aa, Diabrotica virgifera
  misc_feature: Coding regions on vcDNA: vcDNA=SeqID_6593; Strand=+; Position=310-576
  misc_feature (24)..(38): Xaa can be any naturally occurring amino acid
QYYSYESLRSKGVISDKKKILSKXXXXXXXXXXXXXXXKLVFLLGLSNCRHYYFSLQQKIIILLATHFGAIFRILSSTCTLLFLRNAT

SEQ ID NO: 26897 - protein, 66 aa, Diabrotica virgifera; identical to SEQ ID NO: 26808
  misc_feature: Coding regions on vcDNA: vcDNA=SeqID_6594; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 26898 - protein, 88 aa, Diabrotica virgifera
  misc_feature: Coding regions on vcDNA: vcDNA=SeqID_6595; Strand=-; Position=1-264
SCSHKNAVSLSFNSVCISLSPVLIYVRDFWFSVTPSMVRLCMFLLYGCKKNALYIIRSLFGGVLVFDILLVFLQKARCPAPLATRADE

SEQ ID NO: 26899 - protein, 72 aa, Diabrotica virgifera
  misc_feature: Coding regions on vcDNA: vcDNA=SeqID_6596; Strand=-; Position=105-323
LCVLVTDVILIMLIRSFLRLLMLIKCNLSIRIFSMLIIGRFRLVVNLDYLMLASTRVIVNIYLPCICSAVIS

SEQ ID NO: 26900 - protein, 22 aa, Diabrotica virgifera
  misc_feature: Coding regions on vcDNA: vcDNA=SeqID_6597; Strand=+; Position=1-66
  misc_feature (1)..(21): Xaa can be any naturally occurring amino acid
XXXXXXXXXXXXXXXXXXXXXL

SEQ ID NO: 26901 - protein, 56 aa, Diabrotica virgifera
  misc_feature: Coding regions on vcDNA: vcDNA=SeqID_6598; Strand=-; Position=301-471
NELATFSISWRVFFNALLSVATMVISSAYHIICTAFLFIVSAFEIFFVILSSDRIN

SEQ ID NO: 26902 - protein, 103 aa, Diabrotica virgifera
  misc_feature: Coding regions on vcDNA: vcDNA=SeqID_6599; Strand=-; Position=101-412
  misc_feature (63)..(70): Xaa can be any naturally occurring amino acid
LCIFAVVSFLVVFGPFVVTSDVFLHLGIAPFGAFNGDSAKTTFFWGGVVRCYYLQFGARHAIXXXXXXXXLRGHRLARGPFIHIVLVIGRLRKVCICCLLLCS

SEQ ID NO: 26903 - protein, 111 aa, Diabrotica virgifera
  misc_feature: Coding regions on vcDNA: vcDNA=SeqID_6600; Strand=-; Position=2-334
  misc_feature (24)..(35): Xaa can be any naturally occurring amino acid
NNYLTKSNKYFYLYNVNNFPNNVXXXXXXXXXXXXYRQYCLFFFNGAFRSAPNLSFHLFLGRPILLLPNGDLSLAILAILDSDILLMCSFHSSFLFFTQVLKLSTPHRPMH

SEQ ID NO: 26904 - protein, 67 aa, Diabrotica virgifera
  misc_feature: Coding regions on vcDNA: vcDNA=SeqID_6601; Strand=-; Position=567-770
  misc_feature (57)..(63): Xaa can be any naturally occurring amino acid
KPHAHIERGGYQKIMMYALKLFFKGIARQKTIAETPSTSGRISENNDRISCRFCDNXXXXXXXIATH

SEQ ID NO: 26905 - protein, 76 aa, Diabrotica virgifera
  misc_feature: Coding regions on vcDNA: vcDNA=SeqID_6602; Strand=-; Position=96-326
PVLTFGVRINSLLSDLCAIHLSLSFRIFCLNTFSWLMGVVVNSKLVAIWSLFNVSPTNNICYCVCINISHSQYHVY

SEQ ID NO: 26906 - protein, 48 aa, Diabrotica virgifera
  misc_feature: Coding regions on vcDNA: vcDNA=SeqID_6603; Strand=+; Position=354-500
AGQTLNIQCKNPLDIFPILKARQNFTPDSLSNFKLQLFMIIIKQDLLN

SEQ ID NO: 26907 - protein, 238 aa, Diabrotica virgifera
  misc_feature: Coding regions on vcDNA: vcDNA=SeqID_6604; Strand=-; Position=3-716
  misc_feature (4)..(10): Xaa can be any naturally occurring amino acid
  misc_feature (12)..(50): Xaa can be any naturally occurring amino acid
  misc_feature (57)..(68): Xaa can be any naturally occurring amino acid
  misc_feature (84)..(97): Xaa can be any naturally occurring amino acid
  misc_feature (104)..(223): Xaa can be any naturally occurring amino acid
  misc_feature (226)..(237): Xaa can be any naturally occurring amino acid
IYKXXXXXXXPXXXXXXXXXXXXXXXXXXXXXXXXXXXXXXXXXXXXXXXPPLHPTXXXXXXXXXXXXTNKIPLPFKLIIPQSXXXXXXXXXXXXXXLNNNFTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKRXXXXXXXXXXXXL

SEQ ID NO: 26908 - protein, 273 aa, Diabrotica virgifera
  misc_feature: Coding regions on vcDNA: vcDNA=SeqID_6605; Strand=+; Position=100-917
  misc_feature: Homolog annotation: Hit_ID=XP_535099.1; Match level="QueryCoverage =83%, HitCoverage=27%, E-value=2e-19, Identity=29%"; Hit description =PREDICTED: similar to ORF2 [Canis familiaris]
  misc_feature: Gene Ontology Annotation: Molecular function=molecular_function unknown; Cellular component=cellular_component unknown; Biological process=biological_process unknown
  misc_feature (192)..(192): Xaa can be any naturally occurring amino acid
  misc_feature (242)..(242): Xaa can be any naturally occurring amino acid
IHKQIRDEIRSAKENFYKRKCEEIEELQLKHDTFNLHKKVKELAGIQKRKHPNVLYNANGQIITDLQEKLTTWKNYIEELFADEREDHDIGNIQGEEGPKISKEEILYAIKTMKNGKSPGPDGLPSELLKLVEDETVNVLVDLFNCIYKTGEIPKEWLLSTFVTIPKKTNAKLCTDHRTISLMGHTLKVFLXVIHTRIHKKLDADISDTQFGFRNGLGTREALFALNIMCQRCLDVNQDIYXMCFIDYNKAFDKVRHEHLMRLLVEKNLDKRD

SEQ ID NO: 26909 - protein, 80 aa, Diabrotica virgifera
  misc_feature: Coding regions on vcDNA: vcDNA=SeqID_6606; Strand=+; Position=68-310
IRIGLECFAYIGDTVIIGSLRIWRCYRLPFSLLVCRASTTQQYPSSCKLAITVSFFAVHCYPSLDLSMYVPCDLIGVVTI

SEQ ID NO: 26910 - protein, 72 aa, Diabrotica virgifera
  misc_feature: Coding regions on vcDNA: vcDNA=SeqID_6607; Strand=-; Position=527-745
GVRQGCILSPILFNLYPEELFSEALENCEHTREIYLVFPGKKTISREIRRCYSFNYLQNESEENTKYEVVLS

SEQ ID NO: 26911 - protein, 88 aa, Diabrotica virgifera
  misc_feature: Coding regions on vcDNA: vcDNA=SeqID_6608; Strand=-; Position=0-263
  misc_feature (27)..(41): Xaa can be any naturally occurring amino acid
  misc_feature (62)..(71): Xaa can be any naturally occurring amino acid
GEKFSKEFLPQGETPLGRKPLLPPHVXXXXXXXXXXXXXXXKKQEGKNAKKKGKKGRPRKKXXXXXXXXXXQYFWEAFFRGLFFSRGG

SEQ ID NO: 26912 - protein, 198 aa, Diabrotica virgifera
  misc_feature: Coding regions on vcDNA: vcDNA=SeqID_6609; Strand=-; Position=290-885
  misc_feature: Homolog annotation: Hit_ID=XP_313621.1; Match level="QueryCoverage =72%, HitCoverage=32%, E-value=9e-17, Identity=31%"; Hit description =ENSANGP00000024261 [Anopheles gambiae]
  misc_feature: Gene Ontology Annotation: Molecular function=molecular_function unknown; Cellular component=cellular_component unknown; Biological process=biological_process unknown
  misc_feature: Pfam annotation: Pfam_ID=RVT_1; Match level="Score=15.0, E-value=1.5e- 05, Copies=1"; Pfam description=Reverse transcriptase (RNA-dependent
  misc_feature (130)..(130): Xaa can be any naturally occurring amino acid
CHKIWLESPFIPLPKNTQYIHQVKDFRPTSLMSHSLKLPLKIILNRIKQKCEETMGNKQFGFREGLRTREALFSMLTLLQRSSEVQNPNYVCFIDFEKAFDRVQHDKLFEYLEMIGIDDKDLRLYNIYIXNQEASILVDGKETDKICIQRGFRQGRALSLTFFNVYSEIIFNEALEGQCGVREWAMWAKIENDIGKLL

SEQ ID NO: 26913 - protein, 161 aa, Diabrotica virgifera
  misc_feature: Coding regions on vcDNA: vcDNA=SeqID_6610; Strand=+; Position=231-716
  misc_feature (30)..(35): Xaa can be any naturally occurring amino acid
LRWTVTMRIFRNLKFLAISFIALYRIVESXXXXXXRKYGCTWHGGSMAKLSCNCENGAEMTIKADSINSFSTSEILINGCKSVKMEANAVADMRNLRALSLSKIANIQLDTDSINWYGYKENSGQIEEERFDITVPSLKLTFIRVTYPKFKVMLSQVELVK

SEQ ID NO: 26914 - protein, 57 aa, Diabrotica virgifera
  misc_feature: Coding regions on vcDNA: vcDNA=SeqID_6611; Strand=+; Position=486-659
KPSISGSTSAPYQILLVGGTRNIRKKNTFITNLKKDTCHLLEMVKSQRMQVDLIFDL

SEQ ID NO: 26915 - protein, 86 aa, Diabrotica virgifera
  misc_feature: Coding regions on vcDNA: vcDNA=SeqID_6612; Strand=-; Position=57-317
  misc_feature (21)..(30): Xaa can be any naturally occurring amino acid
  misc_feature (41)..(53): Xaa can be any naturally occurring amino acid
FLQHQLEGLLISNTLIFTEKXXXXXXXXXXLVVDTLEVGIXXXXXXXXXXXXXISGWSICTSKGDVDSSWLVIAFTNVNLGKLRGV

SEQ ID NO: 26916 - protein, 23 aa, Diabrotica virgifera
  misc_feature: Coding regions on vcDNA: vcDNA=SeqID_6613; Strand=+; Position=2-70
  misc_feature (9)..(9): Xaa can be any naturally occurring amino acid
GLCNFFETXQWQKSIQHLQFFYS

SEQ ID NO: 26917 - protein, 227 aa, Diabrotica virgifera
  misc_feature: Coding regions on vcDNA: vcDNA=SeqID_6614; Strand=+; Position=168-851
  misc_feature: Homolog annotation: Hit_ID=EAL31013.1; Match level="QueryCoverage =99%, HitCoverage=75%, E-value=2e-52, Identity=44%"; Hit description =GA10878-PA [Drosophila pseudoobscura]
  misc_feature: Gene Ontology Annotation: Molecular function=C-terminal protein carboxyl methyltransferase activity; Cellular component=membrane fraction; Biological process=protein-membrane targeting
  misc_feature: Pfam annotation: Pfam_ID=ICMT; Match level="Score=42.1, E-value=1.6e -09, Copies=1"; Pfam description=Isoprenylcysteine carboxyl methyltran
MVCIQVQIGLKSFFLSFALVAIVAFVQIYYSIIHFWINVLMFSAAGVIDFVLVKVFFRRYFPFQIAVRAAFLGYVFALGIFVKLVVPSHIQIFGSYICVMSFFHFSEFIAIGLVQPKFVSTDSFVLNHSPQYIAAAVSSWVEFFVEYYFFPGMKQFYWVSNIGLGICVLGELLRKTAMLTAGSNFNHLVQCEKFSNHTLVTYGVYGWFRHPSYVRWFYWSIGTQILL

SEQ ID NO: 26918 - protein, 25 aa, Diabrotica virgifera
  misc_feature: Coding regions on vcDNA: vcDNA=SeqID_6615; Strand=-; Position=1-75
  misc_feature (1)..(25): Xaa can be any naturally occurring amino acid
XXXXXXXXXXXXXXXXXXXXXXXXX

SEQ ID NO: 26919 - protein, 128 aa, Diabrotica virgifera
  misc_feature: Coding regions on vcDNA: vcDNA=SeqID_6616; Strand=-; Position=760-1146
  misc_feature (26)..(35): Xaa can be any naturally occurring amino acid
  misc_feature (74)..(80): Xaa can be any naturally occurring amino acid
  misc_feature (88)..(104): Xaa can be any naturally occurring amino acid
PLPPGAGGETKRVFFGGRENIIGVRXXXXXXXXXXEKPQKFLFFKYGVGGGVFVWGGGPKPQKKRVFHPLVFWXXXXXXXPKNSPEEXXXXXXXXXXXXXXXXXPVFQIVFSPFPKRNFVGKKSLLKF

SEQ ID NO: 26920 - protein, 57 aa, Diabrotica virgifera
  misc_feature: Coding regions on vcDNA: vcDNA=SeqID_6617; Strand=-; Position=2-172
VHACTRCVLEHLYIFDVKHNPHPWSPLTLIVQRFHYILITHLVLVLGFHYLCRTKRG

SEQ ID NO: 26921 - protein, 72 aa, Diabrotica virgifera
  misc_feature: Coding regions on vcDNA: vcDNA=SeqID_6618; Strand=+; Position=332-550
  misc_feature (14)..(20): Xaa can be any naturally occurring amino acid
MTSASYSSLNQTSXXXXXXXIFPKSFLDVVQKLRSTRRTYVVSDIVLSARTLWLWQLPRTIMSIFPTTRDLI

SEQ ID NO: 26922 - protein, 107 aa, Diabrotica virgifera
  misc_feature: Coding regions on vcDNA: vcDNA=SeqID_6619; Strand=-; Position=1-321
  misc_feature (3)..(32): Xaa can be any naturally occurring amino acid
  misc_feature (34)..(53): Xaa can be any naturally occurring amino acid
  misc_feature (61)..(103): Xaa can be any naturally occurring amino acid
LKXXXXXXXXXXXXXXXXXXXXXXXXXXXXXXPXXXXXXXXXXXXXXXXXXXXDKLYRVFXXXXXXXXXXXXXXXXXXXXXXXXXXXXXXXXXXXXXXXXXXXPLAT

SEQ ID NO: 26923 - protein, 273 aa, Diabrotica virgifera
  misc_feature: Coding regions on vcDNA: vcDNA=SeqID_6620; Strand=+; Position=69-887
  misc_feature: Homolog annotation: Hit_ID=CAF91436.1; Match level="QueryCoverage =95%, HitCoverage=70%, E-value=2e-24, Identity=28%"; Hit description =unnamed protein product [Tetraodon nigroviridis]
  misc_feature: Gene Ontology Annotation: Molecular function=receptor activity; Cellular component=membrane; Biological process=vitamin B12 transport
  misc_feature: Pfam annotation: Pfam_ID=CUB; Match level="Score=89.4, E-value=9.1e -24, Copies=1"; Pfam description=CUB domain
KVTCVVFCVGKFFNVSLVCQGDFSKENGVITNPETTNKIYSCQWVHQRTDVAKERTFAVALTVNTSHEKSGSACSYSPVLVEITAADKKTSLFKVCATTTAPVVIRSPFLVTKLSAAAAMKFTLNFTATYSTHDCGGMVHDQSGVISSPGFPNKPSKSYECAWLLSVGAGQTINITTLSLSLGDDCEKSYLVVYNGELPTHPRIGKFCKNTKPEVLISQSNKLWIEYKHDQTSTGTGFMLKYEAMSSGCGGVFHDLKRTIKTPNYGGGDYPHK

SEQ ID NO: 26924 - protein, 36 aa, Diabrotica virgifera
  misc_feature: Coding regions on vcDNA: vcDNA=SeqID_6621; Strand=-; Position=1-108
  misc_feature (19)..(36): Xaa can be any naturally occurring amino acid
RGPFEINAVGQAGGVYVMXXXXXXXXXXXXXXXXXX

SEQ ID NO: 26925 - protein, 94 aa, Diabrotica virgifera
  misc_feature: Coding regions on vcDNA: vcDNA=SeqID_6622; Strand=-; Position=300-584
  misc_feature (7)..(43): Xaa can be any naturally occurring amino acid
  misc_feature (45)..(58): Xaa can be any naturally occurring amino acid
  misc_feature (62)..(84): Xaa can be any naturally occurring amino acid
KNWDQKXXXXXXXXXXXXXXXXXXXXXXXXXXXXXXXXXXXXXSXXXXXXXXXXXXXXVVNXXXXXXXXXXXXXXXXXXXXXXXSIKHLMIMVR

SEQ ID NO: 26926 - protein, 18 aa, Diabrotica virgifera
  misc_feature: Coding regions on vcDNA: vcDNA=SeqID_6623; Strand=-; Position=3-56
ICGKIFLLNVDAYRSGRQ

SEQ ID NO: 26927 - protein, 31 aa, Diabrotica virgifera
  misc_feature: Coding regions on vcDNA: vcDNA=SeqID_6624; Strand=-; Position=1-93
PPPLWRGWLFFVFVKPTRFSPEKKKGFSKKI

SEQ ID NO: 26928 - protein, 101 aa, Diabrotica virgifera
  misc_feature: Coding regions on vcDNA: vcDNA=SeqID_6625; Strand=-; Position=2-304
GIISSHQRRLQILLAQIKKCTDNLLLSGINAESYYKHCDEIKLYVQVYDPHILCLTETCITSDFSDSELQIPEYVMARCDSSSRHTGGVIIYTKEYIKVTG

SEQ ID NO: 26929 - protein, 284 aa, Diabrotica virgifera
  misc_feature: Coding regions on vcDNA: vcDNA=SeqID_6626; Strand=+; Position=47-898
  misc_feature: Homolog annotation: Hit_ID=AAL68282.1; Match level="QueryCoverage =84%, HitCoverage=82%, E-value=3e-57, Identity=43%"; Hit description =RE31002p [Drosophila melanogaster]
  misc_feature: Gene Ontology Annotation: Molecular function=protein tyrosine phosphatase activity; Cellular component=extracellular; Biological process=regulation of cell cycle
  misc_feature: Pfam annotation: Pfam_ID=Acid_phosphat_A; Match level="Score=-87.8, E- value=0.0023, Copies=1"; Pfam description=Histidine acid phosphatase
  misc_feature (146)..(146): Xaa can be any naturally occurring amino acid
  misc_feature (209)..(209): Xaa can be any naturally occurring amino acid
  misc_feature (228)..(228): Xaa can be any naturally occurring amino acid
  misc_feature (259)..(259): Xaa can be any naturally occurring amino acid
  misc_feature (268)..(268): Xaa can be any naturally occurring amino acid
MSGNEENNKCMRRWTFICGTVTAMAAVLVFLGVGIKAIHVSGIPDRELKMVHIVMRHGARTPVSTYPNDPYKNDPLYPTGWGQLTNEGKKALYEIGKYYRERYGKFLGDKYSPDEYYTQSTDVDRTKASMMLVNAGLWPPKGEQVXGPLDWQPIPVASEPLSQDMLLLVRKPCPKYHVEKKKVFESKEVKDMLSKYEDLYKELTDITGXKLKILHGVQDIYTTLMAEXEIHLKLPDWTTNYYPDRMYFPTVRSFVLNAXHDQMNMLIXSVSVKKLIEDWSAKSE

SEQ ID NO: 26930 - protein, 42 aa, Diabrotica virgifera
  misc_feature: Coding regions on vcDNA: vcDNA=SeqID_6627; Strand=-; Position=0-125
GRSMLGVLVLIACEAASFFYNYSILKGRAPSSSSCYSRLKGG

SEQ ID NO: 26931 - protein, 185 aa, Diabrotica virgifera
  misc_feature: Coding regions on vcDNA: vcDNA=SeqID_6628; Strand=+; Position=37-591
  misc_feature: Homolog annotation: Hit_ID=XP_312664.1; Match level="QueryCoverage =94%, HitCoverage=51%, E-value=4e-40, Identity=48%"; Hit description =ENSANGP00000020655 [Anopheles gambiae]
  misc_feature: Gene Ontology Annotation: Molecular function=pre-mRNA splicing factor activity; Cellular component=spliceosome complex; Biological process =mRNA splicing
  misc_feature (11)..(11): Xaa can be any naturally occurring amino acid
TFIKTKTCLYXEIARKRKLLEEKELLGTDKKYFKRGELIAKEQEDYRKKYYSLNEADDKSSTISDGDKIESDVQHSILPRQEVITRLRDRSEPVLLFGETEIDAFTRLRKCELLEPEVNKGFRNDFQEAMDQVDQAYLNELLKDSEATKSIEKVDKKKHEATIGYEAIREMAKSMGRGNREHDMT

SEQ ID NO: 26932 - protein, 182 aa, Diabrotica virgifera
  misc_feature: Coding regions on vcDNA: vcDNA=SeqID_6629; Strand=+; Position=2-550
  misc_feature: Homolog annotation: Hit_ID=NP_649989.1; Match level="QueryCoverage =92%, HitCoverage=17%, E-value=5e-76, Identity=79%"; Hit description =CG3999-PA [Drosophila melanogaster] gb|AAF54512.1| CG3999-PA [Drosophila melanogaster]
  misc_feature: Gene Ontology Annotation: Molecular function=glycine dehydrogenase (decarboxylating) activity; Cellular component=mitochondrion; Biological process=glycine metabolism
ANMNAQVGLCRPGDYGSDVSHLNLHKTFCIPHGGGGPGMGPIGVKSHLAPYLPGHPVVMPLGHNGTSEGAVSAAPYGSSAILPISWAYIKMMGPKGLRKATQIAILNANYMSKRLEPHYTTLFKSSTSNLVAHEFIIDTRDFKKTAKIEAADIAKRLMDYGFHADFVSIYKTRNKRYLKRPL

SEQ ID NO: 26933 - protein, 196 aa, Diabrotica virgifera
  misc_feature: Coding regions on vcDNA: vcDNA=SeqID_6630; Strand=+; Position=72-791
  misc_feature: Homolog annotation: Hit_ID=CAF99142.1; Match level="QueryCoverage =64%, HitCoverage=5%, E-value=4e-33, Identity=62%"; Hit description =unnamed protein product [Tetraodon nigroviridis]
MQNVSQESSTDNPKIDKVTVLHELGNSSSTPQSTTSNSSPAKSETETYSEHRRYMSETSESEEDSVSEVESFMIDQEFEDDPQVEAAKFLLNPDEDRAVDPETQARLEQLLQAAGIGQLARQDGKHLGDPEVLRRLTSSVSCALDEAAAALTRMRSDNPPNRSSNTKKTSLVEACTDGDVRTVRNCSQRSIRTRNF

SEQ ID NO: 26934 - protein, 313 aa, Diabrotica virgifera
  misc_feature: Coding regions on vcDNA: vcDNA=SeqID_6631; Strand=+; Position=1-939
  misc_feature: Homolog annotation: Hit_ID=EAL39466.1; Match level="QueryCoverage =99%, HitCoverage=32%, E-value=3e-88, Identity=48%"; Hit description =ENSANGP00000026260 [Anopheles gambiae str. PEST] ref|XP_554687.1| ENSANGP00000026260 [Anopheles gambiae st
  misc_feature: Pfam annotation: Pfam_ID=RVT_1; Match level="Score=172.5, E-value =9.2e-49, Copies=1"; Pfam description=Reverse transcriptase (RNA -dependent D
  misc_feature (191)..(203): Xaa can be any naturally occurring amino acid
  misc_feature (247)..(247): Xaa can be any naturally occurring amino acid
  misc_feature (257)..(257): Xaa can be any naturally occurring amino acid
  misc_feature (261)..(261): Xaa can be any naturally occurring amino acid
  misc_feature (272)..(272): Xaa can be any naturally occurring amino acid
  misc_feature (275)..(275): Xaa can be any naturally occurring amino acid
  misc_feature (277)..(277): Xaa can be any naturally occurring amino acid
  misc_feature (296)..(296): Xaa can be any naturally occurring amino acid
  misc_feature (298)..(298): Xaa can be any naturally occurring amino acid
  misc_feature (303)..(303): Xaa can be any naturally occurring amino acid
RIKHNIRTNPENASPIYTRNYRHPHVHKKEVNKQITKLLEQGIIRDSVSPWNSPFFIVPKKPDENNVQKWRIVIDFRKLNLITVDDRFPIPNISDIFDLLNTSKFFSTIDLASGFHQIPMNPEDIEKTAFSTENGHFEFTRMPFGLKNAPSTFARVMNDIFREHIGKTCFIYMDDILIFSNTVEDHLKNIXXXXXXXXXXXXXIEPDKCKFLTDEITFLGHLLTPEGIKPDPKKIQAILDFPVPQNXTECKSFLGLXWLYXEFVNNFADLTXPLXRXVKKNIKFHGTPEVVECFDXMXTFFDXEKILGYPNFS

SEQ ID NO: 26935 - protein, 171 aa, Diabrotica virgifera
  misc_feature: Coding regions on vcDNA: vcDNA=SeqID_6632; Strand=+; Position=3-518
  misc_feature: Homolog annotation: Hit_ID=XP_313130.1; Match level="QueryCoverage =98%, HitCoverage=29%, E-value=6e-64, Identity=67%"; Hit description =ENSANGP00000012911 [Anopheles gambiae]
  misc_feature: Gene Ontology Annotation: Molecular function=ligand-dependent nuclear receptor activity; Biological process=calcium ion homeostasis
  misc_feature: Pfam annotation: Pfam_ID=Hormone_recep; Match level="Score=25.8, E -value=7.2e-06, Copies=1"; Pfam description=Ligand-binding domain of nuclear horm
NMCQEDQVALLKGGCTEVMMVKSAIYYDTKIQSWEIPHTSEKFMVNSKILKLINKGNVYNEHETFIKTFSPLWKGDENIILILCMILLFSPDRPKVVHQDVIKLEQNAYYYLLRRYLESIYPGCEAKSVFLKLMQKLGDVRRVNEELISVYLNINPTDVEPLLIEIFDLHR

SEQ ID NO: 26936 - protein, 52 aa, Diabrotica virgifera
  misc_feature: Coding regions on vcDNA: vcDNA=SeqID_6633; Strand=+; Position=397-555
  misc_feature (6)..(13): Xaa can be any naturally occurring amino acid
  misc_feature (44)..(52): Xaa can be any naturally occurring amino acid
GKYARXXXXXXXXLKMFHYVVFFIHNFYFLPLYTLTGFYYNITXXXXXXXXX

SEQ ID NO: 26937 - protein, 238 aa, Diabrotica virgifera
  misc_feature: Coding regions on vcDNA: vcDNA=SeqID_6634; Strand=+; Position=32-745
  misc_feature: Homolog annotation: Hit_ID=NP_477008.1; Match level="QueryCoverage =100%, HitCoverage=57%, E-value=2e-66, Identity=52%"; Hit description= CG4758-PA, isoform A [Drosophila melanogaster] gb|AAF52847.1| CG4758 -PA, isoform A [Drosophila
  misc_feature: Pfam annotation: Pfam_ID=Sec62; Match level="Score=41.2, E-value=1.1e- 11, Copies=1"; Pfam description=Translocation protein Sec62
  misc_feature (133)..(141): Xaa can be any naturally occurring amino acid
  misc_feature (158)..(167): Xaa can be any naturally occurring amino acid
MAEKKRGKKRKDEYVHPGEEIDDKPTKEEITVAKWMRSNVQIKKTKFANHNVEYFTGARAVDALLNSPFATKDDPLFKTREGIADYLHVMLTHKLFHRARKVPVDEQELKGKKGKKKDKKEDKEKKDSGEDEXXXXXXXXXVTDAESSVVEGSKDQKXXXXXXXXXXKLEMHYDQRFEDNLDAYVWIYDPIPFHYWIIGTFLVLGAIGICLFPLWPPSVRLGVYYLSVPAAGFLVSII

SEQ ID NO: 26938 - protein, 216 aa, Diabrotica virgifera
  misc_feature: Coding regions on vcDNA: vcDNA=SeqID_6635; Strand=+; Position=1-647
  misc_feature: Homolog annotation: Hit_ID=NP_996420.1; Match level="QueryCoverage =100%, HitCoverage=11%, E-value=1e-101, Identity=80%"; Hit description=CG1522-PB, isoform B [Drosophila melanogaster] gb|AAS65326.1| CG1522-PB, isoform B [Drosophila
  misc_feature: Gene Ontology Annotation: Molecular function=voltage-gated calcium channel activity; Cellular component=voltage-gated calcium channel complex; Biological process=male courtship behavior (sensu Insecta), song production
  misc_feature: Pfam annotation: Pfam_ID=efhand; Match level="Score=23.9, E-value =0.00049, Copies=1"; Pfam description=EF hand
  misc_feature (206)..(206): Xaa can be any naturally occurring amino acid
LLFRCATGENWPSIMLSCVKGKMCDENSGKDGHQCGHNIAYAYFVSFIFFCSFLMLNLFVAVIMDNFDYLTRDPSILGAHHLDEFVRIWAEYDPNATGKIHYSEMYDMLKNMDPPLGFGNKCPNRLAYKKLIRMNMPVDDDGKVNFTTTFFALVRENLSIKMRTADEMDQADDELKETIKNIWPIQAKNMVELLVPPTNQLTTGKXSVGKLYAGLL

SEQ ID NO: 26939 - protein, 66 aa, Diabrotica virgifera
  misc_feature: Coding regions on vcDNA: vcDNA=SeqID_6636; Strand=-; Position=1-198
  misc_feature (4)..(12): Xaa can be any naturally occurring amino acid
  misc_feature (21)..(21): Xaa can be any naturally occurring amino acid
  misc_feature (23)..(30): Xaa can be any naturally occurring amino acid
  misc_feature (34)..(45): Xaa can be any naturally occurring amino acid
  misc_feature (52)..(64): Xaa can be any naturally occurring amino acid
SFRXXXXXXXXXGNQPGSHGXNXXXXXXXXRTDXXXXXXXXXXXXIQHRGRXXXXXXXXXXXXXLL

SEQ ID NO: 26940 - protein, 131 aa, Diabrotica virgifera
  misc_feature: Coding regions on vcDNA: vcDNA=SeqID_6637; Strand=+; Position=135-530
FEGDDDEIEAEDEEDAQGEGVQEDEDDDRIIKRVPSKPSRSFFFSPPLSSAYAYVVTLWTSLFFLSQLVRCSVRALIPLGMLSRSPNVCLWTPIPHQYSHPFDSSLSSYLSHPDTLGDLCPAGAQGSSGDP

SEQ ID NO: 26941 - protein, 225 aa, Diabrotica virgifera
  misc_feature: Coding regions on vcDNA: vcDNA=SeqID_6638; Strand=-; Position=65-741
  misc_feature: Homolog annotation: Hit_ID=AAC46945.1; Match level="QueryCoverage =87%, HitCoverage=57%, E-value=3e-37, Identity=42%"; Hit description =mariner transposase pir||S35520 transposase - lacewing
  misc_feature: Gene Ontology Annotation: Molecular function=transposase activity; Cellular component=cellular_component unknown; Biological process =DNA transposition
  misc_feature: Pfam annotation: Pfam_ID=Transposase_1; Match level="Score=43.2, E -value=7.7e-10, Copies=1"; Pfam description=Transposase
  misc_feature (6)..(6): Xaa can be any naturally occurring amino acid
  misc_feature (62)..(62): Xaa can be any naturally occurring amino acid
  misc_feature (94)..(94): Xaa can be any naturally occurring amino acid
  misc_feature (127)..(127): Xaa can be any naturally occurring amino acid
  misc_feature (153)..(153): Xaa can be any naturally occurring amino acid
IGWYPXFTQDNKRHHETTLEQYLRLFKRNLKEFLHCFIIIDETWIHQYSPETKEQLIQWTSXPRTKKAKTVLTTEKVMTTVFWDSQSVIYISFXEKKGKTVTGLYFGALLDRFDADLQKKQPQLGKXKVLFYDNAPAYTFAVAMAKLVDSDYXLLSHPLYSPDLALCDFFSFPNLKSHSSGRNVSRFSEFIAAIDVYFTDLQKLKQLKLGEASLGHVYRARRRQY

SEQ ID NO: 26942 - protein, 273 aa, Diabrotica virgifera
  misc_feature: Coding regions on vcDNA: vcDNA=SeqID_6639; Strand=+; Position=88-909
  misc_feature: Homolog annotation: Hit_ID=CAG12188.1; Match level="QueryCoverage =93%, HitCoverage=22%, E-value=8e-45, Identity=39%"; Hit description =unnamed protein product [Tetraodon nigroviridis]
  misc_feature: Gene Ontology Annotation: Molecular function=DNA (cytosine-5-) -methyltransferase activity; Cellular component=nucleus; Biological process=DNA methylation
  misc_feature: Pfam annotation: Pfam_ID=BAH; Match level="Score=63.3, E-value=6.8e -16, Copies=1"; Pfam description=BAH domain
  misc_feature (100)..(106): Xaa can be any naturally occurring amino acid
  misc_feature (184)..(184): Xaa can be any naturally occurring amino acid
MFKKQQTPTLVNNCIKGTGVFLDPDVYTFNNYSKVAKENNENQLDTVLYPEYFRKSDSVKGSNENTVSPFVIGIIEDIKEPKNKNIKIEVRIFFRPEHTXXXXXXXYTKDLNYLFYSDEVITVPFDKVMGKCYLSYGYNFESPTEWSELGPYRFYFTEAYDPENKKITELPTNAKNIGIKGKGXGGGKIKGKAKLENDLADLPPVWDKVDRPLRCMDVFAGCGGLSEGLKMSNIADSRWAIEKKYLQQIAFQMKNPKLESISRMACNNLVKIE

SEQ ID NO: 26943 - protein, 98 aa, Diabrotica virgifera
  misc_feature: Coding regions on vcDNA: vcDNA=SeqID_6640; Strand=-; Position=702-998
  misc_feature (24)..(31): Xaa can be any naturally occurring amino acid
KFVESQTPWKCSREEGAVSPPRGXXXXXXXXCWAKGSRWALFRKLIRPKKIQTPIKSVGIQKMYFHAKTLLKKNSPKNLGGIVPHHYHVYFSPRSLFP

SEQ ID NO: 26944 - protein, 56 aa, Diabrotica virgifera
  misc_feature: Coding regions on vcDNA: vcDNA=SeqID_6641; Strand=-; Position=256-426
  misc_feature (14)..(21): Xaa can be any naturally occurring amino acid
RVTTGITLGITCLXXXXXXXXQVVIYNFFSYLIYNISIIIVFSRYKTFICRYALGE

SEQ ID NO: 26945 - protein, 219 aa, Diabrotica virgifera
  misc_feature: Coding regions on vcDNA: vcDNA=SeqID_6642; Strand=-; Position=2-658
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(217): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAL

SEQ ID NO: 26946 - protein, 292 aa, Diabrotica virgifera
  misc_feature: Coding regions on vcDNA: vcDNA=SeqID_6643; Strand=-; Position=96-974
  misc_feature (22)..(43): Xaa can be any naturally occurring amino acid
  misc_feature (46)..(287): Xaa can be any naturally occurring amino acid
GQSFIIEFDLFQIKLRLYPLGXXXXXXXXXXXXXXXXXXXXXXKGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLITNC

SEQ ID NO: 26947 - protein, 208 aa, Diabrotica virgifera
  misc_feature: Coding regions on vcDNA: vcDNA=SeqID_6644; Strand=+; Position=131-757
  misc_feature: Homolog annotation: Hit_ID=XP_310426.1; Match level="QueryCoverage =63%, HitCoverage=80%, E-value=2e-34, Identity=57%"; Hit description =ENSANGP00000017933 [Anopheles gambiae]
  misc_feature (28)..(33): Xaa can be any naturally occurring amino acid
MTPMKEASPPVSAMATPTNSSGNLVDEXXXXXXHCLNVLTKEEALPTSDKDEVKVEVEQTTLRFIDLARQMEAFFLQKRFLLSALKPEMNVKEDISELRLELARKEELLKRHYEKIAVWQNLLADIQSYSKSPAQSSATPGTSSIPPSPLPSIPGNQTPNQMISNIPCYNATTITAATATTTATTGANTQQMQQMQQPQLQQMQGDRR

SEQ ID NO: 26948 - protein, 90 aa, Diabrotica virgifera
  misc_feature: Coding regions on vcDNA: vcDNA=SeqID_6645; Strand=+; Position=139-411
MVILPLTILEIKMQVRGTPKTNYPDTSMIMKTAKKNLMIIGGLSVATNALILLMLHLNSNSPDMASTLAMDMHRNILDMLDHDILKNTPL

SEQ ID NO: 26949 - protein, 183 aa, Diabrotica virgifera
  misc_feature: Coding regions on vcDNA: vcDNA=SeqID_6646; Strand=-; Position=0-548
  misc_feature (3)..(11): Xaa can be any naturally occurring amino acid
  misc_feature (14)..(27): Xaa can be any naturally occurring amino acid
  misc_feature (38)..(73): Xaa can be any naturally occurring amino acid
  misc_feature (77)..(86): Xaa can be any naturally occurring amino acid
  misc_feature (91)..(155): Xaa can be any naturally occurring amino acid
  misc_feature (161)..(178): Xaa can be any naturally occurring amino acid
PPXXXXXXXXXKGXXXXXXXXXXXXXXKRKERGGVLFXXXXXXXXXXXXXXXXXXXXXXXXXXXXXXXXXXXXPFSXXXXXXXXXXEGREXXXXXXXXXXXXXXXXXXXXXXXXXXXXXXXXXXXXXXXXXXXXXXXXXXXXXXXXXXXXXXXXXGGAGGXXXXXXXXXXXXXXXXXXNKTPP

SEQ ID NO: 26950 - protein, 161 aa, Diabrotica virgifera
  misc_feature: Coding regions on vcDNA: vcDNA=SeqID_6647; Strand=+; Position=3-488
  misc_feature (1)..(44): Xaa can be any naturally occurring amino acid
  misc_feature (58)..(72): Xaa can be any naturally occurring amino acid
  misc_feature (99)..(125): Xaa can be any naturally occurring amino acid
  misc_feature (130)..(158): Xaa can be any naturally occurring amino acid
XXXXXXXXXXXXXXXXXXXXXXXXXXXXXXXXXXXXXXXXXXXXDELTNKILSKFNFXXXXXXXXXXXXXXXIIHFHILLFSILINSLLKYKFQLFLFXXXXXXXXXXXXXXXXXXXXXXXXXXXLFTCXXXXXXXXXXXXXXXXXXXXXXXXXXXXXQVS

SEQ ID NO: 26951 - protein, 115 aa, Diabrotica virgifera
  misc_feature: Coding regions on vcDNA: vcDNA=SeqID_6648; Strand=-; Position=85-432
KYMSYSLSGPRQKKQKVDPIHSCSLLVLSMRQGLILYFGLAPVPCRRIQLCVCLLDVAHMYSSHLFNLMVFLSHILLCYFLFSASMPHFSTKLFIYIMIPNMTLTHILKLVKDLL

SEQ ID NO: 26952 - protein, 15 aa, Diabrotica virgifera
  misc_feature: Coding regions on vcDNA: vcDNA=SeqID_6649; Strand=+; Position=2-49
LYLNSGQPLYIILIY

SEQ ID NO: 26953 - protein, 213 aa, Diabrotica virgifera
  misc_feature: Coding regions on vcDNA: vcDNA=SeqID_6650; Strand=+; Position=259-900
  misc_feature: Homolog annotation: Hit_ID=XP_318072.1; Match level="QueryCoverage =96%, HitCoverage=30%, E-value=1e-36, Identity=42%"; Hit description =ENSANGP00000010699 [Anopheles gambiae]
  misc_feature: Gene Ontology Annotation: Molecular function=protein binding; Biological process=negative regulation of macrophage differentiation
  misc_feature (84)..(94): Xaa can be any naturally occurring amino acid
  misc_feature (184)..(184): Xaa can be any naturally occurring amino acid
MCMVKKLNRTDKIRHVHGKETLTTEKQKCDSIKLTYQNLVYERHHLVTETNKCLAFRSKDEDIELVPFEEFMREAPESLSSKFXXXXXXXXXXXHSLRLARLEWELTQRKNLAQLCKAFLEQKKKLSEDLLLRKDKLTALTPLLVNVINATKPLQDHLEMSPSGLRVEHKLAYLLPDPLYIFYXHVVSYKVVYDINLDVEIIGDEEKLTDGKI

SEQ ID NO: 26954 - protein, 117 aa, Diabrotica virgifera
  misc_feature: Coding regions on vcDNA: vcDNA=SeqID_6651; Strand=+; Position=457-810
  misc_feature (23)..(31): Xaa can be any naturally occurring amino acid
  misc_feature (96)..(101): Xaa can be any naturally occurring amino acid
  misc_feature (108)..(115): Xaa can be any naturally occurring amino acid
VIGRAFDYRSRGPAFKSGQFIFXXXXXXXXXGVLLINIFERTKVLTHSFFWDNLSPSCIFSTFYLCGVFCNSYFYDVLRLPWGYGSILFTPMIAFXXXXXXLIRCSHXXXXXXXXRE

SEQ ID NO: 26955 - protein, 89 aa, Diabrotica virgifera
  misc_feature: Coding regions on vcDNA: vcDNA=SeqID_6652; Strand=+; Position=192-461
DTARSIDIRRRCKVENNNNWVRSKKVEWNDQISRMTTNRVVSPYSSEDQDSLLYQLLPHLLLVVDYSVSGGVALVTCVYLLGGESRNLI

SEQ ID NO: 26956 - protein, 212 aa, Diabrotica virgifera
  misc_feature: Coding regions on vcDNA: vcDNA=SeqID_6653; Strand=-; Position=2-637
  misc_feature (3)..(12): Xaa can be any naturally occurring amino acid
  misc_feature (24)..(31): Xaa can be any naturally occurring amino acid
  misc_feature (34)..(47): Xaa can be any naturally occurring amino acid
  misc_feature (53)..(66): Xaa can be any naturally occurring amino acid
  misc_feature (68)..(208): Xaa can be any naturally occurring amino acid
PLXXXXXXXXXXRKPTWLTPGLNXXXXXXXXSNXXXXXXXXXXXXXXPTSRSXXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEFPL

SEQ ID NO: 26957 - protein, 237 aa, Diabrotica virgifera
  misc_feature: Coding regions on vcDNA: vcDNA=SeqID_6654; Strand=+; Position=3-716
  misc_feature: Homolog annotation: Hit_ID=NP_503166.1; Match level="QueryCoverage =97%, HitCoverage=30%, E-value=3e-30, Identity=33%"; Hit description =predicted CDS, reverse transcriptase family member (5A739) [Caenorhabditis elegans]
  misc_feature (47)..(47): Xaa can be any naturally occurring amino acid
  misc_feature (67)..(67): Xaa can be any naturally occurring amino acid
  misc_feature (97)..(97): Xaa can be any naturally occurring amino acid
  misc_feature (122)..(122): Xaa can be any naturally occurring amino acid
  misc_feature (140)..(140): Xaa can be any naturally occurring amino acid
HLRFADDIVLFSTDINELEQMMKELNQQSNKIGFKINLQKTKIICTXVIYKLILLLTTSVLKMETTXLYKYLEHTIKIGKENQIVEIKRRIQLSWIXFVLSFILKNKYIIPMCLKRRIYDKXYLPVTTYGLETMAFTKKXLEQLSTTQRAMERAMLGISLRDRIRNIDIRERTKITDVAERIARLKWQWVGHVARDNTEKWIPRLTNWRPIENRRGVGRPQKRWADDIKQVPCQARE

SEQ ID NO: 26958 - protein, 108 aa, Diabrotica virgifera
  misc_feature: Coding regions on vcDNA: vcDNA=SeqID_6655; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid
NYAVIPKEIYSYXXXXXXXXXXXXXXXXXXXXXXXXXPXXXXXXXXXXXXXXXXXXXXXXSIGSSXXXXXXXLFXXXXXXXXXXXXXXXXXXXPSFQXXXXXXXXMLP

SEQ ID NO: 26959 - protein, 84 aa, Diabrotica virgifera
  misc_feature: Coding regions on vcDNA: vcDNA=SeqID_6656; Strand=+; Position=126-377
  misc_feature: Homolog annotation: Hit_ID=AAH68615.1; Match level="QueryCoverage =96%, HitCoverage=34%, E-value=2e-14, Identity=45%"; Hit description =MGC78821 protein [Xenopus laevis]
RKEEQSRISQAMTIVANANKLQDPLEPFPVFRKFNKNGVEAEVFVKKAADLDQNGKDWGFIFTKKNMQVKYEKCTWGWWDRINV

SEQ ID NO: 26960 - protein, 30 aa, Diabrotica virgifera
  misc_feature: Coding regions on vcDNA: vcDNA=SeqID_6657; Strand=-; Position=9-101
DLHFITVVFEPIYYSSSVSPLGKVMSENSQ

SEQ ID NO: 26961 - protein, 51 aa, Diabrotica virgifera
  misc_feature: Coding regions on vcDNA: vcDNA=SeqID_6658; Strand=-; Position=7-162
PAPKNTETLKKVLNPLEKPFFGGGKLFKGFFPGWGNPSLDDTPLRAPQLDF

SEQ ID NO: 26962 - protein, 57 aa, Diabrotica virgifera
  misc_feature: Coding regions on vcDNA: vcDNA=SeqID_6659; Strand=+; Position=216-389
TLYLFNKIDCRIIVSNQFITDGNKTRLILRTHHIQYFHENFTLIKYYRPYLEIYNSI

SEQ ID NO: 26963 - protein, 97 aa, Diabrotica virgifera
  misc_feature: Coding regions on vcDNA: vcDNA=SeqID_6660; Strand=+; Position=271-564
  misc_feature (32)..(39): Xaa can be any naturally occurring amino acid
  misc_feature (56)..(62): Xaa can be any naturally occurring amino acid
QKQTLQDLIQIIHFEKNLLVVYYHASVSEEYXXXXXXXXCFFFKYFSYCFIDLEAXXXXXXXILYFFSVALRFPLHEFDDNFSFWLVLAINGMMTIM

SEQ ID NO: 26964 - protein, 281 aa, Diabrotica virgifera
  misc_feature: Coding regions on vcDNA: vcDNA=SeqID_6661; Strand=+; Position=1-843
  misc_feature: Homolog annotation: Hit_ID=AAB53258.1; Match level="QueryCoverage =94%, HitCoverage=11%, E-value=6e-33, Identity=35%"; Hit description =p270 [Bombyx mori] pir||T18201 fatty-acid synthase homolog p270 - silkworm
  misc_feature: Gene Ontology Annotation: Cellular component=mitochondrion; Biological process=polar body extrusion after meiotic divisions
  misc_feature (127)..(153): Xaa can be any naturally occurring amino acid
  misc_feature (171)..(171): Xaa can be any naturally occurring amino acid
HKDCLTRKDVYKELRLRGYNYSGEFQNIQAFNPSDKSGLIKWTDNWIAFLDNMLQLKIVTTDTRLLYVPTYISKLTIPSKSVLEWVNRGYLQKQVEPILPVYINEETSEIKCGNIVIQGLIASSIAXXXXXXXXXXXXXXXXXXXXXXXXXXXIRVNLQIICENALARKSXVIELIDEYAAQESILIPLLQNAFGDQPLLQALVKVLAKTRPEYVPEEIEVEDKELATETDCQIIIGFKLTERKEVLKTAAKCLKDHGFLISREDINFDSSMSDVEDFTVF

SEQ ID NO: 26965 - protein, 132 aa, Diabrotica virgifera
  misc_feature: Coding regions on vcDNA: vcDNA=SeqID_6662; Strand=+; Position=51-446
  misc_feature (2)..(2): Xaa can be any naturally occurring amino acid
  misc_feature (4)..(5): Xaa can be any naturally occurring amino acid
  misc_feature (7)..(7): Xaa can be any naturally occurring amino acid
  misc_feature (11)..(11): Xaa can be any naturally occurring amino acid
  misc_feature (14)..(14): Xaa can be any naturally occurring amino acid
  misc_feature (17)..(17): Xaa can be any naturally occurring amino acid
  misc_feature (22)..(22): Xaa can be any naturally occurring amino acid
  misc_feature (24)..(24): Xaa can be any naturally occurring amino acid
  misc_feature (26)..(26): Xaa can be any naturally occurring amino acid
  misc_feature (30)..(32): Xaa can be any naturally occurring amino acid
  misc_feature (35)..(37): Xaa can be any naturally occurring amino acid
  misc_feature (40)..(40): Xaa can be any naturally occurring amino acid
  misc_feature (42)..(42): Xaa can be any naturally occurring amino acid
  misc_feature (44)..(45): Xaa can be any naturally occurring amino acid
  misc_feature (49)..(49): Xaa can be any naturally occurring amino acid
  misc_feature (57)..(58): Xaa can be any naturally occurring amino acid
  misc_feature (60)..(60): Xaa can be any naturally occurring amino acid
  misc_feature (68)..(69): Xaa can be any naturally occurring amino acid
  misc_feature (72)..(73): Xaa can be any naturally occurring amino acid
  misc_feature (80)..(80): Xaa can be any naturally occurring amino acid
  misc_feature (85)..(86): Xaa can be any naturally occurring amino acid
  misc_feature (88)..(89): Xaa can be any naturally occurring amino acid
  misc_feature (96)..(97): Xaa can be any naturally occurring amino acid
  misc_feature (100)..(101): Xaa can be any naturally occurring amino acid
  misc_feature (108)..(110): Xaa can be any naturally occurring amino acid
  misc_feature (112)..(112): Xaa can be any naturally occurring amino acid
  misc_feature (114)..(114): Xaa can be any naturally occurring amino acid
  misc_feature (116)..(116): Xaa can be any naturally occurring amino acid
  misc_feature (118)..(118): Xaa can be any naturally occurring amino acid
  misc_feature (121)..(129): Xaa can be any naturally occurring amino acid
KXYXXWXKEIXSMXDVXIKNSXVXLXKIIXXXNKXXXFVXYXCXXNIKXELENIEDXXKXFLIYGNIXXLVXXRVRKGFXRMGLXXDXXLIMKKVXXKLXXEIRWRVXXXLXMXDXKXVIXXXXXXXXXLFV

SEQ ID NO: 26966 - protein, 61 aa, Diabrotica virgifera
  misc_feature: Coding regions on vcDNA: vcDNA=SeqID_6663; Strand=+; Position=73-258
NVWGTRSSAVWNFTLSFLWPGLRFTTLYNIEHQTLLPNFFCRNLVVLQFLIPVVLIPSSMR

SEQ ID NO: 26967 - protein, 65 aa, Diabrotica virgifera
  misc_feature: Coding regions on vcDNA: vcDNA=SeqID_6664; Strand=+; Position=20-217
  misc_feature: Homolog annotation: Hit_ID=XP_313365.1; Match level="QueryCoverage =70%, HitCoverage=5%, E-value=3e-14, Identity=80%"; Hit description =ENSANGP00000011815 [Anopheles gambiae]
  misc_feature (47)..(47): Xaa can be any naturally occurring amino acid
LIQEVYAQSKVSFAPSVQLIKKCIESLIDKQYIERTPQSSEEYSYVXVEDRLMDAVRFYKRHIFL

SEQ ID NO: 26968 - protein, 29 aa, Diabrotica virgifera
  misc_feature: Coding regions on vcDNA: vcDNA=SeqID_6665; Strand=-; Position=1-87
  misc_feature (15)..(22): Xaa can be any naturally occurring amino acid
HLPTNNLLYNLSKGXXXXXXXXGNFPFIG

SEQ ID NO: 26969 - protein, 60 aa, Diabrotica virgifera
  misc_feature: Coding regions on vcDNA: vcDNA=SeqID_6666; Strand=+; Position=175-357
  misc_feature (37)..(47): Xaa can be any naturally occurring amino acid
LPSHGTKGPTQTLFKYSVLFMLQLISPTWRSDFDIVXXXXXXXXXXXACFLRMLLCVCVR

SEQ ID NO: 26970 - protein, 234 aa, Diabrotica virgifera
  misc_feature: Coding regions on vcDNA: vcDNA=SeqID_6667; Strand=-; Position=0-701
  misc_feature (19)..(26): Xaa can be any naturally occurring amino acid
  misc_feature (32)..(40): Xaa can be any naturally occurring amino acid
  misc_feature (85)..(222): Xaa can be any naturally occurring amino acid
RFNPLLLRFVIWVFLVWPXXXXXXXXTSILYXXXXXXXXXPDYLICTGTRATFSSLHKDALNTDHETFFEALNASVRKNVLKKCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPASTTFTRIKGG

SEQ ID NO: 26971 - protein, 266 aa, Diabrotica virgifera
  misc_feature: Coding regions on vcDNA: vcDNA=SeqID_6668; Strand=+; Position=3-801
  misc_feature: Homolog annotation: Hit_ID=XP_315267.1; Match level="QueryCoverage =98%, HitCoverage=64%, E-value=4e-97, Identity=50%"; Hit description =ENSANGP00000022300 [Anopheles gambiae]
  misc_feature: Gene Ontology Annotation: Molecular function=ATP-binding cassette (ABC) transporter activity; Cellular component=integral to membrane; Biological process=transport
  misc_feature: Pfam annotation: Pfam_ID=ABC_tran; Match level="Score=141.8, E-value =1.6e-39, Copies=1"; Pfam description=ABC transporter
  misc_feature (249)..(249): Xaa can be any naturally occurring amino acid
LTKYYNNFLAVNGLSIGIEKSECFGLLGINGAGKTTTFKMMSGDETVSYGDAWIEGKSVKTQLKQVQRNIGYCPQFDALLDDMTARETIIMYCLLRGIEFKRTQRIANFLSRDFDFHRHLDKKVKEMSGGNKRKLSTVLSLIGDPPVLFLDEPTTGMDPATKRYLWDSLCKIRDNGKCIVLTSHSMEECEALCTRIAIMVNGNFKCLGSTQHLKNKFAEGYTLTIKLKKLPESGGLVHADTESLEKYIXINFPYAHLREKHQNYCI

SEQ ID NO: 26972 - protein, 102 aa, Diabrotica virgifera
  misc_feature: Coding regions on vcDNA: vcDNA=SeqID_6669; Strand=+; Position=217-525
TSQNDTSTSSILGIELVSPLYHIYSEYIIRSNNLYSEVITDCIQDRIDDKSKIHISSLCKRSLTYLQYIPRILNYKPLDNNTCHRISRSSYSNHGKKTILRT

SEQ ID NO: 26973 - protein, 100 aa, Diabrotica virgifera
  misc_feature: Coding regions on vcDNA: vcDNA=SeqID_6670; Strand=+; Position=19-321
  misc_feature (60)..(66): Xaa can be any naturally occurring amino acid
YSMERSTEKEKLVERNFHGSETFVNGLAYQQINCYMPHKIENDIGKLLWKLPTPKFGHGXXXXXXXFISSSVVSLFDIIKPKYLYLSVYLKLFYFCILRC

SEQ ID NO: 26974 - protein, 111 aa, Diabrotica virgifera
  misc_feature: Coding regions on vcDNA: vcDNA=SeqID_6671; Strand=+; Position=304-639
  misc_feature (44)..(52): Xaa can be any naturally occurring amino acid
PQTLYYSHLYHFELPSSQQPLIRHDPTSRSTPLQKAPKNEQNGXXXXXXXXXLEFAENLSFYLALTHMLLLKAPVAKCCEKPNFSRQSREGSIPSPLIVRFGEREKYGLET

SEQ ID NO: 26975 - protein, 24 aa, Diabrotica virgifera
  misc_feature: Coding regions on vcDNA: vcDNA=SeqID_6672; Strand=-; Position=2-73
RGGGPGGCRGPVTVRGGPDLFPLI

SEQ ID NO: 26976 - protein, 57 aa, Diabrotica virgifera
  misc_feature: Coding regions on vcDNA: vcDNA=SeqID_6673; Strand=-; Position=149-322
KQVRVTFNKSWDGRAIRKVRSKLEPGYFKSNVISKVLYSMAKPNLCCNHCCHIQHAK

SEQ ID NO: 26977 - protein, 52 aa, Diabrotica virgifera
  misc_feature: Coding regions on vcDNA: vcDNA=SeqID_6674; Strand=+; Position=119-277
AYLVGGFGVYNTPFGCTSSSIRLTPLLFHTPRDLSRHASSPHHPLRSSCKRI

SEQ ID NO: 26978 - protein, 265 aa, Diabrotica virgifera
  misc_feature: Coding regions on vcDNA: vcDNA=SeqID_6675; Strand=+; Position=166-961
  misc_feature: Homolog annotation: Hit_ID=XP_309957.1; Match level="QueryCoverage =88%, HitCoverage=19%, E-value=2e-84, Identity=61%"; Hit description =ENSANGP00000004412 [Anopheles gambiae]
  misc_feature: Gene Ontology Annotation: Molecular function=structural molecule activity; Cellular component=endoplasmic reticulum; Biological process=ER to Golgi transport
  misc_feature: Pfam annotation: Pfam_ID=WD40; Match level="Score=21.7, E-value =0.0023, Copies=2"; Pfam description=WD domain, G-beta repeat
  misc_feature (213)..(213): Xaa can be any naturally occurring amino acid
MKVKDIERTASVAWSPKNQHPIYLAAGTAAQQLDASFNTSAALEIYSLNLTDPGPDTQLVSSVQSDHRFHKIIWGSYGSNPVNSTIIGGCDGGLIQIYNASKLLKGEDAIIGKQEKHTGPVHALDFNNFQQNLFASGAGESEIFIWDLNNTSTPMSPGTKSQPLEDVLSVAWNKQVQHILASTFPSKCVIWDLRKNEPIIKLTDTVSRIRWKXVVAWHPEVATQLCLASEEDQAPVYNYGILSLHFRLKNPSNPPRSILSLGRWF

SEQ ID NO: 26979 - protein, 49 aa, Diabrotica virgifera
  misc_feature: Coding regions on vcDNA: vcDNA=SeqID_6676; Strand=-; Position=7-156
YSSYVAIEDEMRLRIFPQGVNSINATGRQENLFPPFSLSLLIGRVGRPR

SEQ ID NO: 26980 - protein, 70 aa, Diabrotica virgifera
  misc_feature: Coding regions on vcDNA: vcDNA=SeqID_6677; Strand=+; Position=682-891
FFSTSVQKCLLLRTHFRLESFFPHACYFSARGFYFSARGFYFSARGFYFSARGFYFFARGFYFSARGFYF

SEQ ID NO: 26981 - protein, 275 aa, Diabrotica virgifera
  misc_feature: Coding regions on vcDNA: vcDNA=SeqID_6678; Strand=+; Position=108-935
  misc_feature: Homolog annotation: Hit_ID=BAA33574.1; Match level="QueryCoverage =86%, HitCoverage=81%, E-value=5e-24, Identity=30%"; Hit description =a part of reverse transcriptase-like domain of retrotransposon [Bombyx mori]
  misc_feature (124)..(136): Xaa can be any naturally occurring amino acid
  misc_feature (213)..(220): Xaa can be any naturally occurring amino acid
  misc_feature (255)..(255): Xaa can be any naturally occurring amino acid
MIMLKVSCEVKTNKTKFITGRNFKNLNYNQFKSDLESIPWRNIYDLTDVDSKVTFLSENIVTLLDIHVPIRTYRITKKYAPWLTDTIRALMLDRDKAFLSYKISKNIAHWNNYKKLRNLVSAVXXXXXXXXXXXXXVRSVKDMWSNLKYLINDDKHEKSFDVSSKWNINDINKHFIEVIPKMKEDLDTKMFYQNNVKTYFNKLLNFKPVSETXXXXXXXXIKSKAVGHDGINILTLQLCIPYLLPYITHIINFCXKHSVFPNNWKRAHVIPLPKN

SEQ ID NO: 26982 - protein, 28 aa, Diabrotica virgifera
  misc_feature: Coding regions on vcDNA: vcDNA=SeqID_6679; Strand=-; Position=33-119
LVSLKSTVRVTEFMVPLSERFYLAGSVK

SEQ ID NO: 26983 - protein, 140 aa, Diabrotica virgifera
  misc_feature: Coding regions on vcDNA: vcDNA=SeqID_6680; Strand=-; Position=209-632
  misc_feature: Homolog annotation: Hit_ID=AAU90161.1; Match level="QueryCoverage =60%, HitCoverage=23%, E-value=4e-17, Identity=44%"; Hit description =putative ubiquitin ligase SINAT5 [Oryza sativa (japonica cultivar -group)]
  misc_feature: Gene Ontology Annotation: Molecular function=transcription co -repressor activity; Cellular component=cytoplasm; Biological process= small GTPase mediated signal transduction
  misc_feature (14)..(14): Xaa can be any naturally occurring amino acid
VDKQLFECPICKGXMIPPIHQCKAGHTLCNVCKAKVEKCPSCEGSIEDTRNFILEDIAEGVEIPCSFESKSCKFRSGVKRMATHELECPLNSKRRCVEEPKPSEEKDKPNEESTANATEVTNNSQEETTTSEDVVELSLM

SEQ ID NO: 26984 - protein, 242 aa, Diabrotica virgifera
  misc_feature: Coding regions on vcDNA: vcDNA=SeqID_6681; Strand=-; Position=99-828
  misc_feature: Homolog annotation: Hit_ID=XP_318321.1; Match level="QueryCoverage =88%, HitCoverage=24%, E-value=1e-18, Identity=26%"; Hit description =ENSANGP00000014035 [Anopheles gambiae]
  misc_feature: Pfam annotation: Pfam_ID=RVT_1; Match level="Score=38.4, E-value=2.1e- 08, Copies=1"; Pfam description=Reverse transcriptase (RNA-dependent
  misc_feature (30)..(30): Xaa can be any naturally occurring amino acid
  misc_feature (60)..(60): Xaa can be any naturally occurring amino acid
  misc_feature (92)..(92): Xaa can be any naturally occurring amino acid
VIIEEFNLLLQNHTGFRPKKSTLTAACNLXELIYDELDSRNHVAGLFFDLSRAFDCLDIXLFAINFLSDRKSVVKIKESSSEPYTTNKGVPXGSVLRPLLFLIFINDLPDHIRALIISMFADDTSLIVSARTLEELKMTMKTVVDCFRCWCNTNRLILNIDKTEIIYFHSYNSSTNDYNLTIHDRNNMLSSTHSTKFLGVFIDCNLKWSEQVNSVNMKLNKAFYAISRIKNTLPISALINVF

SEQ ID NO: 26985 - protein, 242 aa, Diabrotica virgifera
  misc_feature: Coding regions on vcDNA: vcDNA=SeqID_6682; Strand=+; Position=52-780
  misc_feature: Homolog annotation: Hit_ID=EAL38831.1; Match level="QueryCoverage =62%, HitCoverage=71%, E-value=2e-21, Identity=40%"; Hit description =ENSANGP00000028850 [Anopheles gambiae str. PEST] ref|XP_552316.1| ENSANGP00000028850 [Anopheles gambiae st
MTFLLKKINRKRQQLSAKITCQLAITEYGKNKFDVESCQDVQNGNKMNLNFTLQLEDRDLPLNQSPVRKFNTKEILQRKPSFTVNRTESMDNDTFDHILQVTSQHDTIMAYYYLDENNKVKVTEIFDVTDSDSPIVQTSEERSANTNLEFDDDWTNQEQWQPNEENIAQFELEDILDREPIFSDPESEWTGTFKIEEPEDEDEQYPTNDTLPESDRRSREIINQWNKKEYKIPSMVYEDSDT

SEQ ID NO: 26986 - protein, 103 aa, Diabrotica virgifera
  misc_feature: Coding regions on vcDNA: vcDNA=SeqID_6683; Strand=-; Position=389-700
KSPLLSTPKPFDVSPSYWAGSIGTVQTAKLCQTNVSDYYQRRTMGKSEWPTPSKFHATGGIATLVQLLDSPILSLKIIYSSFVTIKSPAFEIFEVKNETTRLF

SEQ ID NO: 26987 - protein, 221 aa, Diabrotica virgifera
  misc_feature: Coding regions on vcDNA: vcDNA=SeqID_6684; Strand=-; Position=2-664
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(219): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDV

SEQ ID NO: 26988 - protein, 266 aa, Diabrotica virgifera
  misc_feature: Coding regions on vcDNA: vcDNA=SeqID_6685; Strand=+; Position=1-798
  misc_feature (17)..(25): Xaa can be any naturally occurring amino acid
  misc_feature (40)..(47): Xaa can be any naturally occurring amino acid
  misc_feature (55)..(84): Xaa can be any naturally occurring amino acid
  misc_feature (88)..(119): Xaa can be any naturally occurring amino acid
  misc_feature (122)..(130): Xaa can be any naturally occurring amino acid
  misc_feature (140)..(168): Xaa can be any naturally occurring amino acid
  misc_feature (184)..(200): Xaa can be any naturally occurring amino acid
  misc_feature (213)..(227): Xaa can be any naturally occurring amino acid
  misc_feature (229)..(240): Xaa can be any naturally occurring amino acid
  misc_feature (242)..(260): Xaa can be any naturally occurring amino acid
SLRGRGGGAVGGGKTPXXXXXXXXXGGGSSAAPPTNTTHXXXXXXXXKPSFFFPXXXXXXXXXXXXXXXXXXXXXXXXXXXXXXVLCXXXXXXXXXXXXXXXXXXXXXXXXXXXXXXXXVVXXXXXXXXXFFLLFFFSPXXXXXXXXXXXXXXXXXXXXXXXXXXXXXDPTQEQGEERERGGKXXXXXXXXXXXXXXXXXLWWGRGERLNMEXXXXXXXXXXXXXXXFXXXXXXXXXXXXRXXXXXXXXXXXXXXXXXXXTKSILL

SEQ ID NO: 26989 - protein, 180 aa, Diabrotica virgifera
  misc_feature: Coding regions on vcDNA: vcDNA=SeqID_6686; Strand=+; Position=41-583
  misc_feature: Homolog annotation: Hit_ID=NP_647799.1; Match level="QueryCoverage =76%, HitCoverage=16%, E-value=1e-40, Identity=57%"; Hit description =CG12009-PA [Drosophila melanogaster] gb|AAF47752.1| CG12009-PA [Drosophila melanogaster]
  misc_feature: Pfam annotation: Pfam_ID=CBM_14; Match level="Score=54.1, E-value =3.9e-13, Copies=1"; Pfam description=Chitin binding Peritrophin-A domain
MKAVLVLPVFFCLVNSAPKLRLTPQFIAPPSLLTLPSNATSIRTDISDSFHCEGRDYGYYADVENDCQLFHVCLPVTYSDGRNQTFRWSFICPEETVFNQEMFTCTRADEAIDCAESPRFYELNRNFGSEEIIGEVIDSVVPSTPEPHYLEEATALPDVPQGLGRNLSRRGGNKPDLKKQ

SEQ ID NO: 26990 - protein, 142 aa, Diabrotica virgifera
  misc_feature: Coding regions on vcDNA: vcDNA=SeqID_6687; Strand=-; Position=113-541
  misc_feature (1)..(30): Xaa can be any naturally occurring amino acid
  misc_feature (91)..(99): Xaa can be any naturally occurring amino acid
  misc_feature (110)..(122): Xaa can be any naturally occurring amino acid
XXXXXXXXXXXXXXXXXXXXXXXXXXXXXXWTPTNISLLMINQSQRSSFFHHPILWHFHVYLMILLSLSKKSLRMEYLKTFLCHIKRSSNXXXXXXXXXNKEHNLKTLPXXXXXXXXXXXXXHSLCFTLSTILYCDLKAMGT

SEQ ID NO: 26991 - protein, 26 aa, Diabrotica virgifera
  misc_feature: Coding regions on vcDNA: vcDNA=SeqID_6688; Strand=-; Position=1-78
IFFIACSFCYHLAGSVVVPFLSKDIT

SEQ ID NO: 26992 - protein, 65 aa, Diabrotica virgifera
  misc_feature: Coding regions on vcDNA: vcDNA=SeqID_6689; Strand=-; Position=570-767
  misc_feature (20)..(26): Xaa can be any naturally occurring amino acid
  misc_feature (33)..(39): Xaa can be any naturally occurring amino acid
ILHEVCKKYEFFLRVKCLYXXXXXXXKDVIEHXXXXXXXKQLFLITIFDIVKFNDTLLLSEIHIF

SEQ ID NO: 26993 - protein, 263 aa, Diabrotica virgifera
  misc_feature: Coding regions on vcDNA: vcDNA=SeqID_6690; Strand=+; Position=76-864
MAPKNNKRRLKTKSVNRQNTVSQCNVIRTQIIDEDKMKMNTQEGPFPREKLVNQQSDVSQSGITNNQIIDRENNKLKTSNELDYQHDLISKRVEEPHQGKDEAGMKDLEQVEKTEPMKTDKDSVLIMNDSNQLKRELLSTFSQYLEDIGDDKCELSFVSKILSEHLLPKELLKLINRKYKITEKRQCGAGGFGVIYLGKLRESGGPRMDVIVKGALPKKEKYLKSEAIILSPMDHKNIVKMISFITEPMEIVMEYMEYGSLDR

SEQ ID NO: 26994 - protein, 59 aa, Diabrotica virgifera
  misc_feature: Coding regions on vcDNA: vcDNA=SeqID_6691; Strand=-; Position=231-410
  misc_feature (2)..(8): Xaa can be any naturally occurring amino acid
GXXXXXXXFRILMIDLPVHIRCNYNNNVCSRYFVNSLSTSTRGMIIFNADSCGLLSLSV

SEQ ID NO: 26995 - protein, 38 aa, Diabrotica virgifera
  misc_feature: Coding regions on vcDNA: vcDNA=SeqID_6692; Strand=-; Position=19-135
KGAPKEIGFLGGKTSKGYFRVLGPQFGGDPLRAPQGVF

SEQ ID NO: 26996 - protein, 184 aa, Diabrotica virgifera
  misc_feature: Coding regions on vcDNA: vcDNA=SeqID_6693; Strand=+; Position=1-552
  misc_feature: Homolog annotation: Hit_ID=XP_313661.1; Match level="QueryCoverage =96%, HitCoverage=45%, E-value=2e-41, Identity=47%"; Hit description =ENSANGP00000013017 [Anopheles gambiae] gb|EAA09159.1| ENSANGP00000013017 [Anopheles gambiae
  misc_feature: Gene Ontology Annotation: Molecular function=molecular_function unknown; Cellular component=cellular_component unknown; Biological process=carbohydrate metabolism
  misc_feature: Pfam annotation: Pfam_ID=Aldose_epim; Match level="Score=-6.6, E -value=8.5e-08, Copies=1"; Pfam description=Aldose 1-epimerase
  misc_feature (9)..(9): Xaa can be any naturally occurring amino acid
FKGAKKNMXKVTLTPYTFGKITDGKGRTQTVRRFTWKNKNNVSAQVINYGGYITSIKVPGCNKEVEDITIGFNDIEGYLKPENRYFGATIGRVANRIGKAQMTVEGVKYNLAANNGPNHLHGGVVGFDKVFWEASVKDTKLTLSYHAADLEENYPGDLIANVTFELTNDNEFRIDYRAVTTKPC

SEQ ID NO: 26997 - protein, 67 aa, Diabrotica virgifera
  misc_feature: Coding regions on vcDNA: vcDNA=SeqID_6694; Strand=+; Position=366-569
  misc_feature (49)..(55): Xaa can be any naturally occurring amino acid
DFSQDFEYSRYLTTFLVIKTLKLKTLMGKNISWPKLCHTYIFTLNILTXXXXXXXVCLHLNIINLLI

SEQ ID NO: 26998 - protein, 55 aa, Diabrotica virgifera
  misc_feature: Coding regions on vcDNA: vcDNA=SeqID_6695; Strand=+; Position=37-204
QVTMIRISKNRYSVTIPTTDGSDSVKVWIEFSGNRLTILFDFGSSDMLYTKIFLV

SEQ ID NO: 26999 - protein, 265 aa, Diabrotica virgifera
  misc_feature: Coding regions on vcDNA: vcDNA=SeqID_6696; Strand=+; Position=149-943
  misc_feature: Homolog annotation: Hit_ID=AAT12450.1; Match level="QueryCoverage =86%, HitCoverage=34%, E-value=3e-54, Identity=49%"; Hit description =vasa protein [Copidosoma floridanum] gb|AAT11555.1| vasa-like protein [Copidosoma floridanum]
  misc_feature: Gene Ontology Annotation: Molecular function=DNA helicase activity; Cellular component=polar granule; Biological process=pole plasm RNA localization
  misc_feature (153)..(153): Xaa can be any naturally occurring amino acid
  misc_feature (215)..(215): Xaa can be any naturally occurring amino acid
  misc_feature (229)..(229): Xaa can be any naturally occurring amino acid
MDDDWDDDSGSAPAPTMAPSVATEGGKKFSAGRGFKSVEISDGDWNDNGGGDSWNNGGENGYSGGRGGGRRGGRGGGDRDGGDRRGRGGFSRNGDSNGYGDENGGDSYGDSNKENYGGYENRGRGRGGGRGGRGGGRGDRGDDNDDYGGGGGXDKTDEPQKPREIYIPPERDEDLFTSTITSGINFVKLDDIEVNVSGENVPKPITSFESSGMRXILLENIKKSGYTKXPTPIQKYAVPIIMNGGDLMGCAQTGSEKTAAFLFTL

SEQ ID NO: 27000 - protein, 47 aa, Diabrotica virgifera
  misc_feature: Coding regions on vcDNA: vcDNA=SeqID_6697; Strand=+; Position=10-153
ENPTNRSQENGGSLLAGEDQIPMTARAITALEVYQMRITTISRAAQA

SEQ ID NO: 27001 - protein, 175 aa, Diabrotica virgifera
  misc_feature: Coding regions on vcDNA: vcDNA=SeqID_6698; Strand=+; Position=74-745
  misc_feature: Homolog annotation: Hit_ID=AAF87759.1; Match level="QueryCoverage =100%, HitCoverage=50%, E-value=4e-70, Identity=65%"; Hit description= cytochrome oxidase subunit I [Diabrotica virgifera virgifera]
  misc_feature: Pfam annotation: Pfam_ID=COX1; Match level="Score=-136.5, E-value =1.3e-06, Copies=1"; Pfam description=Cytochrome C and Quinol oxidase polyp
  misc_feature (2)..(2): Xaa can be any naturally occurring amino acid
  misc_feature (10)..(10): Xaa can be any naturally occurring amino acid
  misc_feature (35)..(43): Xaa can be any naturally occurring amino acid
  misc_feature (70)..(70): Xaa can be any naturally occurring amino acid
  misc_feature (124)..(124): Xaa can be any naturally occurring amino acid
  misc_feature (159)..(159): Xaa can be any naturally occurring amino acid
LXERGVGTGXTVYPPLSSNIAHGGPSVDLAIFRLXXXXXXXXXGAINFITTVINIRPIGITFDRIPLFVXAVVITAILLLLSLPVLAGAITILLTDRNLNTSFFDPAGIIYAIIAIGLLGFIVXAHHIFTVGMDVDTRAYFTSATIIIAVPTGIKVFRXLATYHGTTITYSPVTL

SEQ ID NO: 27002 - protein, 95 aa, Diabrotica virgifera
  misc_feature: Coding regions on vcDNA: vcDNA=SeqID_6699; Strand=+; Position=136-423
AVGFTKREQTQKRVDGCTDSSYRYSLHTYRTDHYQRKRQRVCALCAQRHMLECDYPMRKKPDGRQTFYECYNATTMARTPPRRHHSQQKARLFES

SEQ ID NO: 27003 - protein, 55 aa, Diabrotica virgifera
  misc_feature: Coding regions on vcDNA: vcDNA=SeqID_6700; Strand=+; Position=75-242
ALPISETNGLFLKKAVVVLIILMDFVLYCHDQALPIITILTASNRLLAKETLNML

SEQ ID NO: 27004 - protein, 123 aa, Diabrotica virgifera
  misc_feature: Coding regions on vcDNA: vcDNA=SeqID_6701; Strand=+; Position=25-396
  misc_feature: Homolog annotation: Hit_ID=XP_315025.1; Match level="QueryCoverage =99%, HitCoverage=66%, E-value=2e-32, Identity=48%"; Hit description =ENSANGP00000022254 [Anopheles gambiae]
  misc_feature: Pfam annotation: Pfam_ID=EGF; Match level="Score=27.7, E-value=3.6e -05, Copies=1"; Pfam description=EGF-like domain
MLVKVLVVLFICIEVCRNCEVGQTKQGCLIRNLVCSCGIGCISDYRYDTFQECQNALKGKKRDICKVHNPCLHNGTCIQISQQPGYRCRCEGTGYFGARCSRVCPTPGQGRAGTIYPYECIVI

SEQ ID NO: 27005 - protein, 117 aa, Diabrotica virgifera
  misc_feature: Coding regions on vcDNA: vcDNA=SeqID_6702; Strand=+; Position=37-390
  misc_feature: Homolog annotation: Hit_ID=XP_395078.1; Match level="QueryCoverage =96%, HitCoverage=4%, E-value=1e-10, Identity=31%"; Hit description =similar to transcription factor TFIIICalfa [Apis mellifera]
MIIMPWVRVDGTLNRVMLKTWTCNVLSYCLDYPKVPFSKICDKFCYIKPVDLYFIVQILEEIGCIEVLIYETEEESIFSEWRKTCERPATFLDNIEDLIIQPNNVSMTRLGSFYNEE

SEQ ID NO: 27006 - protein, 17 aa, Diabrotica virgifera
  misc_feature: Coding regions on vcDNA: vcDNA=SeqID_6703; Strand=-; Position=1-51
  misc_feature (10)..(16): Xaa can be any naturally occurring amino acid
LPLPTRFRLXXXXXXXN

SEQ ID NO: 27007 - protein, 104 aa, Diabrotica virgifera
  misc_feature: Coding regions on vcDNA: vcDNA=SeqID_6704; Strand=-; Position=3-314
ILYLKYHVGIFFRCSVTSARVRRSHTLYCCHWFGLLATYGFLCLVVLRSTYRSLGSVTLMRGWSCYPLELKRETGPYSSALGVCAQGALVDHRRVHIMESDVVP

SEQ ID NO: 27008 - protein, 61 aa, Diabrotica virgifera
  misc_feature: Coding regions on vcDNA: vcDNA=SeqID_6705; Strand=+; Position=2-184
  misc_feature (1)..(29): Xaa can be any naturally occurring amino acid
  misc_feature (34)..(40): Xaa can be any naturally occurring amino acid
XXXXXXXXXXXXXXXXXXXXXXXXXXXXXENKFXXXXXXXINYQLFERNSMIRLKYYLRDN

SEQ ID NO: 27009 - protein, 286 aa, Diabrotica virgifera
  misc_feature: Coding regions on vcDNA: vcDNA=SeqID_6706; Strand=+; Position=79-934
  misc_feature: Homolog annotation: Hit_ID=XP_393446.1; Match level="QueryCoverage =99%, HitCoverage=55%, E-value=1e-140, Identity=89%"; Hit description= similar to ENSANGP00000015224 [Apis mellifera]
  misc_feature: Pfam annotation: Pfam_ID=WD40; Match level="Score=37.7, E-value=3.5e -08, Copies=1"; Pfam description=WD domain, G-beta repeat
  misc_feature (210)..(210): Xaa can be any naturally occurring amino acid
  misc_feature (248)..(248): Xaa can be any naturally occurring amino acid
  misc_feature (250)..(250): Xaa can be any naturally occurring amino acid
MSIEIESADVIRLIQQYLKESNLFRTLHTLQEETGVTLNTVDSVDGFCADINNGHWDTVLKAIQSLKLPDKKLIDLYEQIVLELIELRELGAARSLLRQTDPMIMLKQNEPERYIHLENLLARSYFDTREAYSDGSSKEKRRAAIAHALSGEVSVVPSSRLLALLGQALKWQQHQGLLPPGTTIDLFRGKAAVREQEDETFPTQMAKQIXFGQKSHVECARFSPDGQYLVTGSVDGIIEVWNFTTGKXIXKDLKYQAQDNFMMMKHAVLCMAFSRDSEMLVTGSQT

SEQ ID NO: 27010 - protein, 205 aa, Diabrotica virgifera
  misc_feature: Coding regions on vcDNA: vcDNA=SeqID_6707; Strand=+; Position=25-642
  misc_feature: Pfam annotation: Pfam_ID=DUF227; Match level="Score=53.5, E-value =5.9e-13, Copies=1"; Pfam description=Domain of unknown function (DUF227)
MIPKDICDLVEDYLNEKIENFEIQEHEGNQKGQGHLGEIVFLSLKNKKTGKKHHLVVKQCLTGSEETSKLMSACFNNEVHFYTKVVPAIEAFQKSYPRAEIFSHLPRCFATSSKRGKEKLVMENLKIQDYKIHPKKVPLNSKMYEIIFKTYGKFHGICYAFKHYHPDQVTELGKGYQSTMKMFFDGGFMQKAITGNCNKTKENVF

SEQ ID NO: 27011 - protein, 57 aa, Diabrotica virgifera
  misc_feature: Coding regions on vcDNA: vcDNA=SeqID_6708; Strand=-; Position=641-814
GPLSQYFFKLSRFFISHSSPKTSFVLLQVPVMALSMNPPSKNIFFCFDTNSRYIAFA

SEQ ID NO: 27012 - protein, 25 aa, Diabrotica virgifera
  misc_feature: Coding regions on vcDNA: vcDNA=SeqID_6709; Strand=-; Position=0-74
  misc_feature (3)..(24): Xaa can be any naturally occurring amino acid
KLXXXXXXXXXXXXXXXXXXXXXXP

SEQ ID NO: 27013 - protein, 85 aa, Diabrotica virgifera
  misc_feature: Coding regions on vcDNA: vcDNA=SeqID_6710; Strand=+; Position=28-285
MKIVFVAIFMVLVVAATADIIGLPHCGEHEIQGCEPCCPESEVTCQNKVPQPCNEPCFMICRHKCVCDQGYLRDTSTGKCVQNCQ

SEQ ID NO: 27014 - protein, 265 aa, Diabrotica virgifera
  misc_feature: Coding regions on vcDNA: vcDNA=SeqID_6711; Strand=-; Position=2-796
  misc_feature (28)..(247): Xaa can be any naturally occurring amino acid
KMTSKAFPRVGGYFDELTWFDILGQIEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNFCVDFLKHSRNNMFLFD

SEQ ID NO: 27015 - protein, 176 aa, Diabrotica virgifera
  misc_feature: Coding regions on vcDNA: vcDNA=SeqID_6712; Strand=-; Position=64-594
  misc_feature: Homolog annotation: Hit_ID=AAA82161.1; Match level="QueryCoverage =100%, HitCoverage=34%, E-value=6e-39, Identity=44%"; Hit description= cytochrome P450
  misc_feature: Gene Ontology Annotation: Molecular function=cytochrome P450 activity; Cellular component=membrane; Biological process=electron transport
  misc_feature (24)..(24): Xaa can be any naturally occurring amino acid
HPELQDRLGEEITTALNDKKELPXESITEMKSLHQVMDETLRWYPVVSNLQRKCVKDYTFKNSNMVVERGVTCVIPIFSIQRDPEFFKDPLTFDPDRFSPENKNNIVPYSNLPFGEGPRNCIGLRFGYMQSKIGIIEIIRRFKLTISPSTKMPIQIDPDLFILQSRETLYLQAEPI

SEQ ID NO: 27016 - protein, 80 aa, Diabrotica virgifera
  misc_feature: Coding regions on vcDNA: vcDNA=SeqID_6713; Strand=+; Position=415-654
FRLIEEINISHSITNKLSAITTRVVIRCSIYQANAKPKGFYPHAHRLMMIRGREEVDDPHDVEAGHEDGFIDEFPGMRII

SEQ ID NO: 27017 - protein, 301 aa, Diabrotica virgifera
  misc_feature: Coding regions on vcDNA: vcDNA=SeqID_6714; Strand=+; Position=2-907
  misc_feature: Homolog annotation: Hit_ID=XP_391877.1; Match level="QueryCoverage =99%, HitCoverage=49%, E-value=2e-88, Identity=54%"; Hit description =similar to ENSANGP00000015372 [Apis mellifera]
  misc_feature (291)..(291): Xaa can be any naturally occurring amino acid
ADLFITTKDNFEIWLGREESNPKKPKFSYKSTIPHPINPKTSETAKVIGQSLFVDVELKGKVDLLTPVCYDWKCQNGALLLYSNTEEKWIDLQVNFKDDYQSVWTFFKNENYKYNDVITLRSGDFNMDGYPDILATLTPVSNYNAPQSFLLENVPCQNYCGSLKRTFEVRWSSLNPFKNGTIMAAFFDFYQDGILDCIVVQSVNGEYKTAAFKNSLDYDANFIKVMVLTGLTNKNNPMMMGRVGKKRRTYGTNLPGPSISYKTTTQEGNIRHGLSCQLPQIAHFSLSLPYXIFGLGRTPNS

SEQ ID NO: 27018 - protein, 304 aa, Diabrotica virgifera
  misc_feature: Coding regions on vcDNA: vcDNA=SeqID_6715; Strand=+; Position=2-913
  misc_feature: Homolog annotation: Hit_ID=XP_310665.1; Match level="QueryCoverage =99%, HitCoverage=43%, E-value=1e-141, Identity=80%"; Hit description= ENSANGP00000020753 [Anopheles gambiae]
  misc_feature: Gene Ontology Annotation: Molecular function=dolichyl-diphospho -oligosaccharide-protein glycosyltransferase activity; Cellular component=integral to plasma membrane; Biological process=protein modification
  misc_feature: Pfam annotation: Pfam_ID=STT3; Match level="Score=-129.4, E-value =0.0013, Copies=1"; Pfam description=Oligosaccharyl transferase STT3 subun
  misc_feature (147)..(147): Xaa can be any naturally occurring amino acid
  misc_feature (215)..(215): Xaa can be any naturally occurring amino acid
  misc_feature (239)..(239): Xaa can be any naturally occurring amino acid
  misc_feature (249)..(249): Xaa can be any naturally occurring amino acid
  misc_feature (263)..(263): Xaa can be any naturally occurring amino acid
  misc_feature (282)..(282): Xaa can be any naturally occurring amino acid
  misc_feature (296)..(296): Xaa can be any naturally occurring amino acid
KYLAEQGFYSFHNWFDDRAWYPLGRIIGGTIYPGLMITSTVLYHLCWLLNITIDIRNVCVFLAPLFSSFTTIITYLLTKEVKNSGAGLVAAAFVSIVPGYISRSVAGSYDNEGIAIFCMLLTYYTWIKAVKTGTIFWGTLSALAYFXMVSSWGGYVFLINLIPLHVLTLMATGRFGHRIYIAYSTLYCVGTILSMQISFVGFQPVQSSEHMLALXVFGLCQIVAFVDYTRSKLSASEFXTLYTFLIYTXGILTVVVGGVLTVXGKISPWTGRFYSLLDPSLXQNHIPYIASVSEHXPTSWSRFI

SEQ ID NO: 27019 - protein, 46 aa, Diabrotica virgifera
  misc_feature: Coding regions on vcDNA: vcDNA=SeqID_6716; Strand=-; Position=75-215
  misc_feature (5)..(11): Xaa can be any naturally occurring amino acid
  misc_feature (15)..(15): Xaa can be any naturally occurring amino acid
NSNGXXXXXXXTKKXNVECHNTVLPPYVYCHLTKLDDQEGDHRRDE

SEQ ID NO: 27020 - protein, 102 aa, Diabrotica virgifera
  misc_feature: Coding regions on vcDNA: vcDNA=SeqID_6717; Strand=+; Position=522-830
VMLDPRSFLYQVYCIFCTHINRIKRITEKKGKQAFPSNTETRQNNTILQSRIIIVFRVAGQQRINIKESFYVFFVLLILGGVYFLDFQERCLINKHVDSKVK

SEQ ID NO: 27021 - protein, 98 aa, Diabrotica virgifera
  misc_feature: Coding regions on vcDNA: vcDNA=SeqID_6718; Strand=-; Position=94-390
WNLDIFSLYEIIIFCHINWIYSGIKYYVFVSFSVSACIHLSRVFSHRCCGVDSWSATSPWHPRLHKWFTSGLTLTEFPVSGMRTNMDKNPKNTPVRSF

SEQ ID NO: 27022 - protein, 73 aa, Diabrotica virgifera
  misc_feature: Coding regions on vcDNA: vcDNA=SeqID_6719; Strand=+; Position=115-336
  misc_feature (17)..(22): Xaa can be any naturally occurring amino acid
NLNCQNSFKFDCNIVKXXXXXXGTKIWYRARGMQSMHKNTNKQKGLKTNQHNYRIITLLQSTSILLKKSCSRS

SEQ ID NO: 27023 - protein, 175 aa, Diabrotica virgifera
  misc_feature: Coding regions on vcDNA: vcDNA=SeqID_6720; Strand=+; Position=2-529
  misc_feature: Homolog annotation: Hit_ID=XP_321301.1; Match level="QueryCoverage =86%, HitCoverage=14%, E-value=6e-42, Identity=52%"; Hit description =ENSANGP00000008459 [Anopheles gambiae]
  misc_feature: Gene Ontology Annotation: Molecular function=15-hydroxyprostaglandin dehydrogenase (NAD+) activity; Cellular component=cellular_component unknown; Biological process=biological_process unknown
LRPTAPRFIIPSIELTTDNCLYIYSVILGALFVLAMTRSFFFYKMAMLSSKKLHGTIFDNVIDATMRFFDTNPGGRILNRFSKDMGAVDELLPKAILDSSQILLSMCGSLVLIIVVNPYFLILIGVLSAVFGVMRHIYLKSSKNIKRLEGISTYTYCYVSSTLASYTILVLSLFN

SEQ ID NO: 27024 - protein, 66 aa, Diabrotica virgifera; identical to SEQ ID NO: 26808
  misc_feature: Coding regions on vcDNA: vcDNA=SeqID_6721; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 27025 - protein, 67 aa, Diabrotica virgifera
  misc_feature: Coding regions on vcDNA: vcDNA=SeqID_6722; Strand=+; Position=2-202
  misc_feature (2)..(15): Xaa can be any naturally occurring amino acid
  misc_feature (21)..(34): Xaa can be any naturally occurring amino acid
  misc_feature (56)..(65): Xaa can be any naturally occurring amino acid
NXXXXXXXXXXXXXXRPRCWXXXXXXXXXXXXXXVRLLKFYIDLSLNPGEPGWFLXXXXXXXXXXKG

SEQ ID NO: 27026 - protein, 166 aa, Diabrotica virgifera
  misc_feature: Coding regions on vcDNA: vcDNA=SeqID_6723; Strand=+; Position=2-502
  misc_feature: Homolog annotation: Hit_ID=AAH77393.1; Match level="QueryCoverage =98%, HitCoverage=73%, E-value=2e-41, Identity=56%"; Hit description =MGC81677 protein [Xenopus laevis]
  misc_feature: Gene Ontology Annotation: Molecular function=pre-mRNA splicing factor activity; Cellular component=nucleus; Biological process=mRNA splice site selection
  misc_feature: Pfam annotation: Pfam_ID=zf-CCHC; Match level="Score=23.4, E-value =0.00021, Copies=1"; Pfam description=Zinc knuckle
  misc_feature (37)..(46): Xaa can be any naturally occurring amino acid
  misc_feature (92)..(97): Xaa can be any naturally occurring amino acid
VWVARNPPGFAFVEFEDARDAEDAIRGLDGRTICGRXXXXXXXXXXSGNGRYRGPPPRSRGKPFHPDDRCYDCGDRGHYARDCNRYRSSRRXXXXXXSRSRSRDRRSRSRSNTRSRSRSRNRSRSDSRKRSHSRSRSNEKRSRSRSARSRSRSHSRSVKENGNAKD

SEQ ID NO: 27027 - protein, 97 aa, Diabrotica virgifera
  misc_feature: Coding regions on vcDNA: vcDNA=SeqID_6724; Strand=+; Position=362-654
  misc_feature: Homolog annotation: Hit_ID=NP_061169.2; Match level="QueryCoverage =98%, HitCoverage=50%, E-value=2e-23, Identity=35%"; Hit description =PR domain containing 5 [Homo sapiens]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=72.5, E-value =1.1e-18, Copies=3"; Pfam description=Zinc finger, C2H2 type
  misc_feature (56)..(56): Xaa can be any naturally occurring amino acid
  misc_feature (67)..(67): Xaa can be any naturally occurring amino acid
  misc_feature (85)..(85): Xaa can be any naturally occurring amino acid
FHTEQKTHICEYCSIHFSSSSSLRVHMRTHNGNRVLKCEICSRELTTNSHLKVHKXNHIKEKPYKCXVCSKELTQMGQLSKHLYXHTGEKPFSCEIC

SEQ ID NO: 27028 - protein, 66 aa, Diabrotica virgifera
  misc_feature: Coding regions on vcDNA: vcDNA=SeqID_6725; Strand=-; Position=0-197
MQTMHRVSIFIPECLILVGSSFRYQLKHGCSFSFAELINDNDNCGVTYCSGGVGGAREFGPGPAGV

SEQ ID NO: 27029 - protein, 131 aa, Diabrotica virgifera
  misc_feature: Coding regions on vcDNA: vcDNA=SeqID_6726; Strand=-; Position=1-393
  misc_feature (27)..(35): Xaa can be any naturally occurring amino acid
  misc_feature (37)..(131): Xaa can be any naturally occurring amino acid
PLIQHGGCHLYFWIGLLQKKFRCYPKXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27030 - protein, 91 aa, Diabrotica virgifera
  misc_feature: Coding regions on vcDNA: vcDNA=SeqID_6727; Strand=+; Position=165-440
ISVIYKCCNVLQGGANFERATRFDWRTRNSVRVCLLSSSIIAEVFLGNHTVTCLRDHLGTARRVWEIWDLQVAKFLVSPFLCTSVYFINYV

SEQ ID NO: 27031 - protein, 185 aa, Diabrotica virgifera
  misc_feature: Coding regions on vcDNA: vcDNA=SeqID_6728; Strand=+; Position=24-581
  misc_feature: Homolog annotation: Hit_ID=XP_314051.1; Match level="QueryCoverage =96%, HitCoverage=92%, E-value=6e-59, Identity=62%"; Hit description =ENSANGP00000015684 [Anopheles gambiae] gb|EAA44533.2| ENSANGP00000024640 [Anopheles gambiae
  misc_feature: Gene Ontology Annotation: Molecular function=ATP binding; Cellular component=cytosol; Biological process=cell-matrix adhesion
  misc_feature: Pfam annotation: Pfam_ID=Ras; Match level="Score=226.7, E-value=4.4e -65, Copies=1"; Pfam description=Ras family
MTIGDGACGKTSLLTTFSFNAFPERHVPTVFDAYSKDIEVDDQTVTLALWDTAGEEDYDRLRPLSYSRTSVVLICFAVDFPDSLSNVKDKWYPEVKHFLPYVPYILIANKLDLRTDPETIKTLADRNQHPVSQEEGERMAKKIKAVKYMECSAKHLFGIRPIFEEAARIALETKTKSKIKHCKFL

SEQ ID NO: 27032 - protein, 78 aa, Diabrotica virgifera
  misc_feature: Coding regions on vcDNA: vcDNA=SeqID_6729; Strand=+; Position=261-494
  misc_feature (56)..(56): Xaa can be any naturally occurring amino acid
LTMKSVIIGVTRGRFWGYTSVSDTNRTFQKTNRFFTQNCTNLVHGVYLRLFYTTQXHIFSILYTSSPACTLLHLYLCI

SEQ ID NO: 27033 - protein, 90 aa, Diabrotica virgifera
  misc_feature: Coding regions on vcDNA: vcDNA=SeqID_6730; Strand=+; Position=62-334
TIIRPLLYYNTIETLFYRKCNVRLQVVFTVYEFIASPLVIISQKRFPCSCTIYQFTCFNHSKCSANAALKRCPFASSIPHLITLWRFSAS

SEQ ID NO: 27034 - protein, 142 aa, Diabrotica virgifera
  misc_feature: Coding regions on vcDNA: vcDNA=SeqID_6731; Strand=+; Position=342-767
  misc_feature: Homolog annotation: Hit_ID=NP_493497.1; Match level="QueryCoverage =84%, HitCoverage=14%, E-value=2e-21, Identity=42%"; Hit description =predicted CDS, reverse transcriptase family member (1O881) [Caenorhabditis elegans]
  misc_feature: Gene Ontology Annotation: Molecular function=molecular_function unknown; Cellular component=cellular_component unknown; Biological process=biological_process unknown
IYTSKKDANFNTQEYIKKTITNVNSETLPKIENYEIEAALSQLKNNKAPGPDGILAEMLKEGKEEILQTLRNLFNQCLHKGEIPDEWNESLTILLFKKGDRKDIKNYRPISLLSQTYKLFMRIINNRLTHKLDSYQPVKQAG

SEQ ID NO: 27035 - protein, 278 aa, Diabrotica virgifera
  misc_feature: Coding regions on vcDNA: vcDNA=SeqID_6732; Strand=+; Position=2-837
  misc_feature: Homolog annotation: Hit_ID=NP_995599.1; Match level="QueryCoverage =100%, HitCoverage=67%, E-value=1e-105, Identity=39%"; Hit description=CG32019-PD, isoform D [Drosophila melanogaster] gb|AAS64599.1| CG32019-PD, isoform D [Drosophila
  misc_feature: Gene Ontology Annotation: Molecular function=structural constituent of muscle; Cellular component=cytoskeleton; Biological process =regulation of striated muscle contraction
  misc_feature: Pfam annotation: Pfam_ID=fn3; Match level="Score=86.8, E-value=5.6e -23, Copies=2"; Pfam description=Fibronectin type III domain
  misc_feature (233)..(233): Xaa can be any naturally occurring amino acid
  misc_feature (262)..(262): Xaa can be any naturally occurring amino acid
WTPPKNDGGAPVEKYIIEKKDPVTGKWQKAVEVPGNKTEAKVPDLQEGQKYQFRVKAVNKGGDSKPSPPSETITAKDRFFPPKIDRTNLKDFTVRAGQHIRLDVKVSGEPPPTKTWFLNKACIENRDDITVDLEDYRTKLVIGVLKREHTGTLTLKAENDSGRDEASIEIKVLDKPSKPEGPLKISDVHKEGCTLKWNPPQDDGGVPIEYYQVEKLDTATGRWVPAGRTKDPXIELNNLEPGQEYKFRVSAVNAESESEPFXAEQTIVAKNPFDEPGA

SEQ ID NO: 27036 - protein, 127 aa, Diabrotica virgifera
  misc_feature: Coding regions on vcDNA: vcDNA=SeqID_6733; Strand=+; Position=347-727
  misc_feature: Homolog annotation: Hit_ID=XP_392046.1; Match level="QueryCoverage =89%, HitCoverage=28%, E-value=2e-45, Identity=72%"; Hit description =similar to CG5021-PB [Apis mellifera]
  misc_feature: Gene Ontology Annotation: Molecular function=molecular_function unknown; Cellular component=membrane; Biological process =intracellular protein transport
  misc_feature: Pfam annotation: Pfam_ID=DUF846; Match level="Score=190.6, E-value =3.3e-54, Copies=1"; Pfam description=Eukaryotic protein of unknown function
LANPSKRKLPSTCLRHPYITFFHLAFRGAAIVAYLLCEQFTASFITSFVSVILLLSMDFWTVKNITGRLMVGLRWWNYVDEDGKSHWVFESRQNKVNEREARIFWVALVLTPLLWPFLFIVGLFGFE

SEQ ID NO: 27037 - protein, 323 aa, Diabrotica virgifera
  misc_feature: Coding regions on vcDNA: vcDNA=SeqID_6734; Strand=+; Position=2-968
  misc_feature: Homolog annotation: Hit_ID=EAL34002.1; Match level="QueryCoverage =99%, HitCoverage=34%, E-value=1e-112, Identity=60%"; Hit description= GA16377-PA [Drosophila pseudoobscura]
  misc_feature (294)..(294): Xaa can be any naturally occurring amino acid
  misc_feature (301)..(301): Xaa can be any naturally occurring amino acid
VALSMIEKHGGDFGKERLFSCFGMAIFAPITGGLIDWYSEKVGHTDYSLAFYSFDFLLIIASLSLFFMPLDTKLPSDSMFSDLKKILKMPALMMVVFFLFLLGNLWGFIESFLFFYLKDLGAPNYLLGITVTVGTMSSVPFLYGSDKITGTIGHVTVVILAFFAHATRLVGYSLIESPWWCFPFEALESIAVHLMWVAAATYCAVLAPRGLLATLLGVCAVAQYSVGRGSGSFIGGHIIAKFGITTAFRIMGLFAVCSGLSYAFLNLVWLRKVEKREQDRREAEVTEDLKAVAXIQDQGTXDELRRLNVMIDQTHIGSITSLG

SEQ ID NO: 27038 - protein, 204 aa, Diabrotica virgifera
  misc_feature: Coding regions on vcDNA: vcDNA=SeqID_6735; Strand=-; Position=417-1031
  misc_feature (16)..(33): Xaa can be any naturally occurring amino acid
  misc_feature (47)..(56): Xaa can be any naturally occurring amino acid
  misc_feature (92)..(100): Xaa can be any naturally occurring amino acid
  misc_feature (104)..(112): Xaa can be any naturally occurring amino acid
KLLYKLPAGPFSSLEXXXXXXXXXXXXXXXXXXDGKVCFIKGGSVEXXXXXXXXXXNTPQAPFFSAFFPILRAASCFGEGGNLERPGRNCIXXXXXXXXXPPFXXXXXXXXXERWENILFSFFIFLRARGFFQKTIFGRSSIKSLHRGDSFNFGGLNVGGGGILLPVFCAGAGPAYKLFKAFVELSISSCCSYSGVVIVIGLSD

SEQ ID NO: 27039 - protein, 114 aa, Diabrotica virgifera
  misc_feature: Coding regions on vcDNA: vcDNA=SeqID_6736; Strand=-; Position=45-389
TCINHVIPLEFPVSPQLIPHPMPPFSVSSVIAFMSATSNKTSDISYSLLGAPCALSPPTVTLITLYVCEVIHLNLFSSTFVFTNYLHNSSVGRPSIFRRPTLSALEKSSPEKNS

SEQ ID NO: 27040 - protein, 209 aa, Diabrotica virgifera
  misc_feature: Coding regions on vcDNA: vcDNA=SeqID_6737; Strand=-; Position=3-629
  misc_feature: Homolog annotation: Hit_ID=XP_394284.1; Match level="QueryCoverage =77%, HitCoverage=24%, E-value=5e-18, Identity=30%"; Hit description =similar to Ubiquitin ligase SIAH1 (Seven in absentia homolog 1) (Siah-1) (Siah-1a) [Apis mellifera]
  misc_feature: Gene Ontology Annotation: Molecular function=transcription co -repressor activity; Cellular component=cytoplasm; Biological process= small GTPase mediated signal transduction
  misc_feature: Pfam annotation: Pfam_ID=zf-C3HC4; Match level="Score=-0.2, E-value =0.053, Copies=1"; Pfam description=Zinc finger, C3HC4 type (RING finger)
MLLSDNKKFFILAEDQKIIKFNDKEHCFKCSRGTCKISDHIYKVKRKEIFRRLTTKLNRDAVKYRTNTLNYQIVLKEYKEDKTDKLIKQLFECPICKDYMIPPIHQCKAGHTLCNVCKAKVEKCPSCEGSIEDTRNFILEDIAEGVEIPCSFESKSCKFRSGVKRMATHELECPLNSKRRCVEEPKPSEEKDKPNEESTANATEVTNNS

SEQ ID NO: 27041 - protein, 89 aa, Diabrotica virgifera
  misc_feature: Coding regions on vcDNA: vcDNA=SeqID_6738; Strand=-; Position=3-269
ADLSTYMSMSLMTIMLAMPNGIMHFIITLDRHVGHSAYAGVWSTPCHSRSLAWLKIDCGRVSHVSNAGSIDWCIYNAPLFKLLGVSTGR

SEQ ID NO: 27042 - protein, 201 aa, Diabrotica virgifera
  misc_feature: Coding regions on vcDNA: vcDNA=SeqID_6739; Strand=+; Position=57-662
  misc_feature: Homolog annotation: Hit_ID=XP_308743.1; Match level="QueryCoverage =97%, HitCoverage=36%, E-value=2e-37, Identity=42%"; Hit description =ENSANGP00000015016 [Anopheles gambiae]
MKLLMCLLLLWKTVSLAQSDKVLLVFPVPSKSHFILGNSLARGLAQAGHEVTLISPFADENPPKNYRDVVLEGFMEIKKEQTIFNVFDMEKMHPMLSVFIMNIIGNQLANATLGHPNVQKLLSSKEHFDVIIIEQFKNKAINALQWYYNAPLILFSTIGPSFWVNGFTENPSPPSYIPDMFLSYTSEMNFWQRTFNFIMTL

SEQ ID NO: 27043 - protein, 237 aa, Diabrotica virgifera
  misc_feature: Coding regions on vcDNA: vcDNA=SeqID_6740; Strand=+; Position=5-718
  misc_feature (2)..(144): Xaa can be any naturally occurring amino acid
  misc_feature (151)..(159): Xaa can be any naturally occurring amino acid
  misc_feature (162)..(169): Xaa can be any naturally occurring amino acid
  misc_feature (171)..(192): Xaa can be any naturally occurring amino acid
  misc_feature (196)..(222): Xaa can be any naturally occurring amino acid
VXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVEWPRHXXXXXXXXXISXXXXXXXXGXXXXXXXXXXXXXXXXXXXXXXNLSXXXXXXXXXXXXXXXXXXXXXXXXXXXIHLIGREQKSKFTSF

SEQ ID NO: 27044 - protein, 184 aa, Diabrotica virgifera
  misc_feature: Coding regions on vcDNA: vcDNA=SeqID_6741; Strand=-; Position=2-553
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(166): Xaa can be any naturally occurring amino acid
  misc_feature (174)..(181): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLCYHSTVXXXXXXXXRAQ

SEQ ID NO: 27045 - protein, 28 aa, Diabrotica virgifera
  misc_feature: Coding regions on vcDNA: vcDNA=SeqID_6742; Strand=+; Position=1-84
  misc_feature (9)..(15): Xaa can be any naturally occurring amino acid
  misc_feature (17)..(23): Xaa can be any naturally occurring amino acid
SRGRPSRPXXXXXXXTXXXXXXXDLYLG

SEQ ID NO: 27046 - protein, 61 aa, Diabrotica virgifera
  misc_feature: Coding regions on vcDNA: vcDNA=SeqID_6743; Strand=+; Position=87-272
RPYWNLLDLYGAERGLEHFLSTSVLNSKEIKYYLQREAFSSLPNTLQHHELRVFESKSRGK

SEQ ID NO: 27047 - protein, 161 aa, Diabrotica virgifera
  misc_feature: Coding regions on vcDNA: vcDNA=SeqID_6744; Strand=-; Position=0-482
  misc_feature (7)..(26): Xaa can be any naturally occurring amino acid
  misc_feature (28)..(49): Xaa can be any naturally occurring amino acid
  misc_feature (53)..(81): Xaa can be any naturally occurring amino acid
  misc_feature (86)..(93): Xaa can be any naturally occurring amino acid
  misc_feature (97)..(139): Xaa can be any naturally occurring amino acid
  misc_feature (141)..(151): Xaa can be any naturally occurring amino acid
YNPKNWXXXXXXXXXXXXXXXXXXXXPXXXXXXXXXXXXXXXXXXXXXXPIGXXXXXXXXXXXXXXXXXXXXXXXXXXXXXHPSFXXXXXXXXDPEXXXXXXXXXXXXXXXXXXXXXXXXXXXXXXXXXXXXXXXXXXXFXXXXXXXXXXXNQPGSHRFKL

SEQ ID NO: 27048 - protein, 289 aa, Diabrotica virgifera
  misc_feature: Coding regions on vcDNA: vcDNA=SeqID_6745; Strand=-; Position=15-881
  misc_feature: Homolog annotation: Hit_ID=AAF87760.1; Match level="QueryCoverage =99%, HitCoverage=65%, E-value=1e-119, Identity=77%"; Hit description= cytochrome oxidase subunit I [Diabrotica virgifera zeae]
  misc_feature: Pfam annotation: Pfam_ID=COX1; Match level="Score=57.3, E-value=4.2e -14, Copies=1"; Pfam description=Cytochrome C and Quinol oxidase polyp
  misc_feature (13)..(19): Xaa can be any naturally occurring amino acid
  misc_feature (26)..(26): Xaa can be any naturally occurring amino acid
  misc_feature (68)..(68): Xaa can be any naturally occurring amino acid
  misc_feature (103)..(103): Xaa can be any naturally occurring amino acid
  misc_feature (120)..(120): Xaa can be any naturally occurring amino acid
  misc_feature (123)..(129): Xaa can be any naturally occurring amino acid
  misc_feature (176)..(176): Xaa can be any naturally occurring amino acid
  misc_feature (183)..(199): Xaa can be any naturally occurring amino acid
  misc_feature (230)..(230): Xaa can be any naturally occurring amino acid
  misc_feature (246)..(253): Xaa can be any naturally occurring amino acid
  misc_feature (274)..(274): Xaa can be any naturally occurring amino acid
  misc_feature (289)..(289): Xaa can be any naturally occurring amino acid
DPAGGGDPILYQXXXXXXXHPEVYIXILPGFGLISHIVRQERRKKEAFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAHFHYVLSIGAVFAIIAGFIQXFPLFTGXXXXXXXXXXXXXXXXXGVNLTFFPQHFLGLIGIPRRYSDYPDVFILXNIVSSIGSLISLIGVXXXXXXXXEAFSFQRKRLRPLRITSSIEXLQFNPPAEHRYSELX

SEQ ID NO: 27049 - protein, 112 aa, Diabrotica virgifera
  misc_feature: Coding regions on vcDNA: vcDNA=SeqID_6746; Strand=+; Position=27-365
  misc_feature: Homolog annotation: Hit_ID=EAL30271.1; Match level="QueryCoverage =95%, HitCoverage=21%, E-value=3e-25, Identity=54%"; Hit description =GA18590-PA [Drosophila pseudoobscura]
MQLLALVFLIQCVSVFSTDYEVPKPRFKVLPKGFRVSIPQEEGIQLFAFHGNLNVPMNGLEAGQIAQDVAQSKRGRWIFEDRQTKLQRGDVIYYWLFVIKDHLGYKKRECTW

SEQ ID NO: 27050 - protein, 126 aa, Diabrotica virgifera
  misc_feature: Coding regions on vcDNA: vcDNA=SeqID_6747; Strand=+; Position=54-434
  misc_feature: Homolog annotation: Hit_ID=XP_311283.1; Match level="QueryCoverage =97%, HitCoverage=59%, E-value=5e-55, Identity=79%"; Hit description =ENSANGP00000017568 [Anopheles gambiae]
  misc_feature: Gene Ontology Annotation: Molecular function=actin binding; Cellular component=intercellular junction; Biological process=cytoskeleton organization and biogenesis
  misc_feature: Pfam annotation: Pfam_ID=Calponin; Match level="Score=25.4, E-value =0.00017, Copies=1"; Pfam description=Calponin family repeat
MSIIIQKIPTSGGDYKMMDNLNQFQKACVKYGVPDVDLFQTTDLWDRKNIVLVTTTIFALGRTCYKHPEWRGPFLGPRPSEENRRYFSDEQLRAGEAIIGLQAGQNRGATQAGQNFGASRKIILVK

SEQ ID NO: 27051 - protein, 65 aa, Diabrotica virgifera
  misc_feature: Coding regions on vcDNA: vcDNA=SeqID_6748; Strand=+; Position=225-422
KWPIFGVPVFCAGECIRSFLPVSLLFSLYMSSLYLYLGCIFFASECHFSKYYFNFQSNRSYLICQ

SEQ ID NO: 27052 - protein, 90 aa, Diabrotica virgifera
  misc_feature: Coding regions on vcDNA: vcDNA=SeqID_6749; Strand=+; Position=2-274
  misc_feature: Homolog annotation: Hit_ID=XP_308626.1; Match level="QueryCoverage =100%, HitCoverage=39%, E-value=2e-39, Identity=59%"; Hit description= ENSANGP00000011104 [Anopheles gambiae]
  misc_feature: Pfam annotation: Pfam_ID=NHL; Match level="Score=87.3, E-value=4e-23, Copies=2"; Pfam description=NHL repeat
  misc_feature (12)..(12): Xaa can be any naturally occurring amino acid
KVLTSFGSEGSXEGQFKFPRGVAVDDQGYICVADSGNNRIQIFSPDGGFLRAFGCWGIGKAEFKGLEGVAMTPNGHILVCDRENHRIQVF

SEQ ID NO: 27053 - protein, 82 aa, Diabrotica virgifera
  misc_feature: Coding regions on vcDNA: vcDNA=SeqID_6750; Strand=-; Position=59-307
SGVPNLYLGPHISLSPLQCSHTSKPIRVDSAKLHIPKFSACYQSSNFGPRDPGLCIPLLLYNVSVIRLVFCLYLQLFSPSDF

SEQ ID NO: 27054 - protein, 277 aa, Diabrotica virgifera
  misc_feature: Coding regions on vcDNA: vcDNA=SeqID_6751; Strand=+; Position=63-896
  misc_feature: Homolog annotation: Hit_ID=NP_610929.2; Match level="QueryCoverage =78%, HitCoverage=48%, E-value=3e-31, Identity=35%"; Hit description =CG13016-PA [Drosophila melanogaster] gb|AAF58292.2| CG13016-PA [Drosophila melanogaster]
  misc_feature (196)..(196): Xaa can be any naturally occurring amino acid
  misc_feature (226)..(226): Xaa can be any naturally occurring amino acid
MPLVARRVSRNVVRATPISPPVISSFANEPCGQRYAPLGASVPTLPALEPPASPKHFPFPNTPVDNEVFFESLMCFFAMASTGLQFLHLYRSVWWLPHSYTNQTMNFYLIDPYLVAFIVITLCRRLIYIIMRVVVKKVMITTLPEQEFLHTFRFFLFTKVFMMLGFCLVLVMQNHKLEKILYLCYPFLIYFVFFGXMVHPFFEIVKWSSANPPLHACSSSALEIRXKKVENLGTHFNGRMKDILFSCFLVTHYYAGIIPWLFCSSFRYFYKTCWGCT

SEQ ID NO: 27055 - protein, 64 aa, Diabrotica virgifera
  misc_feature: Coding regions on vcDNA: vcDNA=SeqID_6752; Strand=+; Position=175-367
  misc_feature: Homolog annotation: Hit_ID=AAM53179.1; Match level="QueryCoverage =90%, HitCoverage=12%, E-value=2e-14, Identity=65%"; Hit description =Hsp70 protein [Megachasma pelagios]
  misc_feature: Gene Ontology Annotation: Biological process=reproduction
  misc_feature (34)..(34): Xaa can be any naturally occurring amino acid
IPLIDFIERNTTIPTRQTQTFPTYSDDHPGVLIXEYEREQALTLEITPPGKIQLSVVSPAPRGV

SEQ ID NO: 27056 - protein, 30 aa, Diabrotica virgifera
  misc_feature: Coding regions on vcDNA: vcDNA=SeqID_6753; Strand=-; Position=2-91
FPPKNCTPLNIFVINIAVKIFGFKTFSFYQ

SEQ ID NO: 27057 - protein, 81 aa, Diabrotica virgifera
  misc_feature: Coding regions on vcDNA: vcDNA=SeqID_6754; Strand=-; Position=66-311
RATHDIVGYCTICNKKEDKKQQRKGYNGSRQKDERKIHRKRWLDAVKDDLKTMNERQWRRRTQERSEWNDIARQVKTYPGL

SEQ ID NO: 27058 - protein, 273 aa, Diabrotica virgifera
  misc_feature: Coding regions on vcDNA: vcDNA=SeqID_6755; Strand=+; Position=2-821
  misc_feature: Homolog annotation: Hit_ID=XP_392101.1; Match level="QueryCoverage =100%, HitCoverage=19%, E-value=1e-122, Identity=81%"; Hit description=similar to CG10840-PB [Apis mellifera]
  misc_feature: Gene Ontology Annotation: Molecular function=translation initiation factor activity; Cellular component=cytosolic small ribosomal subunit (sensu Eukarya); Biological process=regulation of translational initiation
  misc_feature: Pfam annotation: Pfam_ID=GTP_EFTU_D2; Match level="Score=27.2, E -value=5e-05, Copies=1"; Pfam description=Elongation factor Tu domain 2
  misc_feature (56)..(60): Xaa can be any naturally occurring amino acid
  misc_feature (114)..(114): Xaa can be any naturally occurring amino acid
GLNAALFYENPDIRNYVSLVPTSAITGEGMGNLLALIVEFCQTKLTKRLMYSDELXXXXXEVKAIPGLGTTIDVILVNGTLREGDTMLCAGTDGPIETQIRSLLMPQPMRELRXNAYIEYKEIKAAQGVKIAAKELEKAIAGLNLYVAHKSDEIDIVKEEVARELKSALSNIKLAERGVYVQASTLGSLEALLEFLRTSKIPYSGIRIGPVVKKDVMKASIMLEHESQYATILAFDVKVERDAQELADSVGVKIFQADIIYHLFDKFMAYREE

SEQ ID NO: 27059 - protein, 174 aa, Diabrotica virgifera
  misc_feature: Coding regions on vcDNA: vcDNA=SeqID_6756; Strand=+; Position=1-522
NTTVMILLKVAVEPSYRTPKFKDACTSREVTQIILSSSDEESVGVIGGSDDELLPKMKPKVTQIILSSSEHDSDDIIEGSDDESVPKTKMKQPTLLEMFKKEPKLEQKIELKTEPKIEVLSSEFFEVSPRQYQEQRNMVRRLRQDLEQAEQLMEALNMEHLPDKGQSLKDRYRT

SEQ ID NO: 27060 - protein, 257 aa, Diabrotica virgifera
  misc_feature: Coding regions on vcDNA: vcDNA=SeqID_6757; Strand=+; Position=1-775
  misc_feature: Homolog annotation: Hit_ID=EAK83807.1; Match level="QueryCoverage =91%, HitCoverage=24%, E-value=1e-39, Identity=39%"; Hit description =hypothetical protein UM02637.1 [Ustilago maydis 521] ref|XP _400252.1| hypothetical protein UM02637.1 [Usti
  misc_feature: Gene Ontology Annotation: Molecular function=molecular_function unknown; Cellular component=nucleus; Biological process=mRNA polyadenylation
  misc_feature: Pfam annotation: Pfam_ID=Ataxin-2_N; Match level="Score=159.2, E -value=8.8e-45, Copies=1"; Pfam description=Ataxin-2 N-terminal region
  misc_feature (103)..(103): Xaa can be any naturally occurring amino acid
DQESAKVMHDRMLFLLGNMIGTMVDATVKDGCKFRGVFHGASTEGDLAIVLSLAQKIYDPTAPIAEDKTNPNPVVSKLLIYSKDLVEVTISSINFTESASDRXTDTDITGKLEVKERELHKWAPSEEDNALGLLDGDLESSSPGETAWDQFAVNEKLFGLKTDFNEEIYTTRLDRSAPGFKDREKRAIKVANEIQKVSTTNVHMLEERGFLVEDSGMDEEDLYGAVVRDSNKYVPPALRKQSQKQTQEQQPNAQHHK

SEQ ID NO: 27061 - protein, 73 aa, Diabrotica virgifera
  misc_feature: Coding regions on vcDNA: vcDNA=SeqID_6758; Strand=-; Position=413-634
KYFPVFPVRIFRLRRASQCFVHRLNSWGVALSEEGVVLVGRRLVRGAYGLYNASFGYYVLACGPPHGFPSWFS

SEQ ID NO: 27062 - protein, 18 aa, Diabrotica virgifera
  misc_feature: Coding regions on vcDNA: vcDNA=SeqID_6759; Strand=-; Position=0-53
GFFPAGGNPSSNVPPSAP

SEQ ID NO: 27063 - protein, 83 aa, Diabrotica virgifera
  misc_feature: Coding regions on vcDNA: vcDNA=SeqID_6760; Strand=-; Position=379-630
ANHDGFHQGDYEVPFNRITVFEHKGYVFHFHYHVISICLFRHTVKTINKKNPIKLIFLIVFLSFKIPFFVHTFVLVVEGLVAE

SEQ ID NO: 27064 - protein, 111 aa, Diabrotica virgifera
  misc_feature: Coding regions on vcDNA: vcDNA=SeqID_6761; Strand=-; Position=336-671
QNSWKSYLPAILLLESNYKIPHINNIGMQSPQTVRYPFYKQNGADKSYFFQLLLYNSEDYKSTTKTLKQKFTAIKFCTETCPSRSASTKIFLGKCGPSQQKLQFSNKVLGK

SEQ ID NO: 27065 - protein, 165 aa, Diabrotica virgifera
  misc_feature: Coding regions on vcDNA: vcDNA=SeqID_6762; Strand=+; Position=137-635
  misc_feature: Homolog annotation: Hit_ID=XP_313621.1; Match level="QueryCoverage =90%, HitCoverage=33%, E-value=3e-19, Identity=36%"; Hit description =ENSANGP00000024261 [Anopheles gambiae]
  misc_feature (45)..(45): Xaa can be any naturally occurring amino acid
  misc_feature (111)..(111): Xaa can be any naturally occurring amino acid
KNPGRKQGPTSKYSNFFKDKKLTQNTKLEIYKAAIRPVITYYGAXVMCLTQKEEERSRILERKVIRRIAGPLNLGNNEFRKLMNHELRELLKGEDIVRFIKAQRLKWMGHXKRKSEAVIKKISKWRPVSGRPRGRPKTRWENQIVEDLKKMGVRKWVTKSKNRNE

SEQ ID NO: 27066 - protein, 299 aa, Diabrotica virgifera
  misc_feature: Coding regions on vcDNA: vcDNA=SeqID_6763; Strand=+; Position=453-1349
  misc_feature (4)..(10): Xaa can be any naturally occurring amino acid
  misc_feature (13)..(31): Xaa can be any naturally occurring amino acid
  misc_feature (36)..(43): Xaa can be any naturally occurring amino acid
  misc_feature (66)..(84): Xaa can be any naturally occurring amino acid
  misc_feature (95)..(107): Xaa can be any naturally occurring amino acid
  misc_feature (112)..(171): Xaa can be any naturally occurring amino acid
  misc_feature (173)..(191): Xaa can be any naturally occurring amino acid
  misc_feature (196)..(276): Xaa can be any naturally occurring amino acid
  misc_feature (286)..(296): Xaa can be any naturally occurring amino acid
GLLXXXXXXXFLXXXXXXXXXXXXXXXXXXXPSFQXXXXXXXXMATLSRAKIPRPFKFNSVGEAKXXXXXXXXXXXXXXXXXXXWRIPLLNLLIXXXXXXXXXXXXXSLHYXXXXXXXXXXXXXXXXXXXXXXXXXXXXXXXXXXXXXXXXXXXXXXXXXXXXXXXXXXXXPXXXXXXXXXXXXXXXXXXXQKYWXXXXXXXXXXXXXXXXXXXXXXXXXXXXXXXXXXXXXXXXXXXXXXXXXXXXXXXXXXXXXXXXXXXXXXXXXXXXXXXXXAANNQEGGTXXXXXXXXXXXFFN

SEQ ID NO: 27067 - protein, 72 aa, Diabrotica virgifera
  misc_feature: Coding regions on vcDNA: vcDNA=SeqID_6764; Strand=-; Position=173-391
  misc_feature (16)..(22): Xaa can be any naturally occurring amino acid
  misc_feature (30)..(37): Xaa can be any naturally occurring amino acid
IPNYKLLFHDSMNPLXXXXXXXHKSSDKYXXXXXXXXPLLHYLDHQHPYRFSSIPRLSPSNDKRLLPSHRLV

SEQ ID NO: 27068 - protein, 121 aa, Diabrotica virgifera
  misc_feature: Coding regions on vcDNA: vcDNA=SeqID_6765; Strand=-; Position=519-884
PKRATNLALKHGRVTHGDIRSKWKKDKTGSNHGNDLNFLPYQMLMHLIGQGIPPLPWPSNLSDMNTIENAWECLKRKLSGEVITNKVQLTERTSQNISIVVKYNNARKVLCSNDLNLQLKV

SEQ ID NO: 27069 - protein, 127 aa, Diabrotica virgifera
  misc_feature: Coding regions on vcDNA: vcDNA=SeqID_6766; Strand=-; Position=258-641
IIYNKKKLSIVKVHVFGVCDDSNFPGGNPTFRVLKIATKWGSFRMPMVGSSIKSFVLSFVIQYHAKCPARSRTRSGTILLNVLSRNIWDHLWGTFTVYLFSEETLEIKCTSSIVCCMDQLVDIKEET

SEQ ID NO: 27070 - protein, 67 aa, Diabrotica virgifera
  misc_feature: Coding regions on vcDNA: vcDNA=SeqID_6767; Strand=-; Position=2-202
  misc_feature (6)..(15): Xaa can be any naturally occurring amino acid
  misc_feature (24)..(31): Xaa can be any naturally occurring amino acid
  misc_feature (34)..(41): Xaa can be any naturally occurring amino acid
  misc_feature (46)..(46): Xaa can be any naturally occurring amino acid
  misc_feature (53)..(66): Xaa can be any naturally occurring amino acid
WVLSDXXXXXXXXXXPTGSPPVNXXXXXXXXSTXXXXXXXXPIINXNPTSRSXXXXXXXXXXXXXXV

SEQ ID NO: 27071 - protein, 70 aa, Diabrotica virgifera
  misc_feature: Coding regions on vcDNA: vcDNA=SeqID_6768; Strand=+; Position=3-215
  misc_feature (1)..(30): Xaa can be any naturally occurring amino acid
  misc_feature (38)..(51): Xaa can be any naturally occurring amino acid
XXXXXXXXXXXXXXXXXXXXXXXXXXXXXXLNYKDSPXXXXXXXXXXXXXXANVSITIIFLIRNCHERLG

SEQ ID NO: 27072 - protein, 41 aa, Diabrotica virgifera
  misc_feature: Coding regions on vcDNA: vcDNA=SeqID_6769; Strand=-; Position=58-183
EVFTPNLLRSLRSLRLSLTSQGLPTRDSSYYCYPVYTHRER

SEQ ID NO: 27073 - protein, 25 aa, Diabrotica virgifera
  misc_feature: Coding regions on vcDNA: vcDNA=SeqID_6770; Strand=+; Position=15-92
AERYDRYLQFLKLNYDLITFLRGRY

SEQ ID NO: 27074 - protein, 169 aa, Diabrotica virgifera
  misc_feature: Coding regions on vcDNA: vcDNA=SeqID_6771; Strand=+; Position=582-1091
  misc_feature (68)..(74): Xaa can be any naturally occurring amino acid
NKNWVVPRQPLYGEMCAPLFVVKIRYALKIITPLANWQHGNLYNRLFLSFSLLRQSIVKPLILSNRLXXXXXXXAFYLLFSRGAQPLIFLLIKTYKKPDPNKFLQTLPPKNSLIWLKSKEPISFGTNSWGPKKFPHCPHWGKRNNLNPFFPLLGGEFLKTPHPPRLKIF

SEQ ID NO: 27075 - protein, 86 aa, Diabrotica virgifera
  misc_feature: Coding regions on vcDNA: vcDNA=SeqID_6772; Strand=+; Position=11-271
  misc_feature (78)..(84): Xaa can be any naturally occurring amino acid
NFQFLPLTRQAGRFTVSNLMDLWFEPYSTQKFFKRNTIKSSFYNNYQNKMSQENNFRYSYRYVNILKIFRCFNVRQSXXXXXXXPT

SEQ ID NO: 27076 - protein, 58 aa, Diabrotica virgifera
  misc_feature: Coding regions on vcDNA: vcDNA=SeqID_6773; Strand=+; Position=1-174
  misc_feature (1)..(27): Xaa can be any naturally occurring amino acid
  misc_feature (30)..(54): Xaa can be any naturally occurring amino acid
XXXXXXXXXXXXXXXXXXXXXXXXXXXEKXXXXXXXXXXXXXXXXXXXXXXXXXNWGG

SEQ ID NO: 27077 - protein, 277 aa, Diabrotica virgifera
  misc_feature: Coding regions on vcDNA: vcDNA=SeqID_6774; Strand=+; Position=1-831
  misc_feature: Homolog annotation: Hit_ID=XP_392361.1; Match level="QueryCoverage =98%, HitCoverage=27%, E-value=3e-93, Identity=50%"; Hit description =similar to CG30171-PB [Apis mellifera]
  misc_feature: Gene Ontology Annotation: Molecular function=calmodulin regulated protein kinase activity; Cellular component=cytoplasm; Biological process=induction of apoptosis
  misc_feature: Pfam annotation: Pfam_ID=I-set; Match level="Score=67.8, E-value=3e -17, Copies=1"; Pfam description=Immunoglobulin I-set domain
FSSARNEHGEARQRVSLEIAEIPYFIRRPEIDYSMLRGKSKFEARIIGVPYPEIKWYKDWKPLAPSSRIKIAFIEPDITVLTIHDIILKDEGLYSVSARNVAGSTSASAMLYVEENEQDYKMRNYSNISPIKTKKRIYTDFYDIGDELGRGTQGITSHAVERLNGRNYAAKVMYGSGDFRPFMYNELDMLNELRHKKLISLHEAYETEDSLALILELASGGELVRDYLLKMDYYTESDIAGFIRQLLQGLDYMHDRGYAHMGLDLGDLLISHPAGTI

SEQ ID NO: 27078 - protein, 66 aa, Diabrotica virgifera; identical to SEQ ID NO: 26808
  misc_feature: Coding regions on vcDNA: vcDNA=SeqID_6775; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 27079 - protein, 206 aa, Diabrotica virgifera
  misc_feature: Coding regions on vcDNA: vcDNA=SeqID_6776; Strand=-; Position=1-618
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(206): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27080 - protein, 92 aa, Diabrotica virgifera
  misc_feature: Coding regions on vcDNA: vcDNA=SeqID_6777; Strand=+; Position=71-349
  misc_feature (31)..(40): Xaa can be any naturally occurring amino acid
  misc_feature (48)..(64): Xaa can be any naturally occurring amino acid
FSINFLFKYKFKLSRFSKDANISIKQCVYLXXXXXXXXXXQQHSFHLXXXXXXXXXXXXXXXXXLNKFEWGRGHFDRGKGCKINYVFLSESW

SEQ ID NO: 27081 - protein, 322 aa, Diabrotica virgifera
  misc_feature: Coding regions on vcDNA: vcDNA=SeqID_6778; Strand=+; Position=2-971
  misc_feature: Homolog annotation: Hit_ID=XP_312568.1; Match level="QueryCoverage =84%, HitCoverage=58%, E-value=2e-51, Identity=36%"; Hit description =ENSANGP00000014917 [Anopheles gambiae]
  misc_feature: Gene Ontology Annotation: Molecular function=acid phosphatase activity; Cellular component=integral to membrane; Biological process=regulation of cell cycle
  misc_feature: Pfam annotation: Pfam_ID=Acid_phosphat_A; Match level="Score=-29.3, E- value=2.8e-06, Copies=1"; Pfam description=Histidine acid phosphatase
  misc_feature (278)..(278): Xaa can be any naturally occurring amino acid
FRPRLAIIVSNILLLFTPVYFSLITKNISTEDRGTLVAVVVMYRHGDRAPLISFPRDEYYNLTYWPMGFGQLTKYGVTRLYNLGKWFRERYKNFLSETYSPNEIYIHSSNIDRCLMSASAALAGLYPPTGFQFWNPQLSWQPIPVHTDNKNHDEIITERRKCKKYEDIVLTLQEATYPSYERNYTELFQFVSNKTGWTVSLYEIKTLYSVLNSYNSYNSSFVPKWIENINLDIVETLAAVVYGLPSSTIELARLRIGPFYKYMFDLFDTFVNSSSSNXQNLFMISAHDTTVCSALRAMRAFRKPSEIPRHFKFWKFRKYMGN

SEQ ID NO: 27082 - protein, 78 aa, Diabrotica virgifera
  misc_feature: Coding regions on vcDNA: vcDNA=SeqID_6779; Strand=+; Position=3-236
  misc_feature: Homolog annotation: Hit_ID=XP_319323.1; Match level="QueryCoverage =100%, HitCoverage=6%, E-value=4e-15, Identity=51%"; Hit description =ENSANGP00000012364 [Anopheles gambiae]
  misc_feature: Gene Ontology Annotation: Molecular function=ATP citrate synthase activity; Cellular component=citrate lyase complex; Biological process=ATP catabolism
LLTIGDRSIGAMDGEANMIREVYEKGMHPAEFDNHLTSLAQLIVDIGRRAKTILNAEQRIKIEKQMLMDNFPATPLLQ

SEQ ID NO: 27083 - protein, 132 aa, Diabrotica virgifera
  misc_feature: Coding regions on vcDNA: vcDNA=SeqID_6780; Strand=+; Position=291-692
  misc_feature: Homolog annotation: Hit_ID=AAF87759.1; Match level="QueryCoverage =98%, HitCoverage=29%, E-value=1e-52, Identity=80%"; Hit description =cytochrome oxidase subunit I [Diabrotica virgifera virgifera]
  misc_feature: Pfam annotation: Pfam_ID=COX1; Match level="Score=-275.0, E-value =0.065, Copies=1"; Pfam description=Cytochrome C and Quinol oxidase polype
  misc_feature (60)..(60): Xaa can be any naturally occurring amino acid
  misc_feature (97)..(97): Xaa can be any naturally occurring amino acid
  misc_feature (111)..(111): Xaa can be any naturally occurring amino acid
TAYPPLSSNIAHGGPSLDLTIFRLHLAGISSILGAINFITTVINIRPIGITFDRIPLFVXAGVITAILLLLSLPDLAGAITILLTDRNLDTSFFDPXGGGDPNSPININFXLAHPEVYILILPGFGLISHFC

SEQ ID NO: 27084 - protein, 161 aa, Diabrotica virgifera
  misc_feature: Coding regions on vcDNA: vcDNA=SeqID_6781; Strand=+; Position=606-1091
  misc_feature (10)..(27): Xaa can be any naturally occurring amino acid
  misc_feature (45)..(59): Xaa can be any naturally occurring amino acid
  misc_feature (69)..(78): Xaa can be any naturally occurring amino acid
  misc_feature (97)..(105): Xaa can be any naturally occurring amino acid
  misc_feature (111)..(117): Xaa can be any naturally occurring amino acid
  misc_feature (124)..(133): Xaa can be any naturally occurring amino acid
ICYNSKTTNXXXXXXXXXXXXXXXXXXNICPGRNFGFMYKKYNIXXXXXXXXXXXXXXXQKKIRSGPNXXXXXXXXXXFNKSGKTDLLSNSSPKKTXXXXXXXXXLFSFGXXXXXXXGWAFLSXXXXXXXXXXPIKKPQQVFCFHRQKKEKERRKKILILG

SEQ ID NO: 27085 - protein, 88 aa, Diabrotica virgifera
  misc_feature: Coding regions on vcDNA: vcDNA=SeqID_6782; Strand=-; Position=178-444
  misc_feature (51)..(58): Xaa can be any naturally occurring amino acid
KGYPILPHLLVPRFAQRADFGIMTCLNYYKFLFFNIMTNKYSRTHSLLVGXXXXXXXXVLVIITMDYFSADIITWLTKNAHVLFTTID

SEQ ID NO: 27086 - protein, 89 aa, Diabrotica virgifera
  misc_feature: Coding regions on vcDNA: vcDNA=SeqID_6783; Strand=-; Position=502-771
  misc_feature (56)..(62): Xaa can be any naturally occurring amino acid
KIYSVLYISSCETNTYTTQKYLSTVSFLTSTLSKSISEYALAIVTIKLYVDTSRVXXXXXXXLIPKYFCEKYGWNVYFQIYENFHARFN

SEQ ID NO: 27087 - protein, 66 aa, Diabrotica virgifera
  misc_feature: Coding regions on vcDNA: vcDNA=SeqID_6784; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PLXXXXXXXXXXXTTLAHTGLNXXXXXXXXSNXXXXXXXXXXXXXXPTSRSXXXXXXXXXXXXXXV

SEQ ID NO: 27088 - protein, 74 aa, Diabrotica virgifera
  misc_feature: Coding regions on vcDNA: vcDNA=SeqID_6785; Strand=-; Position=218-442
  misc_feature (20)..(31): Xaa can be any naturally occurring amino acid
KTMYYYIIHKYVCFVIKITXXXXXXXXXXXXQTNLMVHTTTNLFKQRILALYAKSTYKLKKETSKLIGENKRYS

SEQ ID NO: 27089 - protein, 72 aa, Diabrotica virgifera
  misc_feature: Coding regions on vcDNA: vcDNA=SeqID_6786; Strand=+; Position=3-221
VGLNMVTKALLQLTFGQALGLLKDLWSYAICIHTLNVITIVVIVSWSFEIFITGLRTKNTEEEDTKPTEVNS

SEQ ID NO: 27090 - protein, 50 aa, Diabrotica virgifera
  misc_feature: Coding regions on vcDNA: vcDNA=SeqID_6787; Strand=-; Position=74-226
  misc_feature (4)..(15): Xaa can be any naturally occurring amino acid
  misc_feature (28)..(35): Xaa can be any naturally occurring amino acid
VPFXXXXXXXXXXXXNPHVAPPRVLTSXXXXXXXXWNRIKKYSCYPKFKL

SEQ ID NO: 27091 - protein, 61 aa, Diabrotica virgifera
  misc_feature: Coding regions on vcDNA: vcDNA=SeqID_6788; Strand=-; Position=85-270
LLRVVSSAHGIVVWASNNVVLCRIRLVVDHRGPAVMYAIARMRPLCCRSKLRVRPTFRVSL

SEQ ID NO: 27092 - protein, 247 aa, Diabrotica virgifera
  misc_feature: Coding regions on vcDNA: vcDNA=SeqID_6789; Strand=+; Position=1-739
  misc_feature: Homolog annotation: Hit_ID=XP_395419.1; Match level="QueryCoverage =96%, HitCoverage=37%, E-value=5e-46, Identity=42%"; Hit description =similar to CG10107-PA [Apis mellifera]
  misc_feature: Gene Ontology Annotation: Molecular function=cysteine-type peptidase activity; Cellular component=nucleus; Biological process=protein sumoylation
  misc_feature: Pfam annotation: Pfam_ID=Peptidase_C48; Match level="Score=-14.8, E -value=0.0029, Copies=1"; Pfam description=Ulp1 protease family, C -terminal catal
  misc_feature (26)..(36): Xaa can be any naturally occurring amino acid
  misc_feature (227)..(227): Xaa can be any naturally occurring amino acid
SFNSSLPVIFYYLNPSAASQVRTVLXXXXXXXXXXXPLSLEDEVHRRLTLLPDDLSEENKNAFQTIYSQPASIFEELNIKEANDILIKTCPKDVARPTPGFGAFAEIKQLLTYPPEGRYRLTINTEDYMCLAQDQFLNDVIIDFYLTYLVDNLPPEQKSKIHVFSTFFYKRLTTKPTKASRKSQPSELDPTLSPAQKRHARVKKWSKNVHIFEKDFVIIPLNENGHXWVLGIICFPGMAGLPIQVFL

SEQ ID NO: 27093 - protein, 162 aa, Diabrotica virgifera
  misc_feature: Coding regions on vcDNA: vcDNA=SeqID_6790; Strand=+; Position=93-581
  misc_feature: Homolog annotation: Hit_ID=BAD72925.1; Match level="QueryCoverage =50%, HitCoverage=9%, E-value=2e-22, Identity=65%"; Hit description =unnamed protein product [Drosophila sechellia] dbj|BAD72907.1| unnamed protein product [Drosophila simulans
  misc_feature: Gene Ontology Annotation: Molecular function=ATP dependent RNA helicase activity; Cellular component=cellular_component unknown; Biological process=nucleobase, nucleoside, nucleotide and nucleic acid metabolism
MTKYIKGNWKPVAIDSNVFSGDMTDLIGIEECTDYDLNEFSSKKPQKRNLPNEENIPKQHIEIDHFTPSKSGNTSGIEDEAESTKNDLDVTAWNSFGLPESILKALAELGYSNPTQIQELTLPSAILGKRDILGAAETGSGKTLAFGLPILTGILKVKKNIL

SEQ ID NO: 27094 - protein, 239 aa, Diabrotica virgifera
  misc_feature: Coding regions on vcDNA: vcDNA=SeqID_6791; Strand=+; Position=1-721
  misc_feature: Homolog annotation: Hit_ID=XP_321391.1; Match level="QueryCoverage =99%, HitCoverage=9%, E-value=3e-95, Identity=72%"; Hit description =ENSANGP00000008519 [Anopheles gambiae] gb|EAL38547.1| ENSANGP00000029378 [Anopheles gambiae
  misc_feature: Gene Ontology Annotation: Molecular function=translation factor activity, nucleic acid binding; Cellular component=ribosome; Biological process=regulation of translation
  misc_feature: Pfam annotation: Pfam_ID=HEAT; Match level="Score=71.8, E-value=1.8e -18, Copies=4"; Pfam description=HEAT repeat
  misc_feature (208)..(208): Xaa can be any naturally occurring amino acid
TSKEMVLTFVNSLVPTVRKALCDPLPEVRQAAAKTFDSLHFTVGARALDDILPTLLNQLNDENPEVVEWTLDGLRQVMAIKSRVVLPYLVPQLTAPPANTKALSILASVAGEALNKYLPRILPALQTTLGSSRGTPEEAQQMEYCQAVVLSVVDEVGIRTVIDTLLENTRNENADQRRAAATLLCGFCANSKAQYTSHVPQLLRGLIXLCIDSDREVLQMSWEVLNAGTKTLETKQQAT

SEQ ID NO: 27095 - protein, 68 aa, Diabrotica virgifera
  misc_feature: Coding regions on vcDNA: vcDNA=SeqID_6792; Strand=-; Position=3-206
KKVRTKNGYQKGEKQLKITCYADDAILISQSEDDLQHMLHQFNIIARKFNMLISPQKTKCMVITADPI

SEQ ID NO: 27096 - protein, 201 aa, Diabrotica virgifera
  misc_feature: Coding regions on vcDNA: vcDNA=SeqID_6793; Strand=+; Position=9-614
  misc_feature: Homolog annotation: Hit_ID=CAH81944.1; Match level="QueryCoverage =93%, HitCoverage=76%, E-value=1e-09, Identity=21%"; Hit description =conserved hypothetical protein [Plasmodium chabaudi]
  misc_feature (6)..(8): Xaa can be any naturally occurring amino acid
  misc_feature (10)..(10): Xaa can be any naturally occurring amino acid
  misc_feature (17)..(17): Xaa can be any naturally occurring amino acid
  misc_feature (20)..(20): Xaa can be any naturally occurring amino acid
  misc_feature (34)..(35): Xaa can be any naturally occurring amino acid
  misc_feature (45)..(45): Xaa can be any naturally occurring amino acid
  misc_feature (69)..(69): Xaa can be any naturally occurring amino acid
  misc_feature (72)..(72): Xaa can be any naturally occurring amino acid
  misc_feature (80)..(81): Xaa can be any naturally occurring amino acid
  misc_feature (83)..(85): Xaa can be any naturally occurring amino acid
  misc_feature (89)..(89): Xaa can be any naturally occurring amino acid
  misc_feature (91)..(91): Xaa can be any naturally occurring amino acid
  misc_feature (96)..(96): Xaa can be any naturally occurring amino acid
  misc_feature (98)..(98): Xaa can be any naturally occurring amino acid
  misc_feature (107)..(107): Xaa can be any naturally occurring amino acid
  misc_feature (109)..(109): Xaa can be any naturally occurring amino acid
  misc_feature (115)..(115): Xaa can be any naturally occurring amino acid
  misc_feature (117)..(117): Xaa can be any naturally occurring amino acid
  misc_feature (125)..(125): Xaa can be any naturally occurring amino acid
  misc_feature (128)..(128): Xaa can be any naturally occurring amino acid
  misc_feature (152)..(161): Xaa can be any naturally occurring amino acid
  misc_feature (174)..(174): Xaa can be any naturally occurring amino acid
PSRGYXXXRXRGLYRAXHSXNSPKRPKNRASRTXXSSYFNDQGQXRAQKRRERHKTRTSQRQRQEDRQXRTXNRQSRRTXXTXXXKRQXHXTERRXRXKNRRQRQQXEXKPAKRXRXRTRHRRHXPSXKNRQKRARPPKRNRPKKTNGKDEXXXXXXXXXXGRKKTKTRKPQPXKNPKPDHKNPPGKTGEKDRDQGQGEKE

SEQ ID NO: 27097 - protein, 223 aa, Diabrotica virgifera
  misc_feature: Coding regions on vcDNA: vcDNA=SeqID_6794; Strand=-; Position=3-672
  misc_feature: Homolog annotation: Hit_ID=AAF87760.1; Match level="QueryCoverage =100%, HitCoverage=50%, E-value=5e-89, Identity=76%"; Hit description= cytochrome oxidase subunit I [Diabrotica virgifera zeae]
  misc_feature: Pfam annotation: Pfam_ID=COX1; Match level="Score=-148.1, E-value =3.3e-06, Copies=1"; Pfam description=Cytochrome C and Quinol oxidase polype
  misc_feature (34)..(34): Xaa can be any naturally occurring amino acid
  misc_feature (51)..(51): Xaa can be any naturally occurring amino acid
  misc_feature (54)..(60): Xaa can be any naturally occurring amino acid
  misc_feature (107)..(107): Xaa can be any naturally occurring amino acid
  misc_feature (114)..(130): Xaa can be any naturally occurring amino acid
  misc_feature (161)..(161): Xaa can be any naturally occurring amino acid
  misc_feature (177)..(184): Xaa can be any naturally occurring amino acid
  misc_feature (205)..(205): Xaa can be any naturally occurring amino acid
HHIFTVGMDVDTRAYFPSATIIIAVPTGIKVFRXLATYHGTTITYSPVTLXALXXXXXXXVGGLTGVVLANSSIDIVLHDTYYVVAHFHYVLSIGAVFAIIAGFIQXFPLFTGXXXXXXXXXXXXXXXXXGVNLTFFPQHFLGLIGIPRRYSDYPDVFILXNIVSSIGSLISLIGVXXXXXXXXEAFSFQRKRLRPLRITSSIEXLQFNPPAEHRYSELPILS

SEQ ID NO: 27098 - protein, 47 aa, Diabrotica virgifera
  misc_feature: Coding regions on vcDNA: vcDNA=SeqID_6795; Strand=+; Position=2-145
PFKADFQLIITISDPLKIFWQLAQLRQTPHYDHIIKVPLSQTGSSLG

SEQ ID NO: 27099 - protein, 136 aa, Diabrotica virgifera
  misc_feature: Coding regions on vcDNA: vcDNA=SeqID_6796; Strand=+; Position=37-447
  misc_feature (50)..(57): Xaa can be any naturally occurring amino acid
LRIPPPVLQALKSLSEIKLRKSPQKQETTLVYRKVWCFNRSFYRACSDTXXXXXXXXRTFLRLLDEAIGGWPIIKMHTWNEREFTWQGATLKARKLGLYNVFFFSIQIYDNYTRDGRMLWLKPFYATQISSFNLKR

SEQ ID NO: 27100 - protein, 54 aa, Diabrotica virgifera
  misc_feature: Coding regions on vcDNA: vcDNA=SeqID_6797; Strand=-; Position=1-162
  misc_feature (32)..(43): Xaa can be any naturally occurring amino acid
GGGKYYKGFFSRCEYPFWNYPPLCPPQCFFNXXXXXXXXXXXXEKNQEKENIPK

SEQ ID NO: 27101 - protein, 160 aa, Diabrotica virgifera
  misc_feature: Coding regions on vcDNA: vcDNA=SeqID_6798; Strand=+; Position=2-484
  misc_feature: Homolog annotation: Hit_ID=XP_393150.1; Match level="QueryCoverage =92%, HitCoverage=0%, E-value=4e-74, Identity=87%"; Hit description =similar to CG33196-PB [Apis mellifera]
  misc_feature: Pfam annotation: Pfam_ID=Zona_pellucida; Match level="Score=-28.1, E -value=0.00061, Copies=1"; Pfam description=Zona pellucida-like domain
LCVRVTLGFNVSMLTTAGTIANTGPPPTCLMKIVTPTGEEINSAEIGDNLMLQVDVQPGSIYGGFARSCVAKTMEDAVENEYIVTDENGCATDPSIFGEWDYNPDTQSLLASFNAFKFPSSDNIRFQCNIRVCFGRCQPVNCRGYNAFGRRKEIRRKLRK

SEQ ID NO: 27102 - protein, 18 aa, Diabrotica virgifera
  misc_feature: Coding regions on vcDNA: vcDNA=SeqID_6799; Strand=+; Position=2-55
PPYLHRWTLTPNQIFSSF

SEQ ID NO: 27103 - protein, 89 aa, Diabrotica virgifera
  misc_feature: Coding regions on vcDNA: vcDNA=SeqID_6800; Strand=+; Position=334-603
LHIFILPISNIFRGALNNTILLQLPFHPPATIKKFSYPKNGIMYYYTFLFLLFLSFCFPTPLNFPPSTTADTITPQHPCVTYLQHSPFE

SEQ ID NO: 27104 - protein, 56 aa, Diabrotica virgifera
  misc_feature: Coding regions on vcDNA: vcDNA=SeqID_6801; Strand=+; Position=24-191
  misc_feature (20)..(29): Xaa can be any naturally occurring amino acid
MAAEFCPCSLTIIIIFFIAXXXXXXXXXXSLLFYSTFIKPIYISQVRKAVKFLLKP

SEQ ID NO: 27105 - protein, 174 aa, Diabrotica virgifera
  misc_feature: Coding regions on vcDNA: vcDNA=SeqID_6802; Strand=+; Position=49-573
  misc_feature (6)..(14): Xaa can be any naturally occurring amino acid
LVFTDXXXXXXXXXKMSHHFPPFYFWIVVAIIAFGGFIIFLRVVFACCKNGSNGTRRRLYGPSVTVTTTTQHAQSPQVVPPYPIDTRHPVPASNITGYGNQAPYQQYPFHPTGNVASPMAGATPYPPQPYQQAAHDYSANPPPYDVAVSQPPLQPPPNSKEGYVKKSPYNPGYN

SEQ ID NO: 27106 - protein, 36 aa, Diabrotica virgifera
  misc_feature: Coding regions on vcDNA: vcDNA=SeqID_6803; Strand=-; Position=1-108
INPHSSFNKKLMICSLARQNTAAFQIIRGRRDLYLY

SEQ ID NO: 27107 - protein, 58 aa, Diabrotica virgifera
  misc_feature: Coding regions on vcDNA: vcDNA=SeqID_6804; Strand=+; Position=100-276
IISYIFHIRTLTGNEDIKVRGHTITGNDSSPFLQATDRHSILRLAKESKKLPQFAAPS

SEQ ID NO: 27108 - protein, 239 aa, Diabrotica virgifera
  misc_feature: Coding regions on vcDNA: vcDNA=SeqID_6805; Strand=-; Position=43-762
  misc_feature (6)..(56): Xaa can be any naturally occurring amino acid
  misc_feature (60)..(67): Xaa can be any naturally occurring amino acid
  misc_feature (70)..(76): Xaa can be any naturally occurring amino acid
  misc_feature (89)..(95): Xaa can be any naturally occurring amino acid
  misc_feature (107)..(160): Xaa can be any naturally occurring amino acid
  misc_feature (164)..(194): Xaa can be any naturally occurring amino acid
  misc_feature (200)..(207): Xaa can be any naturally occurring amino acid
LSLPLXXXXXXXXXXXXXXXXXXXXXXXXXXXXXXXXXXXXXXXXXXXXXXXXXXXFYTXXXXXXXXEEXXXXXXXPPQIIILIPRGGXXXXXXXGPPKKNPGFPRXXXXXXXXXXXXXXXXXXXXXXXXXXXXXXXXXXXXXXXXXXXXXXXXXXXXXXFKGXXXXXXXXXXXXXXXXXXXXXXXXXXXXXXXTPSFPXXXXXXXXDYVPLARSKIPRPFQIIRGAGEAFILIQKAMF

SEQ ID NO: 27109 - protein, 174 aa, Diabrotica virgifera
  misc_feature: Coding regions on vcDNA: vcDNA=SeqID_6806; Strand=+; Position=76-650
  misc_feature: Homolog annotation: Hit_ID=NP_258414.1; Match level="QueryCoverage =100%, HitCoverage=36%, E-value=2e-51, Identity=57%"; Hit description= cytochrome c oxidase subunit I [Tribolium castaneum]
  misc_feature: Pfam annotation: Pfam_ID=COX1; Match level="Score=-248.2, E-value =0.0081, Copies=1"; Pfam description=Cytochrome C and Quinol oxidase polype
  misc_feature (10)..(10): Xaa can be any naturally occurring amino acid
  misc_feature (51)..(51): Xaa can be any naturally occurring amino acid
  misc_feature (72)..(72): Xaa can be any naturally occurring amino acid
  misc_feature (80)..(80): Xaa can be any naturally occurring amino acid
  misc_feature (106)..(106): Xaa can be any naturally occurring amino acid
  misc_feature (165)..(165): Xaa can be any naturally occurring amino acid
TSLPILVRAXFGRPGSLVGNDQIYNVIGTAHAFIIILFIGIPIIIGGFGTXLGPFLIGAPDIAFPRINNIRXHRVVGTGXTGYPPLPSNIAHGCPSGDLPIFRLHXTGISSILGAVSCITSAINIRPLRITCDRIPLFVRAVVNTAILLLVSLPSLAAAITYIIXDRNLITIIF

SEQ ID NO: 27110 - protein, 135 aa, Diabrotica virgifera
  misc_feature: Coding regions on vcDNA: vcDNA=SeqID_6807; Strand=+; Position=103-510
  misc_feature (16)..(23): Xaa can be any naturally occurring amino acid
  misc_feature (125)..(133): Xaa can be any naturally occurring amino acid
KKNLLFEPCVSRIIKXXXXXXXXSEFKISTKLIVFVGKQICHEVFLPCYVLRFFIYLIFSNINLVYSLSIYSYLNIFISLSLDIFGDELRNTILFQLNFSIIIRIKTVRILNYAIIYSYILSIFXXXXXXXXXMN

SEQ ID NO: 27111 - protein, 71 aa, Diabrotica virgifera
  misc_feature: Coding regions on vcDNA: vcDNA=SeqID_6808; Strand=+; Position=2-217
  misc_feature (2)..(29): Xaa can be any naturally occurring amino acid
  misc_feature (56)..(64): Xaa can be any naturally occurring amino acid
VXXXXXXXXXXXXXXXXXXXXXXXXXXXXIFKSNAYIFLKDDNTLYSFIKLLTTFXXXXXXXXXNLFNWRD

SEQ ID NO: 27112 - protein, 38 aa, Diabrotica virgifera
  misc_feature: Coding regions on vcDNA: vcDNA=SeqID_6809; Strand=-; Position=0-113
PHKCYEATSSTTVRQISSVISWISATTGRHCSSTVELR

SEQ ID NO: 27113 - protein, 80 aa, Diabrotica virgifera
  misc_feature: Coding regions on vcDNA: vcDNA=SeqID_6810; Strand=-; Position=419-661
  misc_feature (19)..(25): Xaa can be any naturally occurring amino acid
  misc_feature (33)..(43): Xaa can be any naturally occurring amino acid
SYFLVAFFAINYSKWKISXXXXXXXLIWTSKRXXXXXXXXXXXRMKKKRNHQNKKTAISRDICETSIRKRISWQRNKNEY

SEQ ID NO: 27114 - protein, 99 aa, Diabrotica virgifera
  misc_feature: Coding regions on vcDNA: vcDNA=SeqID_6811; Strand=+; Position=701-997
  misc_feature (14)..(23): Xaa can be any naturally occurring amino acid
  misc_feature (31)..(43): Xaa can be any naturally occurring amino acid
  misc_feature (65)..(70): Xaa can be any naturally occurring amino acid
  misc_feature (74)..(80): Xaa can be any naturally occurring amino acid
  misc_feature (83)..(89): Xaa can be any naturally occurring amino acid
  misc_feature (91)..(97): Xaa can be any naturally occurring amino acid
YKYIFQLFYSHNDXXXXXXXXXXFLACKKIXXXXXXXXXXXXXGNQNSSYKFPIELYGKRNLQVXXXXXXKSFXXXXXXXFFXXXXXXXLXXXXXXXHF

SEQ ID NO: 27115 - protein, 54 aa, Diabrotica virgifera
  misc_feature: Coding regions on vcDNA: vcDNA=SeqID_6812; Strand=-; Position=49-213
ARMPPTYRRELERDRKWTGKFDRPSNLICLYKLSRLNQYMGIYQNKYFPKIFGN

SEQ ID NO: 27116 - protein, 87 aa, Diabrotica virgifera
  misc_feature: Coding regions on vcDNA: vcDNA=SeqID_6813; Strand=+; Position=9-269
  misc_feature (19)..(26): Xaa can be any naturally occurring amino acid
  misc_feature (47)..(59): Xaa can be any naturally occurring amino acid
PLYKFKGGLFPGKRGAGNXXXXXXXXKKTFQKIDSRPRRKITPGKMXXXXXXXXXXXXXFSNFSPGPPLFPLFFGAIFPLPLFFVPP

SEQ ID NO: 27117 - protein, 100 aa, Diabrotica virgifera
  misc_feature: Coding regions on vcDNA: vcDNA=SeqID_6814; Strand=-; Position=2-301
  misc_feature (46)..(55): Xaa can be any naturally occurring amino acid
  misc_feature (59)..(70): Xaa can be any naturally occurring amino acid
  misc_feature (90)..(96): Xaa can be any naturally occurring amino acid
AHPPHTKRSFFLCGGGKITQTNFLEKKFMGGREFFFFRGVKGGKKXXXXXXXXXXFSLXXXXXXXXXXXXFSPREIHFMLTPLGPPRFLXXXXXXXVFGG

SEQ ID NO: 27118 - protein, 117 aa, Diabrotica virgifera
  misc_feature: Coding regions on vcDNA: vcDNA=SeqID_6815; Strand=+; Position=2-355
  misc_feature (5)..(14): Xaa can be any naturally occurring amino acid
  misc_feature (21)..(92): Xaa can be any naturally occurring amino acid
  misc_feature (94)..(102): Xaa can be any naturally occurring amino acid
PLTAXXXXXXXXXXPLSSFHXXXXXXXXXXXXXXXXXXXXXXXXXXXXXXXXXXXXXXXXXXXXXXXXXXXXXXXXXXXXXXXXXXXXXXXXAXXXXXXXXXHLRDNSVVLLESLNR

SEQ ID NO: 27119 - protein, 126 aa, Diabrotica virgifera
  misc_feature: Coding regions on vcDNA: vcDNA=SeqID_6816; Strand=+; Position=1-381
SFASASKVDIRNKRRNILVCKFEVSNVGTTSQKGFWNSSGIHNEIVISRPACIQQNGTLITRICKNGKWIPDIAKTVCPQVTGMRRTCPPKFQETPTSCLFIAPAQTWGYICNSKNFRPGTLIKLL

SEQ ID NO: 27120 - protein, 105 aa, Diabrotica virgifera
  misc_feature: Coding regions on vcDNA: vcDNA=SeqID_6817; Strand=+; Position=1-315
TPPTPSGYQRLHKFLTLPRLHSAELLIYAPRVLQAYLSLLFTHVCLPMARDQKPASICHGNFMALLPHWIPHSAKTRWSDPQPHSSYQNSPGQTTEYTHLSTLHK

SEQ ID NO: 27121 - protein, 49 aa, Diabrotica virgifera
  misc_feature: Coding regions on vcDNA: vcDNA=SeqID_6818; Strand=-; Position=279-428
  misc_feature (24)..(32): Xaa can be any naturally occurring amino acid
WYIINFLNNIIKNIIRDFEIVCTXXXXXXXXXLYLVFICRSTNIHIQFL

SEQ ID NO: 27122 - protein, 240 aa, Diabrotica virgifera
  misc_feature: Coding regions on vcDNA: vcDNA=SeqID_6819; Strand=-; Position=81-803
  misc_feature: Homolog annotation: Hit_ID=NP_504041.1; Match level="QueryCoverage =74%, HitCoverage=24%, E-value=7e-18, Identity=28%"; Hit description =acyltransferase 3 family (5E243) [Caenorhabditis elegans] gb|AAF59486.1| Hypothetical protein
  misc_feature (62)..(68): Xaa can be any naturally occurring amino acid
MYGMCSHLLTSGIYSFISTMQNNHGANYFEVNVGYFQGMYLPTKTRLPPYFIGIIFGYIVYXXXXXXXRRPVRYLAWVTVIGTMFGLILVHLVYTRATSYSPLRSALFNGGARQLWAIAQGCFIILCITDKNGLMNRVLSLPIFQRLVRLSYSFYLTHLIVIWYFVGTKRSAVFYTNIGTIHDFMGDAICTFVISIFWCLAFESPFVALGQLMKSRKGKPSHSSSDMDLILPLKKKKEIM

SEQ ID NO: 27123 - protein, 118 aa, Diabrotica virgifera
  misc_feature: Coding regions on vcDNA: vcDNA=SeqID_6820; Strand=-; Position=2-355
  misc_feature (3)..(25): Xaa can be any naturally occurring amino acid
  misc_feature (30)..(38): Xaa can be any naturally occurring amino acid
  misc_feature (44)..(52): Xaa can be any naturally occurring amino acid
  misc_feature (54)..(75): Xaa can be any naturally occurring amino acid
  misc_feature (78)..(84): Xaa can be any naturally occurring amino acid
  misc_feature (97)..(118): Xaa can be any naturally occurring amino acid
KKXXXXXXXXXXXXXXXXXXXXXXXGKKTXXXXXXXXXIGVFLXXXXXXXXXYXXXXXXXXXXXXXXXXXXXXXXIPXXXXXXXNDSCYLRHGQKYXXXXXXXXXXXXXXXXXXXXXX

SEQ ID NO: 27124 - protein, 56 aa, Diabrotica virgifera
  misc_feature: Coding regions on vcDNA: vcDNA=SeqID_6821; Strand=+; Position=192-362
  misc_feature (44)..(50): Xaa can be any naturally occurring amino acid
LVLDAYIPKMFICTMFRYEVYWLLYLTIDFITALRHILTLLCIXXXXXXXKCYFVS

SEQ ID NO: 27125 - protein, 93 aa, Diabrotica virgifera
  misc_feature: Coding regions on vcDNA: vcDNA=SeqID_6822; Strand=+; Position=250-531
  misc_feature: Homolog annotation: Hit_ID=NP_723401.1; Match level="QueryCoverage =49%, HitCoverage=39%, E-value=4e-11, Identity=67%"; Hit description =CG13094-PC, isoform C [Drosophila melanogaster] gb|AAN10672.1| CG13094-PC, isoform C [Drosophila
  misc_feature: Gene Ontology Annotation: Molecular function=diuretic hormone activity; Biological process=fluid secretion
MRTSGVSGNSAIALLFLITSSIILQSATISAQQQARYNDYPAISDDRDTSKRGLDLGLGRGFSGSQAAKHLMGLAAANFPGGPGRRRRNDDRI

SEQ ID NO: 27126 - protein, 61 aa, Diabrotica virgifera
  misc_feature: Coding regions on vcDNA: vcDNA=SeqID_6823; Strand=-; Position=1-183
  misc_feature (22)..(31): Xaa can be any naturally occurring amino acid
SWSIFLVRSNQPNRLFHGNFPXXXXXXXXXXGLVPVQILQAKQNREVQTPKHFLYFITRMK

SEQ ID NO: 27127 - protein, 166 aa, Diabrotica virgifera
  misc_feature: Coding regions on vcDNA: vcDNA=SeqID_6824; Strand=+; Position=195-695
  misc_feature: Homolog annotation: Hit_ID=XP_393297.1; Match level="QueryCoverage =67%, HitCoverage=94%, E-value=2e-31, Identity=56%"; Hit description =similar to myofibril-associated Zeelin1 protein [Apis mellifera]
MSFKEHLEMISLNESPSKKAKFWQAFVRSLKGSDDLRATDSVSSRRGIFRPISDIPENSSSWPYTKSIYDEPSAAAERIHVPGYRYDPVHRDIYGYSPRPIYPHNYGSLDRYRPAYHVTKPKPIDADEAWKHHIDRVKGREPSQWPSSIFPTSYPILSLSIVLKGQ

SEQ ID NO: 27128 - protein, 57 aa, Diabrotica virgifera
  misc_feature: Coding regions on vcDNA: vcDNA=SeqID_6825; Strand=+; Position=1-174
IYPFQSIMSEILALTRSLFLSDVILSSHICIAFYRRILMRYPLPSSLLTELYAKTLL

SEQ ID NO: 27129 - protein, 258 aa, Diabrotica virgifera
  misc_feature: Coding regions on vcDNA: vcDNA=SeqID_6826; Strand=+; Position=3-781
  misc_feature: Homolog annotation: Hit_ID=EAA13099.2; Match level="QueryCoverage =99%, HitCoverage=20%, E-value=5e-44, Identity=36%"; Hit description =ENSANGP00000021224 [Anopheles gambiae str. PEST] ref|XP_554697.1| ENSANGP00000021224 [Anopheles gambiae st
  misc_feature: Pfam annotation: Pfam_ID=rve; Match level="Score=90.0, E-value=6.2e -24, Copies=1"; Pfam description=Integrase core domain
  misc_feature (11)..(18): Xaa can be any naturally occurring amino acid
  misc_feature (150)..(150): Xaa can be any naturally occurring amino acid
  misc_feature (165)..(165): Xaa can be any naturally occurring amino acid
  misc_feature (182)..(189): Xaa can be any naturally occurring amino acid
FIDGFSNFTMXXXXXXXXDVISKFKEYLWFVESKFNSKVSKLRCDNGGEYVSNEYREFCKENGILLDYTGPYTPQQNGKAERMNRTLVERARCIMNASMVPKSFWEEAIRASCYVINRSPSESLDRDVTPAQIWNDKKPDVRNLKVFGSXVMLPDELRSKVDDKXENVMLGYAPTGYRLWNXXXXXXXXARDVRFNENEFYFKGLATLDEDREVRSKRDEDMDSVDNIAKQEMNRRNEIYQVSIYEEIRNEEQNTSQA

SEQ ID NO: 27130 - protein, 221 aa, Diabrotica virgifera
  misc_feature: Coding regions on vcDNA: vcDNA=SeqID_6827; Strand=+; Position=47-709
  misc_feature: Homolog annotation: Hit_ID=AAM28250.1; Match level="QueryCoverage =93%, HitCoverage=46%, E-value=3e-77, Identity=68%"; Hit description =phenylalanine hydroxylase [Aedes aegypti]
  misc_feature: Gene Ontology Annotation: Molecular function=phenylalanine 4 -monooxygenase activity; Cellular component=cellular_component unknown; Biological process=phenylalanine catabolism
  misc_feature: Pfam annotation: Pfam_ID=Biopterin_H; Match level="Score=-75.8, E -value=4.8e-11, Copies=1"; Pfam description=Biopterin-dependent aromatic amino ac
  misc_feature (168)..(168): Xaa can be any naturally occurring amino acid
  misc_feature (187)..(187): Xaa can be any naturally occurring amino acid
  misc_feature (189)..(189): Xaa can be any naturally occurring amino acid
MKYITSIDGIEVDAIIDPKLMPGGNYIRIGKDSAHSTCIVFAPPAEEVGVLAKFLSIFKKHEVNLLHIESRPSSKTPDNYEFMVECAPTGNLGAAIADMKDISDYFQIISRDYRDNKDTVPWFPRRIRDLDRFANQILSYGAELDADHPGFTDPVYRARRKYFADIAXHYKHGQKLPHVDYTKEETXTXGKVFRQLTTLYPTHACKRHNHVFPLLVENCGY

SEQ ID NO: 27131 - protein, 29 aa, Diabrotica virgifera
  misc_feature: Coding regions on vcDNA: vcDNA=SeqID_6828; Strand=-; Position=0-86
  misc_feature (2)..(24): Xaa can be any naturally occurring amino acid
SXXXXXXXXXXXXXXXXXXXXXXXYRVFR

SEQ ID NO: 27132 - protein, 290 aa, Diabrotica virgifera
  misc_feature: Coding regions on vcDNA: vcDNA=SeqID_6829; Strand=+; Position=39-909
  misc_feature: Homolog annotation: Hit_ID=CAF98199.1; Match level="QueryCoverage =86%, HitCoverage=43%, E-value=2e-77, Identity=57%"; Hit description =unnamed protein product [Tetraodon nigroviridis]
  misc_feature: Gene Ontology Annotation: Molecular function=cystathione beta -synthase activity; Cellular component=cytoplasm; Biological process =cysteine metabolism
  misc_feature: Pfam annotation: Pfam_ID=PALP; Match level="Score=174.0, E-value=3.2e- 49, Copies=1"; Pfam description=Pyridoxal-phosphate dependent enzyme
  misc_feature (255)..(255): Xaa can be any naturally occurring amino acid
MSKYVYRSPLNDAICAPEREQKCPWNPKVDRSTSIHTKVDWNAPKPKILPNALAAIGNTPLIKLNRIPQQEGLECDIYVKCEFFNPGGSVKDRMANRILTDAENEGILKPGCTIIEPSSGNTGIGLAMAAAIKGYRCIIVMSEKISKEKEYVMRALGAEVIRCPVTANSFSPYGMFGTVHRLSKEIPNSVIFDQFSNPGNPLTHYDTTAEEIYDQCDKQVDMIIMGAGTGGTVTGIGRKFKEISPTPKIVCGDPXWIILCFPKAINKTRWSLFWENRRNGLTISFPHFGT

SEQ ID NO: 27133 - protein, 57 aa, Diabrotica virgifera
  misc_feature: Coding regions on vcDNA: vcDNA=SeqID_6830; Strand=+; Position=1-171
  misc_feature: Homolog annotation: Hit_ID=AAA56741.1; Match level="QueryCoverage =98%, HitCoverage=29%, E-value=9e-09, Identity=62%"; Hit description =lacZ alpha peptide
  misc_feature (9)..(9): Xaa can be any naturally occurring amino acid
  misc_feature (24)..(24): Xaa can be any naturally occurring amino acid
RDAPGSGAXSAAGEARTRSATATXASALAPAPERDDPTAHATNAGQPRQERKRGRPI

SEQ ID NO: 27134 - protein, 173 aa, Diabrotica virgifera
  misc_feature: Coding regions on vcDNA: vcDNA=SeqID_6831; Strand=+; Position=207-727
  misc_feature: Homolog annotation: Hit_ID=NP_795936.1; Match level="QueryCoverage =82%, HitCoverage=58%, E-value=2e-17, Identity=35%"; Hit description =RIKEN cDNA 6330416L07 gene [Mus musculus] dbj|BAC27574.1| unnamed protein product [Mus musculus]
  misc_feature: Gene Ontology Annotation: Molecular function=transcription factor activity; Cellular component=nucleus; Biological process=biological _process unknown
  misc_feature: Pfam annotation: Pfam_ID=zf-C2H2; Match level="Score=75.3, E-value =1.6e-19, Copies=4"; Pfam description=Zinc finger, C2H2 type
  misc_feature (99)..(99): Xaa can be any naturally occurring amino acid
MDVKVKIEHEEVDLPDLIDPQSLSEEHSVPKHEIHTHTCSECLEDFNCEFLLKVHQMIHDKTQYCFICKHKIHNKFKEHVMDRHFNQCDVCFKTFNYKXNLVQHMEHHTGNLNYIKCDKRFRQRGSLISHMRSYHEGVKPYACKECDGTFTTSSSLDRHVKNVHNPNNPKHSI

SEQ ID NO: 27135 - protein, 112 aa, Diabrotica virgifera
  misc_feature: Coding regions on vcDNA: vcDNA=SeqID_6832; Strand=+; Position=199-534
  misc_feature (35)..(43): Xaa can be any naturally occurring amino acid
  misc_feature (79)..(95): Xaa can be any naturally occurring amino acid
RFLAPICWCPYHRCFYLNIHSSMLEVIFRETGVRXXXXXXXXXTSYHRCYLFLEDVCRARESCKFRHPRPSLKVAGRDXXXXXXXXXXXXXXXXXNRLFSQIVGILQISINT

SEQ ID NO: 27136 - protein, 87 aa, Diabrotica virgifera
  misc_feature: Coding regions on vcDNA: vcDNA=SeqID_6833; Strand=-; Position=5-268
  misc_feature (24)..(31): Xaa can be any naturally occurring amino acid
  misc_feature (73)..(82): Xaa can be any naturally occurring amino acid
PRKLGGGGGPRGIQMVVLIYYPFXXXXXXXXLDFFPSIITFFEDFLPLVILFPRIGARPLGDPHFFPGRNLTXXXXXXXXXXPFIRK

SEQ ID NO: 27137 - protein, 154 aa, Diabrotica virgifera
  misc_feature: Coding regions on vcDNA: vcDNA=SeqID_6834; Strand=+; Position=240-704
  misc_feature: Homolog annotation: Hit_ID=XP_391844.1; Match level="QueryCoverage =99%, HitCoverage=40%, E-value=1e-48, Identity=62%"; Hit description =similar to yes-associated protein 2 [Apis mellifera]
  misc_feature: Gene Ontology Annotation: Molecular function=transcription co -activator activity; Cellular component=nucleus; Biological process =regulation of transcription, DNA-dependent
  misc_feature (140)..(140): Xaa can be any naturally occurring amino acid
MALNQDEAKQVVRVDQDSETDLQALFDSVLKPDSKRPLQVPWSMRKLPDSFFNPPSTGSKSINHSRENSVDSAFGGGATGATSVNSVPLQTAHHRAHSSPASLQQTYAVGQQQAPVHHIKQRSYDVASKSEDNTPLPPGXEQARTPRGQVYYLK

SEQ ID NO: 27138 - protein, 134 aa, Diabrotica virgifera
  misc_feature: Coding regions on vcDNA: vcDNA=SeqID_6835; Strand=-; Position=3-404
  misc_feature: Homolog annotation: Hit_ID=NP_742747.1; Match level="QueryCoverage =98%, HitCoverage=20%, E-value=8e-42, Identity=62%"; Hit description =methyl-accepting chemotaxis transducer [Pseudomonas putida KT2440] gb|AAN66211.1|
  misc_feature: Pfam annotation: Pfam_ID=Cache; Match level="Score=27.0, E-value=5.7e- 05, Copies=1"; Pfam description=Cache domain
PSDVGYASSPDDSKLNTYDPRVRPWYQAAIAAPGKTVRTGAYYWAPDDVSLIGTVHTVADDTGKILGVVGLDVSLKQLTELVRNIKLGDSGYLMLVEANGNVLVDPSDAKHNFKPMADLGPDYAELAKRGDGVT

SEQ ID NO: 27139 - protein, 146 aa, Diabrotica virgifera
  misc_feature: Coding regions on vcDNA: vcDNA=SeqID_6836; Strand=+; Position=375-815
FICFYAKFLTSDYKDHLSHKLLTDLFDSHTMMSPLDPNSSSLLIMLGYQSKPSPFSASIQQHTSNYFSKTQARPLLTSTRSINSKTLSSLSLNNNLLRPKYLVYLVSQIILITIILVTYSLGLYIIKEVFLLDMICLSFHFSATLH

SEQ ID NO: 27140 - protein, 77 aa, Diabrotica virgifera
  misc_feature: Coding regions on vcDNA: vcDNA=SeqID_6837; Strand=+; Position=585-815
LIFSIMEKFSSKKTMNIINPDPKIHWKQYFFSGYHKKNLQRRGTMACGKINSTEMRMPQICMCYAQRTEWFPNVVIT

SEQ ID NO: 27141 - protein, 66 aa, Diabrotica virgifera; identical to SEQ ID NO: 26808
  misc_feature: Coding regions on vcDNA: vcDNA=SeqID_6838; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 27142 - protein, 19 aa, Diabrotica virgifera
  misc_feature: Coding regions on vcDNA: vcDNA=SeqID_6839; Strand=+; Position=1-57
DVWVVRFYIQKISNSCSSK

SEQ ID NO: 27143 - protein, 131 aa, Diabrotica virgifera
  misc_feature: Coding regions on vcDNA: vcDNA=SeqID_6840; Strand=+; Position=3-396
  misc_feature: Homolog annotation: Hit_ID=XP_392943.1; Match level="QueryCoverage =100%, HitCoverage=39%, E-value=1e-69, Identity=91%"; Hit description= similar to Ppp1ca-prov protein [Apis mellifera]
  misc_feature: Gene Ontology Annotation: Molecular function=protein phosphatase type 1 activity; Cellular component=nucleoplasm; Biological process=adult locomotory behavior
  misc_feature (116)..(116): Xaa can be any naturally occurring amino acid
IKLWKTFTDCFNCLPVAAIVDEKIFCCHGGLSPDLFSMEQIRRIMRPTDVPDQGLLCDLLWSDPDKDQMGWGENDRGVSFTFGAEVVGKFLHKHDFDLICQAHQVEEDGYEFFSRXQLTTLFSAPNYCEEF

SEQ ID NO: 27144 - protein, 66 aa, Diabrotica virgifera; identical to SEQ ID NO: 26808
  misc_feature: Coding regions on vcDNA: vcDNA=SeqID_6841; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 27145 - protein, 58 aa, Diabrotica virgifera
  misc_feature: Coding regions on vcDNA: vcDNA=SeqID_6842; Strand=-; Position=290-466
SANYRRSLRHYHLKGHVNRIVCTESVNCRFGQTDDETVDHVFCNFSGLDRIRLNAQYI

SEQ ID NO: 27146 - protein, 75 aa, Diabrotica virgifera
  misc_feature: Coding regions on vcDNA: vcDNA=SeqID_6843; Strand=+; Position=72-299
  misc_feature (38)..(38): Xaa can be any naturally occurring amino acid
  misc_feature (56)..(56): Xaa can be any naturally occurring amino acid
KAKNTSDEGDRTHNTECLSEKLQEMVGEDSTPKRLKGXKLNGTVNDKRENNNLANXEEKCPNDETFQPIAQTDSY

SEQ ID NO: 27147 - protein, 137 aa, Diabrotica virgifera
  misc_feature: Coding regions on vcDNA: vcDNA=SeqID_6844; Strand=+; Position=220-633
YMNKHHYYLVYTSWPVYISPLYEQHLKELYQQRMDQIEPMTYIKLKTPDPHHAVITDNCISYLHKHKTMLNDVNYWHQYMIRNVDHARPELHLTAILHHVFPFNLIPVTYWVKDDFVFFLGRNCELGYRQTMQCKFI

SEQ ID NO: 27148 - protein, 125 aa, Diabrotica virgifera
  misc_feature: Coding regions on vcDNA: vcDNA=SeqID_6845; Strand=+; Position=3-380
  misc_feature: Homolog annotation: Hit_ID=EAL27667.1; Match level="QueryCoverage =94%, HitCoverage=17%, E-value=2e-26, Identity=48%"; Hit description =GA20526-PA [Drosophila pseudoobscura]
IEQKVVTLEWMANPVNDMYADSLVAAILQADLLDVPLKSMNTSIKVDRMHFKECLIEMLQDMFGEDSVPKIFKGEKLYVTVNDKRADINLTNLEVKCPNDETFQQIVQTAVTKLYQCLAPPQVET

SEQ ID NO: 27149 - protein, 21 aa, Diabrotica virgifera
  misc_feature: Coding regions on vcDNA: vcDNA=SeqID_6846; Strand=-; Position=2-64
  misc_feature (13)..(21): Xaa can be any naturally occurring amino acid
LQLKFTLLIPKGXXXXXXXXX

SEQ ID NO: 27150 - protein, 188 aa, Diabrotica virgifera
  misc_feature: Coding regions on vcDNA: vcDNA=SeqID_6847; Strand=+; Position=3-569
  misc_feature: Homolog annotation: Hit_ID=XP_321144.1; Match level="QueryCoverage =100%, HitCoverage=37%, E-value=1e-76, Identity=69%"; Hit description= ENSANGP00000020140 [Anopheles gambiae]
  misc_feature: Gene Ontology Annotation: Molecular function=protein disulfide isomerase activity; Biological process=protein folding
DLDVGRTSSDIVTWALDKLEENIPAPEVTQILDDKSFKKLCEDKPLCVVAVLPHILDCQSECRNNYIKMLAGIGETFKKKMWGWVWSEAGTQLDLENSLDIGGFGYPAMAVINSKKMKYSILRGSFSKDGIYEFLRNLSYGKGNTAPVKGQQLPKINKIEPWDGKDGVLPEEEDIDLSDVDLDEKEEL

SEQ ID NO: 27151 - protein, 26 aa, Diabrotica virgifera
  misc_feature: Coding regions on vcDNA: vcDNA=SeqID_6848; Strand=-; Position=1-78
  misc_feature (4)..(26): Xaa can be any naturally occurring amino acid
KKIXXXXXXXXXXXXXXXXXXXXXXX

SEQ ID NO: 27152 - protein, 200 aa, Diabrotica virgifera
  misc_feature: Coding regions on vcDNA: vcDNA=SeqID_6849; Strand=-; Position=262-864
  misc_feature: Homolog annotation: Hit_ID=NP_127074.1; Match level="QueryCoverage =91%, HitCoverage=67%, E-value=5e-25, Identity=40%"; Hit description =hydrolase related [Pyrococcus abyssi GE5] emb|CAB50304.1| Beta ureidopropionase (beta-alanine
  misc_feature: Gene Ontology Annotation: Molecular function=molecular_function unknown; Cellular component=cellular_component unknown; Biological process=nitrogen metabolism
  misc_feature: Pfam annotation: Pfam_ID=CN_hydrolase; Match level="Score=-10.9, E -value=0.00051, Copies=1"; Pfam description=Carbon-nitrogen hydrolase
AQFLLQLWADKDATLIAGIAERDGDQIYNTAIVVSRGRWLGKQRKCHLSCIEKPLFTPGDSFACFDDGTCRFGVLTCFDLWMPEAARLLVRQGAQLLCCPANYGGPWTTQLARIRAMENATPLICANRTGVEMYAGSEATFRGESQIVGPMGEVWASATEETSLGLSIIDPAAYLLKANPMCDDLMEEASRYALSGPRSK

SEQ ID NO: 27153 - protein, 57 aa, Diabrotica virgifera
  misc_feature: Coding regions on vcDNA: vcDNA=SeqID_6850; Strand=+; Position=1-174
KLGLPPAGHRGPGIPLGPPLFLVPIDGIRHKSICMIRFIPSYTTGAISYSLPFMCDR

SEQ ID NO: 27154 - protein, 183 aa, Diabrotica virgifera
  misc_feature: Coding regions on vcDNA: vcDNA=SeqID_6851; Strand=+; Position=80-627
  misc_feature: Homolog annotation: Hit_ID=EAL39842.1; Match level="QueryCoverage =86%, HitCoverage=33%, E-value=5e-31, Identity=40%"; Hit description =ENSANGP00000027774 [Anopheles gambiae str. PEST] ref|XP_556131.1| ENSANGP00000027774 [Anopheles gambiae st
  misc_feature (126)..(126): Xaa can be any naturally occurring amino acid
MLSGFISQAVISPKIFYSNSPYMSRLQELSRSTETRKFYQKLNKSRKDFKPRKTMCRDKEGNILTEQQEILRRWTEHFTEKLEGDGSETNPDIPLDQADNREKSPPTIAEIRTAEDKLKNNKSPGXTKIWSNKQLPAEWNSGIIVPLHKKGNQLECGNYRGITLLNAAYKIMSNVIYERPHSE

SEQ ID NO: 27155 - protein, 286 aa, Diabrotica virgifera
  misc_feature: Coding regions on vcDNA: vcDNA=SeqID_6852; Strand=+; Position=42-902
  misc_feature: Homolog annotation: Hit_ID=XP_319666.1; Match level="QueryCoverage =100%, HitCoverage=87%, E-value=1e-107, Identity=67%"; Hit description=ENSANGP00000021376 [Anopheles gambiae]
  misc_feature: Gene Ontology Annotation: Molecular function=protein binding; Cellular component=cellular_component unknown; Biological process =biological_process unknown
  misc_feature: Pfam annotation: Pfam_ID=U-box; Match level="Score=91.8, E-value=1.8e- 24, Copies=1"; Pfam description=U-box domain
  misc_feature (150)..(156): Xaa can be any naturally occurring amino acid
  misc_feature (266)..(266): Xaa can be any naturally occurring amino acid
MSKHMYSTANLSDKELKEQGNRLFNLRKYEEAVNCYTKAIIKNPSVAHYFTNRALCYLKLLEWDQACMDCRRALDMDSNLVKAHFFLGQALLETDNYDEAIKHLQRANDLAREQKLNFGDDIASQLRAARKKRFSLQEEKRIAQEIELQXXXXXXXEKDRESRIQEIKAEEGDNESAREKIEHIQISCDNYINDLNHLFIKVDDRRRKREVPDYLCGKISFEILQEPVITPSGITYDKKDFREHLQRVGHFDPVTRSKLTQDQLYXICYERSVDAFFTDNEWALNY

SEQ ID NO: 27156 - protein, 249 aa, Diabrotica virgifera
  misc_feature: Coding regions on vcDNA: vcDNA=SeqID_6853; Strand=+; Position=177-923
  misc_feature: Homolog annotation: Hit_ID=CAF92441.1; Match level="QueryCoverage =95%, HitCoverage=28%, E-value=1e-81, Identity=58%"; Hit description =unnamed protein product [Tetraodon nigroviridis]
  misc_feature: Gene Ontology Annotation: Molecular function=molecular_function unknown; Cellular component=cellular_component unknown; Biological process=biological_process unknown
  misc_feature: Pfam annotation: Pfam_ID=DUF255; Match level="Score=179.7, E-value =6.4e-51, Copies=1"; Pfam description=Protein of unknown function, DUF255
MSTQAEAKKTNRLALEKSPYLLQHATNPVDWYPWGQEAFDKAKAENKLIFLSVGYSTCHWCHVMEKESFENESVAEIMNKHFVNIKVDREERPDVDRLYMAFIQATAGSGGWPMSVFLSPNLEPIAGGTYFPPEDMYGRPGFKSVLKDLAKQWNSNRSKMEAAGKKIIGILRKMEVKETEGGQNVPGEDAWKTCVLQLTRNYESDYGGFSTAPKFPQPTNFNFLFHMYSRNKQSEQGYACLEMCLHTLK

SEQ ID NO: 27157 - protein, 135 aa, Diabrotica virgifera
  misc_feature: Coding regions on vcDNA: vcDNA=SeqID_6854; Strand=+; Position=1-408
  misc_feature: Homolog annotation: Hit_ID=NP_885966.1; Match level="QueryCoverage =99%, HitCoverage=19%, E-value=2e-65, Identity=91%"; Hit description =elongation factor G [Bordetella parapertussis 12822] emb|CAE39097.1| elongation factor G
  misc_feature: Pfam annotation: Pfam_ID=EFG_C; Match level="Score=171.5, E-value =1.8e-48, Copies=1"; Pfam description=Elongation factor G C-terminus
VKVTLFFGSYHDVDSNENAFKMAGSMAFKEGMRRADPVLLEPMMQVEVETPEDFTGNVMGDLSSRRGMVQGMEDIAGGGGKVVRAEVPLAEMFGYSTSLRSLTQGRATYTMEFKHYAEAPRQVAQEVIAAQGSGR

SEQ ID NO: 27158 - protein, 195 aa, Diabrotica virgifera
  misc_feature: Coding regions on vcDNA: vcDNA=SeqID_6855; Strand=+; Position=3-590
  misc_feature: Homolog annotation: Hit_ID=CAI26066.1; Match level="QueryCoverage =87%, HitCoverage=71%, E-value=6e-71, Identity=71%"; Hit description =novel protein [Mus musculus] dbj|BAC38974.1| unnamed protein product [Mus musculus]
  misc_feature: Gene Ontology Annotation: Cellular component=membrane; Biological process=gametogenesis
  misc_feature: Pfam annotation: Pfam_ID=DER1; Match level="Score=178.4, E-value=1.5e- 50, Copies=1"; Pfam description=Der1-like family
  misc_feature (2)..(11): Xaa can be any naturally occurring amino acid
RXXXXXXXXXXFGFNFFFNMIFTYRYCRMLEEGSFRNRTADFVLMFLFGAACMIGFAFFVNLLFLGQAFTIMLVYVWSRRNPFVGLNFFGLLNFQAPYLPWILLAFSIILGNAVYVDLMGIAVGHIYYFLEDVFPNQRGGVKILKTPSFMRILFDALPEDADYQRLPEENPGGFQWGNQNDVQNQEDADNNAENR

SEQ ID NO: 27159 - protein, 155 aa, Diabrotica virgifera
  misc_feature: Coding regions on vcDNA: vcDNA=SeqID_6856; Strand=-; Position=310-777
  misc_feature (7)..(30): Xaa can be any naturally occurring amino acid
  misc_feature (56)..(91): Xaa can be any naturally occurring amino acid
  misc_feature (94)..(104): Xaa can be any naturally occurring amino acid
  misc_feature (112)..(119): Xaa can be any naturally occurring amino acid
KKKNLWXXXXXXXXXXXXXXXXXXXXXXXXAVYFILMIFFFPHSPFLLNFLFFLTXXXXXXXXXXXXXXXXXXXXXXXXXXXXXXXXXXXXQHXXXXXXXXXXXHKVHAINXXXXXXXXHFLQIIRHLLSELILSSYAWEHIRDLVLIFCKLQWL

SEQ ID NO: 27160 - protein, 23 aa, Diabrotica virgifera
  misc_feature: Coding regions on vcDNA: vcDNA=SeqID_6857; Strand=-; Position=1-69
  misc_feature (1)..(22): Xaa can be any naturally occurring amino acid
XXXXXXXXXXXXXXXXXXXXXXI

SEQ ID NO: 27161 - protein, 265 aa, Diabrotica virgifera
  misc_feature: Coding regions on vcDNA: vcDNA=SeqID_6858; Strand=+; Position=1-798
  misc_feature: Homolog annotation: Hit_ID=EAL24777.1; Match level="QueryCoverage =97%, HitCoverage=19%, E-value=6e-82, Identity=57%"; Hit description =GA14940-PA [Drosophila pseudoobscura]
  misc_feature: Gene Ontology Annotation: Molecular function=molecular_function unknown; Cellular component=nucleus; Biological process=biological _process unknown
  misc_feature: Pfam annotation: Pfam_ID=Bromodomain; Match level="Score=25.3, E -value=8.2e-06, Copies=1"; Pfam description=Bromodomain
  misc_feature (188)..(193): Xaa can be any naturally occurring amino acid
QQAGLYMNMDTVKDGNESQPVLVQKIAYCDTHAPADNGDSKKDDSRKKMIQARKMLAKKRTSAPVILIPTIPPERIQEIGSLVTIAKKSQFIQRLIAYWTLKRQFRNGVPLLRRLQSAQGGTPRDSNTSNVDTLELCRQLKYWQCLRQDLERARLLCELVRKREKIKLEYVKVSERVMRIKLKPLEAXXXXXXDSIHAKDTNEIFTEPVDLEEVPDYLTVVTDPMDLSTMRKKLDAGEYPDLCAMEKCLAYNNKDTVFFTELPLK

SEQ ID NO: 27162 - protein, 256 aa, Diabrotica virgifera
  misc_feature: Coding regions on vcDNA: vcDNA=SeqID_6859; Strand=+; Position=1-771
  misc_feature: Homolog annotation: Hit_ID=ZP_00323067.1; Match level="QueryCoverage =99%, HitCoverage=44%, E-value=2e-25, Identity=29%"; Hit description =COG4932: Predicted outer membrane protein [Pediococcus pentosaceus ATCC 25745]
  misc_feature: Gene Ontology Annotation: Molecular function=molecular_function unknown; Cellular component=cell wall (sensu Fungi); Biological process=biological_process unknown
PNSSQTTITEEFTEKTTTTYSINDEDITTEIKEDESMTTTSTTDGPTSTSTKHVTNASTETIGSESSVDISSSSVETEEDTVETTTKESMYSTNHEENTIETKEDETIISTSTTDNENIPNSSKSTITEEFTENITITETSYSTNNEDNTTETKEGESMASTSRTDGSTNTSTKHITSTSTETNGSERSVDISSSSIETDGNTVETTTTESTYSTNHNENTTETKEDKTIISTSTTDNENIPNSSKSTVTEEFTEI

SEQ ID NO: 27163 - protein, 90 aa, Diabrotica virgifera
  misc_feature: Coding regions on vcDNA: vcDNA=SeqID_6860; Strand=+; Position=2-274
PLKGPAQRTKKALMPLKEGPPTRRGEERPQEEKRRKKNRFFWKMHCGMMQQPQKNAWPDSSNFKHRIYDRFEQRRNNLKKTRRVGHVELP

SEQ ID NO: 27164 - protein, 61 aa, Diabrotica virgifera
  misc_feature: Coding regions on vcDNA: vcDNA=SeqID_6861; Strand=+; Position=3-188
HASAFAGENHILSNPSKLYGSIIFAALDKNAFILTSSLERSLKSVSLVALLPPTLRSTFRT

SEQ ID NO: 27165 - protein, 207 aa, Diabrotica virgifera
  misc_feature: Coding regions on vcDNA: vcDNA=SeqID_6862; Strand=+; Position=19-642
MNKLAVFTLLFAIGFQSSAGFRAGFRYNRDVQVMVPAGPVTLEAQPAVQTLEAKLPAVQTLEARPLSIQTLEAHLPEIQTLEARPEVQTLEARPAIATLEARPEVSTLELRPEVSTLELSPEVSTPEHKLTVNDKLAMIKQWVEEQARQSVVDLENKVLPAIQKLKADASHAIDTIKQKVKGQEAQAERTKRAMKQLNRQTRAIKKH

SEQ ID NO: 27166 - protein, 257 aa, Diabrotica virgifera
  misc_feature: Coding regions on vcDNA: vcDNA=SeqID_6863; Strand=+; Position=54-822
  misc_feature: Homolog annotation: Hit_ID=CAD31740.4; Match level="QueryCoverage =97%, HitCoverage=85%, E-value=1e-109, Identity=52%"; Hit description= chitinase [Tenebrio molitor]
  misc_feature: Gene Ontology Annotation: Molecular function=chitinase activity; Cellular component=extracellular space; Biological process=response to bacteria
  misc_feature: Pfam annotation: Pfam_ID=Glyco_hydro_18; Match level="Score=120.5, E -value=4.1e-33, Copies=1"; Pfam description=Glycosyl hydrolases family 18
  misc_feature (227)..(227): Xaa can be any naturally occurring amino acid
  misc_feature (232)..(232): Xaa can be any naturally occurring amino acid
GRVPHPNCNQYYLCNQGELQLQSCPSSLYWNVDHCDWPENTQCHPDGSTLAPVDEVTESSLEFPEEEEEPPVVDNGIDTPSGGTDLSEQGNKVICYFTNWAWYRQGDGKYLPSDIDPNLCTHINYGFAVLDPHSLTIKPHDSWADIDNEFYKKVVEYKSKGIKVLIAIGGWNDSLGDKYSRLVNNPQARARFVANVIEFIEKYGFDGLDLDWGYPKCWQVDCEKGPXSDKQXFAALVRGLSFSFRSKGLLLSSAVSP

SEQ ID NO: 27167 - protein, 152 aa, Diabrotica virgifera
  misc_feature: Coding regions on vcDNA: vcDNA=SeqID_6864; Strand=+; Position=39-499
  misc_feature: Homolog annotation: Hit_ID=EAL01803.1; Match level="QueryCoverage =92%, HitCoverage=71%, E-value=4e-11, Identity=31%"; Hit description =hypothetical protein CaO19.4331 [Candida albicans SC5314]
  misc_feature (48)..(48): Xaa can be any naturally occurring amino acid
  misc_feature (83)..(83): Xaa can be any naturally occurring amino acid
CLLVVSLSILFLVFLLVCLLLVSSLLSSLLVRFFLFFVCFQTSVFVLXNFYYIFSFSCIYYFMVHLSSLFSLFCLYWPCIFLXFFFQLFLAFFIFFHKAHYFHFICYYWSNCCFIYLSLFFCLDFCLVNFQYTRFPALILLLISALFQFCCH

SEQ ID NO: 27168 - protein, 64 aa, Diabrotica virgifera
  misc_feature: Coding regions on vcDNA: vcDNA=SeqID_6865; Strand=-; Position=1-192
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
FXXXXXXXXXXXNQPGSHRFKXXXXXXXXXEXXXXXXXXXXXXXXSNIEVAXXXXXXXXXXXXX

SEQ ID NO: 27169 - protein, 50 aa, Diabrotica virgifera
  misc_feature: Coding regions on vcDNA: vcDNA=SeqID_6866; Strand=+; Position=3-155
FTQHLFDEHFTGPAFLSWLPMGNMRGWGGPLCASWNERSILLQKKIVVTE

SEQ ID NO: 27170 - protein, 126 aa, Diabrotica virgifera
  misc_feature: Coding regions on vcDNA: vcDNA=SeqID_6867; Strand=+; Position=3-380
  misc_feature: Homolog annotation: Hit_ID=NP_524849.2; Match level="QueryCoverage =99%, HitCoverage=7%, E-value=7e-36, Identity=57%"; Hit description =CG32356-PA, isoform A [Drosophila melanogaster] gb|AAF50429.2| CG32356-PA, isoform A [Drosophila
  misc_feature: Pfam annotation: Pfam_ID=EB; Match level="Score=17.8, E-value =0.00034, Copies=1"; Pfam description=EB module
TLLGYDCLVPEQCSLKVANSSCLDGACRCVDGFLQFRKHTCLGPARPGNVCYSNEHCRLWTADSHCDFLIPNLFGRCSCNSPFTPEGDSCARTAFRLNPQGAYHRSYLHYYHENTTSTSTTSAIPT

SEQ ID NO: 27171 - protein, 64 aa, Diabrotica virgifera
  misc_feature: Coding regions on vcDNA: vcDNA=SeqID_6868; Strand=-; Position=1-192
WDIGGRLGLACAALRVQSEGFIAAEESLYVRCSKPMAVLLLAAAAVPAHADWYLDNESSRTVVR

SEQ ID NO: 27172 - protein, 96 aa, Diabrotica virgifera
  misc_feature: Coding regions on vcDNA: vcDNA=SeqID_6869; Strand=-; Position=6-296
  misc_feature (30)..(45): Xaa can be any naturally occurring amino acid
  misc_feature (48)..(61): Xaa can be any naturally occurring amino acid
  misc_feature (63)..(84): Xaa can be any naturally occurring amino acid
  misc_feature (88)..(94): Xaa can be any naturally occurring amino acid
SNTQQNIIVLLCCVVFRCNKKILVKLVYKXXXXXXXXXXXXXXXXLYXXXXXXXXXXXXXXLXXXXXXXXXXXXXXXXXXXXXXHKEXXXXXXXLP

SEQ ID NO: 27173 - protein, 69 aa, Diabrotica virgifera
  misc_feature: Coding regions on vcDNA: vcDNA=SeqID_6870; Strand=-; Position=97-306
IDITSINLIHLIITLVLYLADFSQCNAKPQKFGYGIFRFERNVLETYLQKNVFLYTECFIGKRKYPNDE

SEQ ID NO: 27174 - protein, 222 aa, Diabrotica virgifera
  misc_feature: Coding regions on vcDNA: vcDNA=SeqID_6871; Strand=+; Position=1-669
  misc_feature: Homolog annotation: Hit_ID=NP_651323.3; Match level="QueryCoverage =99%, HitCoverage=91%, E-value=6e-66, Identity=57%"; Hit description =CG11785-PA [Drosophila melanogaster] gb|AAF56382.2| CG11785-PA [Drosophila melanogaster]
  misc_feature: Gene Ontology Annotation: Molecular function=molecular_function unknown; Cellular component=integral to plasma membrane; Biological process=ER to Golgi transport
  misc_feature (36)..(36): Xaa can be any naturally occurring amino acid
VCTNCIMWNLLSNSRKCLREELQQNIPVVGEFDVSXAPGQTVNYVVTDSKGHILAKREAISKGKFSFNTESFDTYEICFISQVAPHIAGVTQEVSLITKHGIETKNYDTYGEAAQLKPIEKELKRLEDLSDAIVQDFAIMRKREEEMRDTNGALYMERRKLILLEITSCGVELVVLETSAHSESTNSRVLYFSIFSLCCLMGLATWQVLYLRTYFKAKKLIE

SEQ ID NO: 27175 - protein, 92 aa, Diabrotica virgifera
  misc_feature: Coding regions on vcDNA: vcDNA=SeqID_6872; Strand=+; Position=104-382
  misc_feature (25)..(31): Xaa can be any naturally occurring amino acid
  misc_feature (51)..(60): Xaa can be any naturally occurring amino acid
  misc_feature (72)..(91): Xaa can be any naturally occurring amino acid
FYRRVPIHNKDCDPRCWIKVYNCRXXXXXXXVPILNLNDLSLTVGARGVPXXXXXXXXXXGPFFNSFLFYLXXXXXXXXXXXXXXXXXXXXP

SEQ ID NO: 27176 - protein, 97 aa, Diabrotica virgifera
  misc_feature: Coding regions on vcDNA: vcDNA=SeqID_6873; Strand=+; Position=107-400
ETLLDECYICLDRESEGRDHDDRLDLLKPDDGRDDLTKDGSDNATNQMATRDAQWDVRCHDALCEVGVVVTWGRASNARRRPRASSSQNLPILTSRR

SEQ ID NO: 27177 - protein, 189 aa, Diabrotica virgifera
  misc_feature: Coding regions on vcDNA: vcDNA=SeqID_6874; Strand=+; Position=228-793
  misc_feature: Homolog annotation: Hit_ID=S52093; Match level="QueryCoverage=95%, HitCoverage=5%, E-value=1e-23, Identity=36%"; Hit description =hemocytin - silkworm
  misc_feature (149)..(149): Xaa can be any naturally occurring amino acid
MIRNNNVKTSYSKGGTKGGTKGGTKGGYQPVKQPPKKWNLQKPTYPTKGGNHDLEQLVEECIVYICVPDWHPGGGGGEICPDVQCSNGLILVFDEFVNDCQEFHCELPPKPDATCKVTGKTFDTFDNVEYKYDICNHVLARDLEHDEWXNILRKACTTTCSKELIIQHDWEQFVIHPDFSIENDGYTYP

SEQ ID NO: 27178 - protein, 62 aa, Diabrotica virgifera
  misc_feature: Coding regions on vcDNA: vcDNA=SeqID_6875; Strand=+; Position=160-348
GFWKLESLILRSLLLYLATLAHMATRSKVLPPCGRSTPEIPNRAHIHEPMTRNFTQKLGVGT

SEQ ID NO: 27179 - protein, 243 aa, Diabrotica virgifera
  misc_feature: Coding regions on vcDNA: vcDNA=SeqID_6876; Strand=+; Position=57-785
  misc_feature: Homolog annotation: Hit_ID=EAA44227.2; Match level="QueryCoverage =93%, HitCoverage=48%, E-value=8e-65, Identity=49%"; Hit description =ENSANGP00000025056 [Anopheles gambiae str. PEST] ref|XP_557097.1| ENSANGP00000025056 [Anopheles gambiae st
  misc_feature: Gene Ontology Annotation: Cellular component=endoplasmic reticulum; Biological process=aging
  misc_feature: Pfam annotation: Pfam_ID=Glyco_hydro_1; Match level="Score=15.8, E -value=7.8e-20, Copies=1"; Pfam description=Glycosyl hydrolase family 1
MCKVIYFLNGTFPANFLFGVATSSFQIEGAWNEDGKGESMWDEYNHRVPSPIRNGDTADIACDSYHKYKEDVKLVADLGADFYRFSISWPRILPTGYTDNINQKGIQYYQNLVKEILKYNMVPIATLYHWELPQTLVASNLDWVNPDIVDIFVNYTRVVIQNLPDVGLWITVNEPKQICHHGYGEGKFAPGRHNSGVDDYQCDYVVLKAHAKAYHMYKEEFPHYKALMSLTIDCEWYEPLTDS

SEQ ID NO: 27180 - protein, 98 aa, Diabrotica virgifera
  misc_feature: Coding regions on vcDNA: vcDNA=SeqID_6877; Strand=-; Position=458-754
  misc_feature (55)..(62): Xaa can be any naturally occurring amino acid
LENDKRYNNEKQKQSYQLEKPFHFCMVSFFVSLIIFELRGEKGRSLRKFKNALYXXXXXXXXVHFKPIQLTEHRNNTIVKVNCRRETMYSNSGEWGVK

SEQ ID NO: 27181 - protein, 22 aa, Diabrotica virgifera
  misc_feature: Coding regions on vcDNA: vcDNA=SeqID_6878; Strand=-; Position=1-66
FGLHDGAYKPRKIFSTIQRIAK

SEQ ID NO: 27182 - protein, 197 aa, Diabrotica virgifera
  misc_feature: Coding regions on vcDNA: vcDNA=SeqID_6879; Strand=+; Position=32-622
  misc_feature: Homolog annotation: Hit_ID=S78002; Match level="QueryCoverage=87%, HitCoverage=92%, E-value=4e-30, Identity=51%"; Hit description =cuticle structural protein PCP15.6, post-ecdysial - yellow mealworm
  misc_feature (44)..(50): Xaa can be any naturally occurring amino acid
MNSLVIVTIFSCLALANAGIIVQGPSAKSTVVGNDGSVISSVAXXXXXXXDEHPGVVAHSAPLVAAYSHPVVTAHAAPVVAAHSAHLVNAHAAPVVAAHSAHLVNPHSAAVVSVHSAPVVAAHVAPVVSAYSHSVVAAPLVAAHSAPVVAHGVVAHKEVDTVVAGPSGTITTSKLVASPVVVPAHGGCKLLKNKQLF

SEQ ID NO: 27183 - protein, 63 aa, Diabrotica virgifera
  misc_feature: Coding regions on vcDNA: vcDNA=SeqID_6880; Strand=-; Position=541-732
QPGNTKKLLRRTIAILWRNLIIVDNNKADFYDSSRKVILFAVVFYHPMRTSNLVAEQLINITF

SEQ ID NO: 27184 - protein, 251 aa, Diabrotica virgifera
  misc_feature: Coding regions on vcDNA: vcDNA=SeqID_6881; Strand=+; Position=3-758
  misc_feature: Homolog annotation: Hit_ID=XP_307960.1; Match level="QueryCoverage =99%, HitCoverage=19%, E-value=2e-67, Identity=52%"; Hit description =ENSANGP00000013501 [Anopheles gambiae] gb|EAA03817.1| ENSANGP00000013501 [Anopheles gambiae
  misc_feature: Gene Ontology Annotation: Molecular function=helicase activity; Cellular component=cellular_component unknown; Biological process =biological_process unknown
  misc_feature: Pfam annotation: Pfam_ID=DUF1605; Match level="Score=79.7, E-value =7.8e-21, Copies=1"; Pfam description=Domain of unknown function (DUF1605)
  misc_feature (117)..(129): Xaa can be any naturally occurring amino acid
FLQIYKKSSVAARHFAVENFLSYRTLTTIADIKKQFLELLVDIGFVPVNLSTRRRLGWDDVYEITGPEFNRNGENIRLLSSILCAALYPNVVKILTPSKSYIMSSAGAVPKENEAKXXXXXXXXXXXXXHPSSINYTVRNFPSPYLVYQEKIQTSKVFFRECTMVPVLPLILFSSYDLNINVQGGNTFIVLEDGWIVFQVDEHKIAEMIKFIRMELFNLLEEKIRDPLLNLLHHDRGEKIIATILGMINSH

SEQ ID NO: 27185 - protein, 238 aa, Diabrotica virgifera
  misc_feature: Coding regions on vcDNA: vcDNA=SeqID_6882; Strand=-; Position=54-768
  misc_feature: Homolog annotation: Hit_ID=AAA92124.2; Match level="QueryCoverage =90%, HitCoverage=25%, E-value=6e-29, Identity=30%"; Hit description =ORF1 [Drosophila virilis]
  misc_feature (34)..(34): Xaa can be any naturally occurring amino acid
MLKFGINYYMDYFRCVSLFTNLPLDAILNTIKKXWNSISPHPKISLDDFIRILTFIFDSNIFLFNGNFFKQIFGTPMGIKISPILCNFVLDELVTTCKEKILFHIPFIKRYVDDLILSVPENKVNDVLNTFNAQCEHLKFTVEREADMIPFLDMLIHRGNDGMLRTEWYRKPCFSNRFINFHSQYPSRMKTNLVLALKSRVINLSHIEFRDKGLKKLRSILLENSYPIGGSPFNNKFS

SEQ ID NO: 27186 - protein, 277 aa, Diabrotica virgifera
  misc_feature: Coding regions on vcDNA: vcDNA=SeqID_6883; Strand=+; Position=57-887
  misc_feature: Homolog annotation: Hit_ID=CAI42494.1; Match level="QueryCoverage =72%, HitCoverage=21%, E-value=8e-51, Identity=49%"; Hit description =OTTHUMP00000040480 [Homo sapiens] emb|CAI19669.1| OTTHUMP00000040480 [Homo sapiens] ref|NP_055660.1| Sac d
  misc_feature: Gene Ontology Annotation: Molecular function=polyphosphoinositide phosphatase activity; Cellular component=extrinsic to membrane; Biological process=cellular morphogenesis during conjugation with cellular fusion
  misc_feature: Pfam annotation: Pfam_ID=Syja_N; Match level="Score=-32.6, E-value =3.2e-09, Copies=1"; Pfam description=SacI homology domain
  misc_feature (103)..(109): Xaa can be any naturally occurring amino acid
MKQEASETTCKIETDSEGSDGPLDAFKIDIKEEPKRESIYQAYDCLESNVSSVNTKVEQDEYKFTPFEEKHTTNEEGFIKFLEGYYIILITKRRRVALIGHYXXXXXXXTTMVYIPHESVRVVHSDESRYVKMFQNIDLASNFYYSYSYDLTHTLQHNLTNPKRFVATSESDEKEFNLSEKSTDNLSSSIISNSSSSDNGETQNYGVRTQPHNKFVWNMHLLSDAVKAELHPDWVLYIIHGFIDQSNINVFGRSIYVTLIAKRACRYAGTRFLKRGA

SEQ ID NO: 27187 - protein, 205 aa, Diabrotica virgifera
  misc_feature: Coding regions on vcDNA: vcDNA=SeqID_6884; Strand=+; Position=1-813
  misc_feature: Homolog annotation: Hit_ID=AAF87759.1; Match level="QueryCoverage =100%, HitCoverage=63%, E-value=2e-79, Identity=63%"; Hit description= cytochrome oxidase subunit I [Diabrotica virgifera virgifera]
  misc_feature: Pfam annotation: Pfam_ID=COX1; Match level="Score=-31.5, E-value=3.7e- 10, Copies=1"; Pfam description=Cytochrome C and Quinol oxidase polyp
  misc_feature (9)..(9): Xaa can be any naturally occurring amino acid
  misc_feature (34)..(42): Xaa can be any naturally occurring amino acid
  misc_feature (69)..(69): Xaa can be any naturally occurring amino acid
  misc_feature (123)..(123): Xaa can be any naturally occurring amino acid
  misc_feature (158)..(158): Xaa can be any naturally occurring amino acid
VERGVGTGXTVYPPLSSNIAHGGPSVDLAIFRLXXXXXXXXXGAINFITTVINIRPIGITFDRIPLFVXAVVITAILLLLSLPVLAGAITILLTDRNLNTSFFDPAGIIYAIIAIGLLGFIVXAHHIFTVGMDVDTRAYFTSATIIIAVPTGIKVFRXLATYHGTTITYRLTGVVLANSSIDIVLHDTYYVVAIGAVFAIIAFIQ

SEQ ID NO: 27188 - protein, 305 aa, Diabrotica virgifera
  misc_feature: Coding regions on vcDNA: vcDNA=SeqID_6885; Strand=+; Position=1-915
  misc_feature: Homolog annotation: Hit_ID=XP_317113.1; Match level="QueryCoverage =93%, HitCoverage=56%, E-value=1e-135, Identity=82%"; Hit description= ENSANGP00000019665 [Anopheles gambiae]
  misc_feature: Gene Ontology Annotation: Biological process=proteolysis and peptidolysis
  misc_feature: Pfam annotation: Pfam_ID=Peptidase_M24; Match level="Score=281.8, E -value=1.2e-81, Copies=1"; Pfam description=metallopeptidase family M24
EIQEYGTDKDDRTAKDRFLSEEKRALDRMHNDIYNEVRLAAEAHRQTRQHIQKWIKPGMTMIEICEELENTARKLIAENGLKAGLAFPTGCSKNHCAAHYTPNAGDKTVFEYDDVVKIDFGTHINGRIIDCAFTHTFNPKYDKLVEAVRDATNTGIRAAGIDVQLCEIGAQIQEVMESYEVELDGKTYQVKSIRNLNGHSISPYRIHAGKTVPIVKGGEATVLEENEFYAIETFRSTGRGVVHDDMECSHYMKNFDVSYVALRLQSSKSPSKILNKNFRTLAFWKRGLDRAGTTKTNGLKGIWGQ

SEQ ID NO: 27189 - protein, 171 aa, Diabrotica virgifera
  misc_feature: Coding regions on vcDNA: vcDNA=SeqID_6886; Strand=+; Position=340-856
  misc_feature: Homolog annotation: Hit_ID=XP_306952.1; Match level="QueryCoverage =84%, HitCoverage=48%, E-value=4e-19, Identity=36%"; Hit description =ENSANGP00000024153 [Anopheles gambiae]
  misc_feature (145)..(145): Xaa can be any naturally occurring amino acid
LRHYRYLLGNNQKFRLQILHQYSKFASRPLYHIFNCSLQIPDYWKESFLKHIFKDGDKSLVDNYRPISIIGVIPKVFESLVCDFLNPLLEPKLINQQFGFRTHRSTELNLLTYVDFLFDSLEKGCQVDTIFTDFSIAFDRMSHGXKLRMIGVDEPMISWFSSRVGRFKPHA

SEQ ID NO: 27190 - protein, 80 aa, Diabrotica virgifera
  misc_feature: Coding regions on vcDNA: vcDNA=SeqID_6887; Strand=+; Position=150-389
RRGDLFIRFSYTLKPWRITFSEGGKRGIYFHIFGTVLWHTLHRSFYYRKEAHCRNIRSIPSSTREPEDPLIRLLDRTQGS

SEQ ID NO: 27191 - protein, 127 aa, Diabrotica virgifera; identical to SEQ ID NO: 23537
  misc_feature: Coding regions on vcDNA: vcDNA=SeqID_6888; Strand=+; Position=145-528
  misc_feature: Homolog annotation: Hit_ID=XP_309156.1; Match level="QueryCoverage =97%, HitCoverage=68%, E-value=3e-30, Identity=51%"; Hit description =ENSANGP00000018748 [Anopheles gambiae]

SEQ ID NO: 27192 - protein, 69 aa, Diabrotica virgifera
  misc_feature: Coding regions on vcDNA: vcDNA=SeqID_6889; Strand=+; Position=109-315
  misc_feature (22)..(35): Xaa can be any naturally occurring amino acid
  misc_feature (39)..(69): Xaa can be any naturally occurring amino acid
LSSVQLLKFNMVWRLKPGWSKXXXXXXXXXXXXXXKGPXXXXXXXXXXXXXXXXXXXXXXXXXXXXXXX

SEQ ID NO: 27193 - protein, 92 aa, Diabrotica virgifera
  misc_feature: Coding regions on vcDNA: vcDNA=SeqID_6890; Strand=+; Position=487-765
DQVHVFYLCLICETLFFANHLSYLQKLLLRRHIYIMFPRPGASFDRAPPPAALKLLRFTKNTSIFIITSYIMYCIYNACPPPSIKFQMTFLS

SEQ ID NO: 27194 - protein, 81 aa, Diabrotica virgifera
  misc_feature: Coding regions on vcDNA: vcDNA=SeqID_6891; Strand=+; Position=761-1006
  misc_feature (69)..(81): Xaa can be any naturally occurring amino acid
HPILRDLIYLLLLIYSNPKIRFSEVELLGKKLFPKMGFSPGNHPRIKRGKASEKTQTRARRLPGMTQYXXXXXXXXXXXXX

SEQ ID NO: 27195 - protein, 133 aa, Diabrotica virgifera
  misc_feature: Coding regions on vcDNA: vcDNA=SeqID_6892; Strand=-; Position=145-546
  misc_feature: Homolog annotation: Hit_ID=XP_313284.1; Match level="QueryCoverage =98%, HitCoverage=26%, E-value=1e-31, Identity=55%"; Hit description =ENSANGP00000010498 [Anopheles gambiae] gb|EAA08857.1| ENSANGP00000010498 [Anopheles gambiae
  misc_feature: Gene Ontology Annotation: Molecular function=translation factor activity, nucleic acid binding; Cellular component=cytoplasm; Biological process=translational elongation
  misc_feature: Pfam annotation: Pfam_ID=GTP_EFTU_D3; Match level="Score=68.3, E -value=2e-17, Copies=1"; Pfam description=Elongation factor Tu C -terminal domai
  misc_feature (22)..(22): Xaa can be any naturally occurring amino acid
  misc_feature (37)..(37): Xaa can be any naturally occurring amino acid
  misc_feature (116)..(116): Xaa can be any naturally occurring amino acid
IYPTRGASYFDVQVMVLSHSGXISSGYTPVFDSLSAXHLPTNSGKLKEKVVRGYGTIIEENAEALNCGDGAVVDFVPAHPMCVEPFHEFPPLVRFAVRTCRLFFAVGVINSVSFKXPSTVKVTKAAEKAQKKK

SEQ ID NO: 27196 - protein, 230 aa, Diabrotica virgifera
  misc_feature: Coding regions on vcDNA: vcDNA=SeqID_6893; Strand=+; Position=30-722
NQVFVYLRIVVKLQVLQLYVNGQMVESVEPSVWQQWLIAQKQKYNIDISVIENWINQQHQQMKLDVGYLEGWIMQQQNANANFLVNWIIKRQVPSFSYQWKMVRMVSQPQNSGTFHVWINNRSVEKVSPEVWKQWVSEQQRNGMDMSLVERNINQWHESLKVDLAYLEAWVMQEQQADSKFLYIWTVERKIPAISYKWKMESQRVQPVITSSSLHTYTWKVQKQTQQVGN

SEQ ID NO: 27197 - protein, 86 aa, Diabrotica virgifera
  misc_feature: Coding regions on vcDNA: vcDNA=SeqID_6894; Strand=+; Position=2-262
  misc_feature (22)..(30): Xaa can be any naturally occurring amino acid
RKRDLRFFVGDRVLKRNFVKSXXXXXXXXXFCQKYVPCTVSRVISPLIYELKDNSTNKRIGQFHVKDLLPDNTMDDVDSSTSSEED

SEQ ID NO: 27198 - protein, 24 aa, Diabrotica virgifera
  misc_feature: Coding regions on vcDNA: vcDNA=SeqID_6895; Strand=-; Position=0-71
WGGENLKGFFPFWEIMLRVNPFVP

SEQ ID NO: 27199 - protein, 87 aa, Diabrotica virgifera
  misc_feature: Coding regions on vcDNA: vcDNA=SeqID_6896; Strand=+; Position=42-305
  misc_feature (71)..(81): Xaa can be any naturally occurring amino acid
CSLVFGFFSRISKILSLRSNSSDQQVATNAVQDFGRNFEYFVEIFIRNIVKNGDTEPNLRNMLVCGNYSIXXXXXXXXXXXKYTFFK

SEQ ID NO: 27200 - protein, 112 aa, Diabrotica virgifera
  misc_feature: Coding regions on vcDNA: vcDNA=SeqID_6897; Strand=-; Position=348-686
KADIPKKIFFRRKFHLVVQNRELILFLVRGTPSTRKQEMILKKTIVKRTVPSLLIMPTGMIRHDLNFISSSYWKLRNNIGNWNSLFCYCILSNQLLSDLAKKKISSGFFTLR

SEQ ID NO: 27201 - protein, 63 aa, Diabrotica virgifera
  misc_feature: Coding regions on vcDNA: vcDNA=SeqID_6898; Strand=-; Position=132-323
  misc_feature (30)..(42): Xaa can be any naturally occurring amino acid
ALPASQDRSEDTQLENVFIKKWVEYVYLVXXXXXXXXXXXXXVGQISQSTPRPVNSIINWLPS

SEQ ID NO: 27202 - protein, 65 aa, Diabrotica virgifera
  misc_feature: Coding regions on vcDNA: vcDNA=SeqID_6899; Strand=+; Position=598-795
HYYFLNTTNTPIVRDKSAITPLKNQEQTEFLLRISSFGDPQKSWFQIIMVLFVNYPLVLGLIAWN

SEQ ID NO: 27203 - protein, 68 aa, Diabrotica virgifera
  misc_feature: Coding regions on vcDNA: vcDNA=SeqID_6900; Strand=+; Position=140-346
YLSCSVAFCHVTCKGSCAHIDRGCTEQKDIFQFVGNDYWFVNPLKTKRACPLQVKLPRVLHLPRVSVM

SEQ ID NO: 27204 - protein, 311 aa, Diabrotica virgifera
  misc_feature: Coding regions on vcDNA: vcDNA=SeqID_6901; Strand=+; Position=2-936
  misc_feature: Homolog annotation: Hit_ID=XP_394824.1; Match level="QueryCoverage =99%, HitCoverage=40%, E-value=3e-64, Identity=39%"; Hit description =similar to CG1560-PA [Apis mellifera]
  misc_feature: Gene Ontology Annotation: Molecular function=ATP binding; Cellular component=integrin complex; Biological process=muscle development
  misc_feature: Pfam annotation: Pfam_ID=Integrin_B_tail; Match level="Score=27.7, E -value=1.3e-06, Copies=1"; Pfam description=Integrin beta tail domain
  misc_feature (175)..(179): Xaa can be any naturally occurring amino acid
  misc_feature (284)..(284): Xaa can be any naturally occurring amino acid
  misc_feature (301)..(301): Xaa can be any naturally occurring amino acid
GTGALTCGVCDCPPGKSGKFCECDLLTQSKVENVTKCMKEGSNEVCSGAGICKCEQCVCNIIPKSNDQKYTGKYCECDNLSCKREKGLLCSNRGNCNCNKCDCFPGYMGDACECETAVTNCRRSSSDDICSNNGKCVCNRCQCAIKDNKRYSGKYCEDCPSCEAKRCNELRACVXXXXXKTGSLNATCATSCTEFQTQIVHKLESEGLEDVKKCRVPFNESCFIHFDYYYVEDKLVVKALDREVCTGPVDPLPWILGGIATILIAGIIMLLIWKIVTSIPDKRXYAKFQNERQKLKWGNNXNHLYKNATSP

SEQ ID NO: 27205 - protein, 279 aa, Diabrotica virgifera
  misc_feature: Coding regions on vcDNA: vcDNA=SeqID_6902; Strand=+; Position=36-876
  misc_feature: Homolog annotation: Hit_ID=AAH83021.1; Match level="QueryCoverage =64%, HitCoverage=40%, E-value=1e-42, Identity=45%"; Hit description =Unknown (protein for MGC:98936) [Xenopus laevis]
  misc_feature: Gene Ontology Annotation: Molecular function=molecular_function unknown; Cellular component=microfibril; Biological process=cell adhesion
  misc_feature: Pfam annotation: Pfam_ID=Fibrinogen_C; Match level="Score=171.3, E -value=2.1e-48, Copies=1"; Pfam description=Fibrinogen beta and gamma chains, C-t
  misc_feature (229)..(229): Xaa can be any naturally occurring amino acid
KLLDVKVESKADSWKNDFSRFFQPQSDEISLGRKDEHNVQIPLKLSLGVEQSGVNEDYSQLVGRSKTPICHLNPLPEYSDKYNAYPGSCREILDNVSNKTGIYTIKPRTSKKPFSVLCDMETKGGGWTYIQKRFDGSQEFYLGYKDYKFGFGDLNGEFWIGLENIHHMTGSEINELLIELTDRDKKTAYAQFKTFGIGPEKDGYILNVLTGYSGDAGDALSPHLNSKFXTFDVDQDENPGNCAVIHEGAWWYKSCHYSNLNEKHFNVNLSATYNYHGVN

SEQ ID NO: 27206 - protein, 61 aa, Diabrotica virgifera
  misc_feature: Coding regions on vcDNA: vcDNA=SeqID_6903; Strand=-; Position=82-267
  misc_feature (9)..(15): Xaa can be any naturally occurring amino acid
  misc_feature (52)..(59): Xaa can be any naturally occurring amino acid
QGMLKIFRXXXXXXXFYSQKLNERFLKTIPIYSYILQSRDDYLNTEIITEQXXXXXXXXPM

SEQ ID NO: 27207 - protein, 26 aa, Diabrotica virgifera
  misc_feature: Coding regions on vcDNA: vcDNA=SeqID_6904; Strand=-; Position=0-77
  misc_feature (8)..(21): Xaa can be any naturally occurring amino acid
FNPPSRSXXXXXXXXXXXXXXVILKV

SEQ ID NO: 27208 - protein, 232 aa, Diabrotica virgifera
  misc_feature: Coding regions on vcDNA: vcDNA=SeqID_6905; Strand=+; Position=3-701
  misc_feature: Homolog annotation: Hit_ID=XP_393278.1; Match level="QueryCoverage =100%, HitCoverage=80%, E-value=2e-84, Identity=67%"; Hit description= similar to CG6972-PA [Apis mellifera]
  misc_feature (201)..(209): Xaa can be any naturally occurring amino acid
EELQQYMIGDEGSWALSDGFLDFVGRLLNDPQLSVDVRVKTVNVLAMAALKDDVILVLHQDRKDHVLMNYAFEIDRLSMPEQEAIAVFMANMFENLSSSEWLLYISEWSYNNQQTSNIRVTTKVAVHSLLSDSPVLQDRGSAIIHNLACKEVKTVVFDDVAVELTMALLQYFNSKPPEEQLFRCLKALAKFVQVSTQEVPXXXXXXXXXPRSFKGTSERIDILVDQIAAKLR

SEQ ID NO: 27209 - protein, 255 aa, Diabrotica virgifera
  misc_feature: Coding regions on vcDNA: vcDNA=SeqID_6906; Strand=+; Position=2-766
  misc_feature: Homolog annotation: Hit_ID=EAA00822.2; Match level="QueryCoverage =92%, HitCoverage=23%, E-value=4e-45, Identity=44%"; Hit description =ENSANGP00000008527 [Anopheles gambiae str. PEST] ref|XP_551110.1| ENSANGP00000008527 [Anopheles gambiae st
  misc_feature (241)..(241): Xaa can be any naturally occurring amino acid
FEGSSSALSLSSTLKQVQKSKVFVCPPHPNNILVLFIPFMCFLDELDQSISIKKQGNPNLYTFLTEYVSNVYLKRKSDEILDQIETCIRKSDAWKATILLDLTSDYKPLLVSTVTVERCIREWKAVLKALPLYSEMVAGYSSKALKEYKETCDMAYRRIVQPQSEDSRKICSAAWLKDDDISRFLKSLPNWLNLKAQQEYRARGERNKKLLKREHPSEEESPEDVRMRNRREAEMLASNLXEGGVSAGEFLSDMN

SEQ ID NO: 27210 - protein, 164 aa, Diabrotica virgifera
  misc_feature: Coding regions on vcDNA: vcDNA=SeqID_6907; Strand=+; Position=3-494
  misc_feature: Homolog annotation: Hit_ID=NP_446404.1; Match level="QueryCoverage =71%, HitCoverage=8%, E-value=3e-22, Identity=46%"; Hit description =nucleoporin 155 [Rattus norvegicus] emb|CAA79848.1| nup155 [Rattus norvegicus]
  misc_feature: Gene Ontology Annotation: Molecular function=transporter activity; Cellular component=nuclear pore
VVNLDGPALAISEVRHPTPLPLPPNQEAPPLVVRQHAEPPKKYVVLTSHSVQIFIKLRPVDILNQILRDSQGLDTEALKTFFTIQKEDQACATCLILASLESDENVEVAEYATRAFFLYGGEPKLVPANIYAGPSVFAPQIISTPAPHNYQTQQYQTAQHFQPN

SEQ ID NO: 27211 - protein, 21 aa, Diabrotica virgifera
  misc_feature: Coding regions on vcDNA: vcDNA=SeqID_6908; Strand=-; Position=0-62
VYCTPVFDYSQFSCNFSIKLL

SEQ ID NO: 27212 - protein, 206 aa, Diabrotica virgifera
  misc_feature: Coding regions on vcDNA: vcDNA=SeqID_6909; Strand=+; Position=3-623
  misc_feature: Homolog annotation: Hit_ID=EAA05165.2; Match level="QueryCoverage =96%, HitCoverage=21%, E-value=3e-62, Identity=55%"; Hit description =ENSANGP00000008246 [Anopheles gambiae str. PEST] ref|XP_564209.1| ENSANGP00000008246 [Anopheles gambiae st
  misc_feature: Gene Ontology Annotation: Molecular function=ATP binding; Cellular component=mitochondrion
  misc_feature (113)..(120): Xaa can be any naturally occurring amino acid
FNTAVDIKLRLWADTALPTQSVQSGWETLRTEFERFLQKAAEAPDHDDIFDLLKQAVVNEAMVRHVWESKASEMLRVIQLNTLEDRTIGDKRDWDQAVKFLESSVKEKLRESXXXXXXXXGPSAKERWLYWKYQSELESKSRSVKNELDKILYANEKHPPGLSYDELTTIRNNLQRSSIEVDNEFIREVLELVYNRRHFSYMLLLN

SEQ ID NO: 27213 - protein, 302 aa, Diabrotica virgifera
  misc_feature: Coding regions on vcDNA: vcDNA=SeqID_6910; Strand=-; Position=0-905
  misc_feature (1)..(269): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSVVSHICYLRGKRFSVISEQKRNSRSQSPAGTV

SEQ ID NO: 27214 - protein, 283 aa, Diabrotica virgifera
  misc_feature: Coding regions on vcDNA: vcDNA=SeqID_6911; Strand=+; Position=7-858
  misc_feature: Homolog annotation: Hit_ID=XP_318646.1; Match level="QueryCoverage =67%, HitCoverage=40%, E-value=3e-31, Identity=37%"; Hit description =ENSANGP00000004604 [Anopheles gambiae]
  misc_feature: Gene Ontology Annotation: Molecular function=GABA-A receptor activity; Cellular component=integral to membrane; Biological process=synaptic transmission
  misc_feature: Pfam annotation: Pfam_ID=Neur_chan_LBD; Match level="Score=42.5, E -value=6e-12, Copies=1"; Pfam description=Neurotransmitter-gated ion -channel li
  misc_feature (116)..(124): Xaa can be any naturally occurring amino acid
MKNVRLVVFCVFLGSLVKCEISNTKFLTTSTRSSVMSIPKPESNIPRTIKDQNKTLDVSTSTKGPIIRQNEVTTPESTTPTETTNTEPVVDLECPELSTIPNLNKYTQEELILLLXXXXXXXXXIKPPGEQIEVFFRMDITHIESADHLQLKAHILVQMRYKDIRLSYAALSPNKRFIRGEEDLKDRIWAPHLILSNEKESSLMGLSDKDIFIQINPDGEVVYGYRLSTLFYCWMDLKKFPFGSQTCDLTWVSWAYNATDLAIEWENDFSFTIGKNLHFDELL

SEQ ID NO: 27215 - protein, 70 aa, Diabrotica virgifera
  misc_feature: Coding regions on vcDNA: vcDNA=SeqID_6912; Strand=+; Position=3-215
  misc_feature (1)..(31): Xaa can be any naturally occurring amino acid
XXXXXXXXXXXXXXXXXXXXXXXXXXXXXXXNSVIFMGEVKSNNKDWDLDGGLKVIIWWSSYINKAWSTF

SEQ ID NO: 27216 - protein, 100 aa, Diabrotica virgifera
  misc_feature: Coding regions on vcDNA: vcDNA=SeqID_6913; Strand=-; Position=248-550
NNYRMGSLSWFVSLKIIFYIGEHWEKQFATLRSYFCINRLFALHIANLYSRWHAHKIIFLSKKKMRSWMGKPLHGRHPNEISQEYDNTVQLLAYIRNDVL

SEQ ID NO: 27217 - protein, 67 aa, Diabrotica virgifera
  misc_feature: Coding regions on vcDNA: vcDNA=SeqID_6914; Strand=-; Position=2-202
  misc_feature (3)..(13): Xaa can be any naturally occurring amino acid
  misc_feature (23)..(31): Xaa can be any naturally occurring amino acid
  misc_feature (34)..(41): Xaa can be any naturally occurring amino acid
  misc_feature (53)..(66): Xaa can be any naturally occurring amino acid
VLXXXXXXXXXXXTNLAHPGFKXXXXXXXXXRTXXXXXXXXQIINFNPTSRSXXXXXXXXXXXXXXV

SEQ ID NO: 27218 - protein, 39 aa, Diabrotica virgifera
  misc_feature: Coding regions on vcDNA: vcDNA=SeqID_6915; Strand=-; Position=0-116
GGKPFKGIFPGVGKSNLEFNHLWAPPNYSLAIFFPFPKV

SEQ ID NO: 27219 - protein, 68 aa, Diabrotica virgifera
  misc_feature: Coding regions on vcDNA: vcDNA=SeqID_6916; Strand=+; Position=223-429
  misc_feature (42)..(48): Xaa can be any naturally occurring amino acid
  misc_feature (51)..(56): Xaa can be any naturally occurring amino acid
ILDTSICLPEYSYIDQYLEINLKRLTLEVMKLILSLLTKLLXXXXXXXSIXXXXXXSILRKMAKKKLF

SEQ ID NO: 27220 - protein, 64 aa, Diabrotica virgifera
  misc_feature: Coding regions on vcDNA: vcDNA=SeqID_6917; Strand=+; Position=21-212
  misc_feature (25)..(31): Xaa can be any naturally occurring amino acid
  misc_feature (33)..(41): Xaa can be any naturally occurring amino acid
  misc_feature (52)..(62): Xaa can be any naturally occurring amino acid
FYWKVQIHNKNCDLHGGLKFIIGGXXXXXXXVXXXXXXXXXFKPVGGKVGSXXXXXXXXXXXGP

SEQ ID NO: 27221 - protein, 115 aa, Diabrotica virgifera
  misc_feature: Coding regions on vcDNA: vcDNA=SeqID_6918; Strand=+; Position=280-627
  misc_feature (73)..(89): Xaa can be any naturally occurring amino acid
IPTSSLVTVDSCGMAMCIVMHYKVISKVSPMNGANGMTCSWRTSSTYLLQAFTLSLSNTARSVRASLEIPSQXXXXXXXXXXXXXXXXXFNACRHEDVHLDLLGLFCSRLRTLCS

SEQ ID NO: 27222 - protein, 132 aa, Diabrotica virgifera
  misc_feature: Coding regions on vcDNA: vcDNA=SeqID_6919; Strand=+; Position=56-454
GCICVWCSCCWGVGGAAVAPVHHIIPSSLLETYHGLDQSVLQAPISNSIPINGMVLRIGISQLSKSMTTKISRLSLTIPHTGPVLESHATTKQPLKNFSLPSTTQGTHHITMIKRQWTGRIRAPKIPTCLTP

SEQ ID NO: 27223 - protein, 216 aa, Diabrotica virgifera
  misc_feature: Coding regions on vcDNA: vcDNA=SeqID_6920; Strand=+; Position=3-650
  misc_feature: Homolog annotation: Hit_ID=NP_732404.1; Match level="QueryCoverage =89%, HitCoverage=46%, E-value=2e-44, Identity=45%"; Hit description =CG5558-PB, isoform B [Drosophila melanogaster] gb|AAF55643.2| CG5558- PB, isoform B [Drosophila
  misc_feature: Gene Ontology Annotation: Molecular function=molecular_function unknown; Cellular component=nucleus; Biological process=biological _process unknown
PGMKTTHLAAVLNNQGTVYATERNPRRFEVLNNIVDASGATCIKTFNKDVLDCTKADFPDVEYILVDPSCSGTGMTDRAQENEITPSRLASLTGFQVKILRHALTKFPSAKRVVYSTCSIMAEENEDVVRQVLETNYNFKLISASQFVSETWHNFGSSDYGNIRKFCLYAKPDSDYTNGFFVTIFERVQEAVKNPFFNTRIFNFKKHVQENEKWEL

SEQ ID NO: 27224 - protein, 86 aa, Diabrotica virgifera
  misc_feature: Coding regions on vcDNA: vcDNA=SeqID_6921; Strand=+; Position=205-462
  misc_feature (43)..(51): Xaa can be any naturally occurring amino acid
  misc_feature (63)..(74): Xaa can be any naturally occurring amino acid
NKNEYEQSRGTTYKWRRDRPDPHLVFHGTSNNKQGDILTDIFXXXXXXXXXTKYYRLVKRSPXXXXXXXXXXXXYDIFIRMGKLNT

SEQ ID NO: 27225 - protein, 71 aa, Diabrotica virgifera
  misc_feature: Coding regions on vcDNA: vcDNA=SeqID_6922; Strand=-; Position=336-551
LKNEGKMTGKGCHEDVRQRLAKRSKGDSGVPQAFVKGDTEHSENMNNRRLRECAINARCIHVLSLYYMKMS

SEQ ID NO: 27226 - protein, 96 aa, Diabrotica virgifera
  misc_feature: Coding regions on vcDNA: vcDNA=SeqID_6923; Strand=-; Position=1-288
  misc_feature (8)..(14): Xaa can be any naturally occurring amino acid
  misc_feature (28)..(96): Xaa can be any naturally occurring amino acid
PLIHHWRXXXXXXXLTSPIKITLLSPKXXXXXXXXXXXXXXXXXXXXXXXXXXXXXXXXXXXXXXXXXXXXXXXXXXXXXXXXXXXXXXXXXXXXX

SEQ ID NO: 27227 - protein, 64 aa, Diabrotica virgifera
  misc_feature: Coding regions on vcDNA: vcDNA=SeqID_6924; Strand=-; Position=2-193
  misc_feature (33)..(42): Xaa can be any naturally occurring amino acid
GGGEVFCFPGRHLGDNYRPPQTRTLKGFLLWKXXXXXXXXXXVFPLVEIQFGINPLGAPQWFLT

SEQ ID NO: 27228 - protein, 23 aa, Diabrotica virgifera
  misc_feature: Coding regions on vcDNA: vcDNA=SeqID_6925; Strand=-; Position=1-69
  misc_feature (3)..(13): Xaa can be any naturally occurring amino acid
PFXXXXXXXXXXXTNLAHTGLNS

SEQ ID NO: 27229 - protein, 297 aa, Diabrotica virgifera
  misc_feature: Coding regions on vcDNA: vcDNA=SeqID_6926; Strand=-; Position=0-890
  misc_feature (15)..(263): Xaa can be any naturally occurring amino acid
  misc_feature (276)..(285): Xaa can be any naturally occurring amino acid
IDRSLFTLSQKTTLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKPFLMLNISGFQXXXXXXXXXXWDLSSRGGHKKV

SEQ ID NO: 27230 - protein, 224 aa, Diabrotica virgifera
  misc_feature: Coding regions on vcDNA: vcDNA=SeqID_6927; Strand=+; Position=374-1048
  misc_feature (5)..(157): Xaa can be any naturally occurring amino acid
  misc_feature (159)..(189): Xaa can be any naturally occurring amino acid
LLISXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXFRDNTAILLESQIDNKDCGPPWWNKVYNWGNQLKY

SEQ ID NO: 27231 - protein, 197 aa, Diabrotica virgifera
  misc_feature: Coding regions on vcDNA: vcDNA=SeqID_6928; Strand=+; Position=1-593
  misc_feature: Homolog annotation: Hit_ID=EAA78044.1; Match level="QueryCoverage =94%, HitCoverage=9%, E-value=2e-41, Identity=44%"; Hit description =hypothetical protein FG07850.1 [Gibberella zeae PH-1] ref|XP _388026.1| hypothetical protein FG07850.1 [Gibb
  misc_feature: Gene Ontology Annotation: Molecular function=sterol glucosyltransferase activity; Cellular component=cellular_component unknown; Biological process=sterol metabolism
  misc_feature: Pfam annotation: Pfam_ID=Glyco_transf_28; Match level="Score=34.6, E -value=2.9e-07, Copies=1"; Pfam description=Glycosyltransferase family 28 N-termi
  misc_feature (170)..(170): Xaa can be any naturally occurring amino acid
NTTEISRFANLFIQHKRILESEPDRAEENIRDWEAKLMEDELKENQHDHVVPQNVALPILSRSMSNESIVYKKPAKPLHFTCITIGTIGDAQPYIALCKGLMKDGHRCRIATHDEFKDWIEEHNIEFRTVGGDPGELMRICVENNFFSVNFVREGLRLLQGWIDELLEKXWKAASGTDIIIESPSAMLGIPMADALL

SEQ ID NO: 27232 - protein, 44 aa, Diabrotica virgifera
  misc_feature: Coding regions on vcDNA: vcDNA=SeqID_6929; Strand=+; Position=32-163
IINDVLSPMCNELHEAEEDRGGETGNYSSPLCCYNKGMKRTGRK

SEQ ID NO: 27233 - protein, 213 aa, Diabrotica virgifera
  misc_feature: Coding regions on vcDNA: vcDNA=SeqID_6930; Strand=+; Position=218-856
  misc_feature: Homolog annotation: Hit_ID=EAL34336.1; Match level="QueryCoverage =73%, HitCoverage=37%, E-value=1e-63, Identity=77%"; Hit description =GA11107-PA [Drosophila pseudoobscura]
  misc_feature: Gene Ontology Annotation: Molecular function=ARF guanyl-nucleotide exchange factor activity; Cellular component=plasma membrane; Biological process=vesicle-mediated transport
  misc_feature: Pfam annotation: Pfam_ID=Sec7; Match level="Score=149.0, E-value=1.1e- 41, Copies=1"; Pfam description=Sec7 domain
MTTLGGSRRGSLSANAGHVSNWFSSLKRTKKTKHKPERTSKSAWDLTTLSHGIKRLQLKDDLCEVVSEMESLDSGEEGKNSNKTKMMSIGRKKFNMDPKKGIEYLIEKGLLQNTAESVAQFLHKGEGLNKTAIGDYLGEKNDFNEQVLQAFVELHDFTDLILVQALRQFLWSFRLPGEAQKIDRMMECFAKRYCECQGENNFFENSDTCYVLS

SEQ ID NO: 27234 - protein, 34 aa, Diabrotica virgifera
  misc_feature: Coding regions on vcDNA: vcDNA=SeqID_6931; Strand=-; Position=0-101
  misc_feature (3)..(12): Xaa can be any naturally occurring amino acid
  misc_feature (27)..(33): Xaa can be any naturally occurring amino acid
GGXXXXXXXXXXEIHLDLPPLGPQLFXXXXXXXA

SEQ ID NO: 27235 - protein, 88 aa, Diabrotica virgifera
  misc_feature: Coding regions on vcDNA: vcDNA=SeqID_6932; Strand=-; Position=98-364
  misc_feature (79)..(86): Xaa can be any naturally occurring amino acid
ERESKQSRKIKHTRKSESDVGEGIMNRGRRIIDNSDNNRQMVEKLKPKRLCYIQIGKGKIKVIHVFCRRQSKNTNFSNXXXXXXXXLK

SEQ ID NO: 27236 - protein, 54 aa, Diabrotica virgifera
  misc_feature: Coding regions on vcDNA: vcDNA=SeqID_6933; Strand=+; Position=2-163
  misc_feature (38)..(45): Xaa can be any naturally occurring amino acid
CFGGGELPRILPRRKKNRAPPNTYFSQKVLLCRYHPPXXXXXXXXFGEGGGYQL

SEQ ID NO: 27237 - protein, 156 aa, Diabrotica virgifera
  misc_feature: Coding regions on vcDNA: vcDNA=SeqID_6934; Strand=+; Position=1-468
  misc_feature (1)..(96): Xaa can be any naturally occurring amino acid
  misc_feature (98)..(110): Xaa can be any naturally occurring amino acid
  misc_feature (114)..(125): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXXLYYXXXXXXXXXXXXTISLKIYFSHQNLGLKLLPTLKNGIIYLYIS

SEQ ID NO: 27238 - protein, 96 aa, Diabrotica virgifera
  misc_feature: Coding regions on vcDNA: vcDNA=SeqID_6935; Strand=+; Position=189-479
YRNGHFPSHWSLPSEISSEKMGKSDIENCRFCDNEKETSEHILCNCIALFCKRLKFLEEVSIAPSDRKKSPRRLINFISLSEVISSKKNLETFNIF

SEQ ID NO: 27239 - protein, 287 aa, Diabrotica virgifera
  misc_feature: Coding regions on vcDNA: vcDNA=SeqID_6936; Strand=-; Position=1-909
  misc_feature: Homolog annotation: Hit_ID=XP_307274.1; Match level="QueryCoverage =99%, HitCoverage=57%, E-value=4e-47, Identity=37%"; Hit description =ENSANGP00000023005 [Anopheles gambiae]
  misc_feature: Pfam annotation: Pfam_ID=RVT_1; Match level="Score=41.6, E-value=2.2e- 09, Copies=1"; Pfam description=Reverse transcriptase (RNA-dependent
  misc_feature (52)..(52): Xaa can be any naturally occurring amino acid
  misc_feature (114)..(114): Xaa can be any naturally occurring amino acid
  misc_feature (131)..(131): Xaa can be any naturally occurring amino acid
  misc_feature (151)..(151): Xaa can be any naturally occurring amino acid
  misc_feature (158)..(158): Xaa can be any naturally occurring amino acid
  misc_feature (214)..(214): Xaa can be any naturally occurring amino acid
  misc_feature (232)..(232): Xaa can be any naturally occurring amino acid
TRAYKILSSINLSRLTPYAEKFPKRNIKPVEGQNRSKIDQLFTLRQLLEKGXMGEYNRPIHNLLIDFRQAYDSVERSQVWNAMAEFSIPKKLIRMTKVCMEDGISKVRVNNKLXDSFEINSGLKQNDALSXVLFNLVLEKAMRSAEIKTEXVINSRSXPLLAYADDIDLVGDSILSIKDIFNKMEGATSEVGLKINEEKTKYMCINRKRRRDRXDKIRRSTPSISKEYNFLXSGGRNTADNDVTEEIKDRIQSANRCLFLQDLTRSSKIKIYKSIVRPISTYGCETW

SEQ ID NO: 27240 - protein, 66 aa, Diabrotica virgifera
  misc_feature: Coding regions on vcDNA: vcDNA=SeqID_6937; Strand=+; Position=1-198
PFPSARLVPFLFISPPSHASRLLCSSVRYRKTNGSIKMHYQIRTHIASRLLTDQMDDEIPELTSNP

SEQ ID NO: 27241 - protein, 89 aa, Diabrotica virgifera
  misc_feature: Coding regions on vcDNA: vcDNA=SeqID_6938; Strand=+; Position=290-559
  misc_feature (22)..(37): Xaa can be any naturally occurring amino acid
ISHKLLLFLNGLLRKQSSSRTXXXXXXXXXXXXXXXXITFTINSVYSFSNQVTIIFQFIICVFIDKYLFFSFCVFHIYQCYQKNTSFKP

SEQ ID NO: 27242 - protein, 77 aa, Diabrotica virgifera
  misc_feature: Coding regions on vcDNA: vcDNA=SeqID_6939; Strand=-; Position=1-231
  misc_feature (70)..(76): Xaa can be any naturally occurring amino acid
TYGARSFRRDRLPIRHLRPITCYVVCILVASRLSYFHLCLPISVSLCNLPPVRKGGSTEFGLVLAAGVLXXXXXXXA

SEQ ID NO: 27243 - protein, 70 aa, Diabrotica virgifera
  misc_feature: Coding regions on vcDNA: vcDNA=SeqID_6940; Strand=+; Position=472-684
FVTSFYSRIYGVNVEACFYFAKNKLNIMLITNVTENLRVGTHGPASFNGFYKICILFYIKNMHTKFQTWK

SEQ ID NO: 27244 - protein, 148 aa, Diabrotica virgifera
  misc_feature: Coding regions on vcDNA: vcDNA=SeqID_6941; Strand=-; Position=205-651
PAGLKNACSVVALLILPKTGGLGWAGMSKDSQALGSTGRRGVLGVEPVKSASSPISEGGFTQVSYRVLARMFTVSFNIWPKAATAVRRPKEKVSRPPLPPSVSCESRSSFEVVFQVLNVETTFSRKRYLLVVAVGAPFQRACVQDCPQ

SEQ ID NO: 27245 - protein, 29 aa, Diabrotica virgifera
  misc_feature: Coding regions on vcDNA: vcDNA=SeqID_6942; Strand=-; Position=2-88
CLLVAWHRVSGEAHSCNAGWLALSAVVRG

SEQ ID NO: 27246 - protein, 343 aa, Diabrotica virgifera
  misc_feature: Coding regions on vcDNA: vcDNA=SeqID_6943; Strand=-; Position=1-1029
  misc_feature (1)..(339): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTIFK

SEQ ID NO: 27247 - protein, 232 aa, Diabrotica virgifera
  misc_feature: Coding regions on vcDNA: vcDNA=SeqID_6944; Strand=+; Position=105-800
  misc_feature: Homolog annotation: Hit_ID=NP_726659.1; Match level="QueryCoverage =94%, HitCoverage=35%, E-value=9e-46, Identity=44%"; Hit description =CG2945-PB, isoform B [Drosophila melanogaster] ref|NP_477030.1| CG2945-PA, isoform A [Drosophila
  misc_feature: Gene Ontology Annotation: Biological process=establishment of synaptic specificity at neuromuscular junction
  misc_feature: Pfam annotation: Pfam_ID=MoCF_biosynth; Match level="Score=133.9, E -value=3.7e-37, Copies=1"; Pfam description=Probable molybdopterin binding domain
MTPLTFGILTVSDTCHRDSKKDTSGPSLKEEVLKNYSSVQVIQQIVPDEIEDIKSVLLNWSDEKKCNVILTTGGTGFANRDVTPEATRQVIEKDAPGLSYAMISNSLAITNMAMLSRAVCGIRGKTVIINLPGSKKGATECFGFVKSCIPHAVALLTDQKDLVVLLHQSIQTKGGGDGLGFTPSKVKIDKVASRSRKSPYPLIEVPEATQIVLTQCTPTDETKVVAFDRSVD

SEQ ID NO: 27248 - protein, 58 aa, Diabrotica virgifera
  misc_feature: Coding regions on vcDNA: vcDNA=SeqID_6945; Strand=-; Position=250-426
  misc_feature (7)..(15): Xaa can be any naturally occurring amino acid
TKAPPLXXXXXXXXXLGGGLVRGHVIVLISSSFDQCGVLLRRTNREPVCSRFRVPPYK

SEQ ID NO: 27249 - protein, 163 aa, Diabrotica virgifera
  misc_feature: Coding regions on vcDNA: vcDNA=SeqID_6946; Strand=+; Position=3-494
  misc_feature: Homolog annotation: Hit_ID=XP_321946.1; Match level="QueryCoverage =99%, HitCoverage=54%, E-value=2e-73, Identity=82%"; Hit description =ENSANGP00000013866 [Anopheles gambiae]
  misc_feature: Gene Ontology Annotation: Molecular function=RAB small monomeric GTPase activity; Cellular component=cellular_component unknown; Biological process=protein transport
  misc_feature: Pfam annotation: Pfam_ID=Ras; Match level="Score=202.7, E-value=7.4e -58, Copies=1"; Pfam description=Ras family
FKIRTIDLDGKKIKLQIWDTAGQERFRTITTAYYRGAMGIMLVYDITNEKSFENIKNWIRNIEENASADVEKMLLGNKCELKDKRQVSKEKGEQLAVEYGIKFIETSAKASIRVEEAFFTLARDIKTKMEKKLEASNPPRGHQLKATEPPKKPTSWLSRCTIL

SEQ ID NO: 27250 - protein, 223 aa, Diabrotica virgifera
  misc_feature: Coding regions on vcDNA: vcDNA=SeqID_6947; Strand=+; Position=54-726
  misc_feature: Homolog annotation: Hit_ID=NP_723145.1; Match level="QueryCoverage =53%, HitCoverage=13%, E-value=6e-09, Identity=30%"; Hit description =CG31643-PA [Drosophila melanogaster] gb|AAN10572.1| CG31643-PA [Drosophila melanogaster]
  misc_feature (177)..(177): Xaa can be any naturally occurring amino acid
MKQSEDFSNLMNMITEKLSDFNAEVLSYVFLYLHKLGFHTEDFPMVQIAEKIRRDLIEEFNLSNCSKWIKVIFLESGIFNAIDECDSAEQLADISTCLTKLQNMVTPQIVSKYADKEQNFIEHKKLTSTDHNAILKAITFLSCPGWRNENTILLCKCMLLVKNQINRLDAARLLVLXRYFSKTQEPGDLLNENSKMCSKILAATRQKAIPLHNNPALQLFPLL

SEQ ID NO: 27251 - protein, 34 aa, Diabrotica virgifera
  misc_feature: Coding regions on vcDNA: vcDNA=SeqID_6948; Strand=-; Position=42-146
IYTVAKINNTVTKLCIKYNLYLTYLSRFKCFALF

SEQ ID NO: 27252 - protein, 100 aa, Diabrotica virgifera
  misc_feature: Coding regions on vcDNA: vcDNA=SeqID_6949; Strand=-; Position=88-391
  misc_feature: Homolog annotation: Hit_ID=AAV91378.1; Match level="QueryCoverage =75%, HitCoverage=57%, E-value=6e-14, Identity=57%"; Hit description =hypothetical protein 17 [Lonomia obliqua]
  misc_feature: Pfam annotation: Pfam_ID=Ribosomal_S30; Match level="Score=46.4, E -value=8e-11, Copies=1"; Pfam description=Ribosomal protein S30
  misc_feature (72)..(72): Xaa can be any naturally occurring amino acid
EEGLVSGLEITDIKLLVGLHGGKVQGSVDGAGKVKGLPPNVEKLEKKMKKLGRNMRGIQSDRGIVNVVESLXRRRGPSLYISPCIENCVDSYIWGGKYCV

SEQ ID NO: 27253 - protein, 28 aa, Diabrotica virgifera
  misc_feature: Coding regions on vcDNA: vcDNA=SeqID_6950; Strand=-; Position=61-147
PPAPPPPFFLCFWGGQNPGKTNFPKKRE

SEQ ID NO: 27254 - protein, 240 aa, Diabrotica virgifera
  misc_feature: Coding regions on vcDNA: vcDNA=SeqID_6951; Strand=+; Position=505-1421
  misc_feature: Homolog annotation: Hit_ID=CAD22154.1; Match level="QueryCoverage =99%, HitCoverage=54%, E-value=9e-58, Identity=49%"; Hit description =pherophorin-dz1 protein [Volvox carteri f. nagariensis]
  misc_feature: Gene Ontology Annotation: Molecular function=profilin binding; Cellular component=extracellular space; Biological process=actin filament organization
  misc_feature (61)..(61): Xaa can be any naturally occurring amino acid
  misc_feature (93)..(93): Xaa can be any naturally occurring amino acid
  misc_feature (134)..(134): Xaa can be any naturally occurring amino acid
  misc_feature (160)..(160): Xaa can be any naturally occurring amino acid
  misc_feature (162)..(171): Xaa can be any naturally occurring amino acid
NTGSPTLLLYNPAIIPSSTPLPLLPTPLSFPHPLKPLHTPPTATHPTTPPPAVSPPPPNAXTPPPPTPPPPPGLATPPPPNIPPQLEPPFPSXPSPPYHTLCPASAFPPPSPHLPPPPHLPSRRPPSPPPPLPXPSPPRSPPLPPSPSPTPPPLPPPPPXPXXXXXXXXXXPAPSVPSPRWPTPAPSPPPLPPIAPPPSPPSPPLPLRRSSPPAPPRPSPPPIHPCPPTHLSSPPPPFPL

SEQ ID NO: 27255 - protein, 141 aa, Diabrotica virgifera
  misc_feature: Coding regions on vcDNA: vcDNA=SeqID_6952; Strand=-; Position=1-423
  misc_feature (30)..(39): Xaa can be any naturally occurring amino acid
  misc_feature (42)..(61): Xaa can be any naturally occurring amino acid
  misc_feature (63)..(85): Xaa can be any naturally occurring amino acid
  misc_feature (90)..(97): Xaa can be any naturally occurring amino acid
  misc_feature (100)..(136): Xaa can be any naturally occurring amino acid
GGSPNYKLLTTLGGHIFYYRFDLPKKIGCXXXXXXXXXXKIXXXXXXXXXXXXXXXXXXXXPXXXXXXXXXXXXXXXXXXXXXXXYRVFXXXXXXXXFLXXXXXXXXXXXXXXXXXXXXXXXXXXXXXXXXXXXXXVKNTA

SEQ ID NO: 27256 - protein, 122 aa, Diabrotica virgifera
  misc_feature: Coding regions on vcDNA: vcDNA=SeqID_6953; Strand=+; Position=37-405
  misc_feature: Homolog annotation: Hit_ID=AAD53751.1; Match level="QueryCoverage =98%, HitCoverage=86%, E-value=4e-29, Identity=41%"; Hit description =death-associated LIM only protein DALP [Manduca sexta]
  misc_feature: Gene Ontology Annotation: Molecular function=transcription co -activator activity; Cellular component=focal adhesion; Biological process=cell adhesion
  misc_feature: Pfam annotation: Pfam_ID=LIM; Match level="Score=68.2, E-value=2.2e -17, Copies=2"; Pfam description=LIM domain
MSSAATEPKVCHKCKEQVKGGKCVQAMGVNWHEDHFLCEDCKTKLIGQQFMDVAGLPRCQKCYIAKHADKCKGCGKPIPDKAIVALDAKWHQMCFRCSKCSKPIMKDQSFQVDSGRPHCVKC

SEQ ID NO: 27257 - protein, 51 aa, Diabrotica virgifera
  misc_feature: Coding regions on vcDNA: vcDNA=SeqID_6954; Strand=-; Position=1-153
  misc_feature (23)..(32): Xaa can be any naturally occurring amino acid
GWANTPKAKNTPNRGNKGAPGNXXXXXXXXXXNYFGSLLFRGFFLLEAGPL

SEQ ID NO: 27258 - protein, 135 aa, Diabrotica virgifera
  misc_feature: Coding regions on vcDNA: vcDNA=SeqID_6955; Strand=+; Position=13-420
  misc_feature: Homolog annotation: Hit_ID=EAA04825.2; Match level="QueryCoverage =86%, HitCoverage=36%, E-value=2e-27, Identity=55%"; Hit description =ENSANGP00000019582 [Anopheles gambiae str. PEST] ref|XP_560278.1| ENSANGP00000019582 [Anopheles gambiae st
  misc_feature: Pfam annotation: Pfam_ID=ubiquitin; Match level="Score=42.7, E-value =1.1e-09, Copies=1"; Pfam description=Ubiquitin family
MSTVIKIVLKWNGKEFNLESSEDDTVSDLKKTIENVTSVKCGRQKLLNLKYKGKTPEDDCTLGLLKLKPNFKLMMMGSLEEDIAEANTAPENLPDVVNDLDIEEEEVAIENQDVYLCKKGGKKKRFFSQRWGGFR

SEQ ID NO: 27259 - protein, 92 aa, Diabrotica virgifera
  misc_feature: Coding regions on vcDNA: vcDNA=SeqID_6956; Strand=-; Position=2-277
  misc_feature (19)..(35): Xaa can be any naturally occurring amino acid
  misc_feature (37)..(54): Xaa can be any naturally occurring amino acid
  misc_feature (64)..(92): Xaa can be any naturally occurring amino acid
FPLGVVFFLVSKKRGSRKXXXXXXXXXXXXXXXXXPXXXXXXXXXXXXXXXXXXNCVNSLGSSXXXXXXXXXXXXXXXXXXXXXXXXXXXXX

SEQ ID NO: 27260 - protein, 31 aa, Diabrotica virgifera
  misc_feature: Coding regions on vcDNA: vcDNA=SeqID_6957; Strand=-; Position=3-95
FLNSKIRVYFAFAERCQNLSTRQHGCGMARP

SEQ ID NO: 27261 - protein, 76 aa, Diabrotica virgifera
  misc_feature: Coding regions on vcDNA: vcDNA=SeqID_6958; Strand=+; Position=1-228
  misc_feature (1)..(74): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXWG

SEQ ID NO: 27262 - protein, 56 aa, Diabrotica virgifera
  misc_feature: Coding regions on vcDNA: vcDNA=SeqID_6959; Strand=-; Position=0-167
  misc_feature (12)..(23): Xaa can be any naturally occurring amino acid
QELLKSGSSLGXXXXXXXXXXXXGFFPPGGEPSLNFNPLGAPPTGSFAFFYLSPNV

SEQ ID NO: 27263 - protein, 170 aa, Diabrotica virgifera
  misc_feature: Coding regions on vcDNA: vcDNA=SeqID_6960; Strand=-; Position=1-510
  misc_feature (17)..(52): Xaa can be any naturally occurring amino acid
  misc_feature (54)..(77): Xaa can be any naturally occurring amino acid
  misc_feature (81)..(123): Xaa can be any naturally occurring amino acid
  misc_feature (129)..(143): Xaa can be any naturally occurring amino acid
  misc_feature (145)..(170): Xaa can be any naturally occurring amino acid
LSLSPKKKLPAVFPPEXXXXXXXXXXXXXXXXXXXXXXXXXXXXXXXXXXXXPXXXXXXXXXXXXXXXXXXXXXXXXSMGXXXXXXXXXXXXXXXXXXXXXXXXXXXXXXXXXXXXXXXXXXXLCYLAXXXXXXXXXXXXXXXEXXXXXXXXXXXXXXXXXXXXXXXXXX

SEQ ID NO: 27264 - protein, 287 aa, Diabrotica virgifera
  misc_feature: Coding regions on vcDNA: vcDNA=SeqID_6961; Strand=-; Position=0-860
  misc_feature (2)..(26): Xaa can be any naturally occurring amino acid
  misc_feature (30)..(63): Xaa can be any naturally occurring amino acid
  misc_feature (70)..(95): Xaa can be any naturally occurring amino acid
  misc_feature (102)..(124): Xaa can be any naturally occurring amino acid
  misc_feature (130)..(137): Xaa can be any naturally occurring amino acid
  misc_feature (143)..(200): Xaa can be any naturally occurring amino acid
  misc_feature (207)..(250): Xaa can be any naturally occurring amino acid
  misc_feature (256)..(282): Xaa can be any naturally occurring amino acid
HXXXXXXXXXXXXXXXXXXXXXXXXXQSAXXXXXXXXXXXXXXXXXXXXXXXXXXXXXXXXXXCVSPPHXXXXXXXXXXXXXXXXXXXXXXXXXXCFLPPPXXXXXXXXXXXXXXXXXXXXXXXRSPIFXXXXXXXXGRARGXXXXXXXXXXXXXXXXXXXXXXXXXXXXXXXXXXXXXXXXXXXXXXXXXXXXXXXXXXGFGGEWXXXXXXXXXXXXXXXXXXXXXXXXXXXXXXXXXXXXXXXXXXXXTPGGGXXXXXXXXXXXXXXXXXXXXXXXXXXXVRGGG

SEQ ID NO: 27265 - protein, 59 aa, Diabrotica virgifera
  misc_feature: Coding regions on vcDNA: vcDNA=SeqID_6962; Strand=-; Position=2-178
GVPRGHPFLPEKKLPPLKFLKRYKYFWFKNWARLKLFVKNQPPFFFTPIGPKNRENFPL

SEQ ID NO: 27266 - protein, 68 aa, Diabrotica virgifera
  misc_feature: Coding regions on vcDNA: vcDNA=SeqID_6963; Strand=+; Position=18-224
  misc_feature: Homolog annotation: Hit_ID=EAL41744.1; Match level="QueryCoverage =75%, HitCoverage=76%, E-value=2e-15, Identity=70%"; Hit description =ENSANGP00000029626 [Anopheles gambiae str. PEST] ref|XP_564616.1| ENSANGP00000029626 [Anopheles gambiae st
  misc_feature: Pfam annotation: Pfam_ID=COX7C; Match level="Score=66.3, E-value=8.3e- 17, Copies=1"; Pfam description=Cytochrome c oxidase subunit VIIc
MIGKSNLLVRQMVRNAIVRASHDHGGVPGVNLPFDINNRFKLTAMMIAFFGSGFGAPFLIVRHQLTKA

SEQ ID NO: 27267 - protein, 190 aa, Diabrotica virgifera
  misc_feature: Coding regions on vcDNA: vcDNA=SeqID_6964; Strand=-; Position=64-636
  misc_feature (71)..(79): Xaa can be any naturally occurring amino acid
  misc_feature (144)..(150): Xaa can be any naturally occurring amino acid
KPPPPLIDEIKALWFAFGGRGVDIPSRVYDALFELGKDKFRAWSENPPAPGKKLANSLIAPNDAAAAVPMXXXXXXXXXRGEDFFSLVKFFPPLIEAPSDVPVDPQRAPDKINGWGGPDYTPPPRVLDVVFGLGEVAKPLVIKXXXXXXXVSDQWNPFVTPPSHCGKAHFDFSHVPGAKWLQKISPRVSP

SEQ ID NO: 27268 - protein, 55 aa, Diabrotica virgifera
  misc_feature: Coding regions on vcDNA: vcDNA=SeqID_6965; Strand=-; Position=90-258
  misc_feature: Homolog annotation: Hit_ID=AAC04471.1; Match level="QueryCoverage =100%, HitCoverage=14%, E-value=8e-19, Identity=78%"; Hit description= MtlK [Pseudomonas fluorescens]
  misc_feature (9)..(9): Xaa can be any naturally occurring amino acid
FCHVITASXEPLDLRVRGDMASQYGETLQLYLDPTQCHLFDADGVAVARPLRAAA

SEQ ID NO: 27269 - protein, 224 aa, Diabrotica virgifera
  misc_feature: Coding regions on vcDNA: vcDNA=SeqID_6966; Strand=+; Position=1-675
  misc_feature: Homolog annotation: Hit_ID=XP_308624.1; Match level="QueryCoverage =99%, HitCoverage=26%, E-value=1e-43, Identity=37%"; Hit description =ENSANGP00000024486 [Anopheles gambiae]
  misc_feature (5)..(5): Xaa can be any naturally occurring amino acid
  misc_feature (54)..(62): Xaa can be any naturally occurring amino acid
RPVLXWSDNATNFHGAKNEMREFYDFFLNQNNSEQIKEFCTQNSITFKMGVPRXXXXXXXXXVGIKSVKYHLYRIIGNSHFTFEVFNTVLCQIEAILNSRPITRMSSDANDFAFLSPAHFLVQRSLTAPPEPSVSEIPENRLNLFQRISKIQQQFWKLWKKDYLCLLQQRNKWTDPTDPVKIGDLVLLKEDGTPPLLWPTARVIDVLPGKDGLVRTVKIHTTSR

SEQ ID NO: 27270 - protein, 260 aa, Diabrotica virgifera
  misc_feature: Coding regions on vcDNA: vcDNA=SeqID_6967; Strand=-; Position=2-781
  misc_feature (13)..(60): Xaa can be any naturally occurring amino acid
  misc_feature (68)..(260): Xaa can be any naturally occurring amino acid
SQIKIYGCYPLKXXXXXXXXXXXXXXXXXXXXXXXXXXXXXXXXXXXXXXXXXXXXXXXXSKNFIGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27271 - protein, 64 aa, Diabrotica virgifera
  misc_feature: Coding regions on vcDNA: vcDNA=SeqID_6968; Strand=-; Position=1-192
  misc_feature (15)..(21): Xaa can be any naturally occurring amino acid
  misc_feature (25)..(30): Xaa can be any naturally occurring amino acid
  misc_feature (48)..(64): Xaa can be any naturally occurring amino acid
FCVFLPLPSRPSLPXXXXXXXHAEXXXXXXLFILSSPFPPQTKNMINXXXXXXXXXXXXXXXXX

SEQ ID NO: 27272 - protein, 66 aa, Diabrotica virgifera; identical to SEQ ID NO: 26808
  misc_feature: Coding regions on vcDNA: vcDNA=SeqID_6969; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 27273 - protein, 77 aa, Diabrotica virgifera
  misc_feature: Coding regions on vcDNA: vcDNA=SeqID_6970; Strand=-; Position=286-519
SFSDMLVSISVSFQYSSSADAVLQVYKNETTVTREMRPRSGTCCFSLYASFQQVCRQCISQREGLSIAGYIVEHHFG

SEQ ID NO: 27274 - protein, 31 aa, Diabrotica virgifera
  misc_feature: Coding regions on vcDNA: vcDNA=SeqID_6971; Strand=-; Position=0-92
  misc_feature (3)..(29): Xaa can be any naturally occurring amino acid
STXXXXXXXXXXXXXXXXXXXXXXXXXXXSR

SEQ ID NO: 27275 - protein, 204 aa, Diabrotica virgifera
  misc_feature: Coding regions on vcDNA: vcDNA=SeqID_6972; Strand=+; Position=82-693
  misc_feature: Homolog annotation: Hit_ID=BAB13402.1; Match level="QueryCoverage =93%, HitCoverage=42%, E-value=2e-45, Identity=46%"; Hit description =KIAA1576 protein [Homo sapiens]
  misc_feature: Gene Ontology Annotation: Molecular function=molecular_function unknown; Cellular component=cellular_component unknown; Biological process=biological_process unknown
LLNSHLISEQEAVPNNAVEEPKTEKAENAVEETKEVKENGTGDVEPVAEAEKEAPKEMRAVVLTGFGGLKSVKILKKPEPSVNEGEVLIRVKACGLNFQDLMVRQGAIDSPPKCPFILGFECAGEIEQVGEGVEDFAIGDQVVALPEYRAWAELVSVPAKYVYKLPKDVSHLDAVTITMNYTVAYILLFELSGLTQGKSILIHS

SEQ ID NO: 27276 - protein, 248 aa, Diabrotica virgifera
  misc_feature: Coding regions on vcDNA: vcDNA=SeqID_6973; Strand=+; Position=2-748
  misc_feature: Homolog annotation: Hit_ID=BAC82590.1; Match level="QueryCoverage =93%, HitCoverage=21%, E-value=1e-22, Identity=31%"; Hit description =reverse transcriptase [Ciona intestinalis]
SEIISVKAGKRRPTRSNQSNAVNAPAIEIENRRHKRALEYRLTQRRYHTDRSALAHAVLDDKPLWEKDVHPKIKTIEKEYRKIFSARSPEDDEPISDQKDPTTVSYAVTEAEILGALRTTKSQAAGPDFFKIKQLRRVPVQKLVLIYNTMLQFGATPEVLKECRTTLIPKGGDPLEVGNWRPITISSILIRVFHRILGKRLAVLGYHDNQRGFRQLDGVLLNNLTLQTVIQERRKALRPYNILAIDLT

SEQ ID NO: 27277 - protein, 218 aa, Diabrotica virgifera
  misc_feature: Coding regions on vcDNA: vcDNA=SeqID_6974; Strand=+; Position=160-813
  misc_feature: Homolog annotation: Hit_ID=XP_426009.1; Match level="QueryCoverage =66%, HitCoverage=11%, E-value=9e-13, Identity=31%"; Hit description =PREDICTED: similar to phosphoinositide-3-kinase, regulatory subunit 4, p150;
  misc_feature: Gene Ontology Annotation: Molecular function=ATP binding; Cellular component=cellular_component unknown; Biological process=protein amino acid phosphorylation
MEEYFLKMSHHLKKINKYKLHLDGRQNRPAEGRLETSSINSSVKSHIYNLGDAQKGDYMANRLHRTNTSGSIDTNINSDWNYSSEVLTRQSESTNSGGPPSRSTSSRPSSPPPDGNNHFNSTDPSSNVSLHERSYIQYRKSNCYIELANLKARQQDHYFEALRNKEWAEQATWRPQLPPPGWRLRGVLVAHLHEHKGAVNKLCVLPDTPYFCSSSSDG

SEQ ID NO: 27278 - protein, 121 aa, Diabrotica virgifera
  misc_feature: Coding regions on vcDNA: vcDNA=SeqID_6975; Strand=+; Position=518-880
  misc_feature (80)..(80): Xaa can be any naturally occurring amino acid
  misc_feature (82)..(82): Xaa can be any naturally occurring amino acid
  misc_feature (86)..(93): Xaa can be any naturally occurring amino acid
KNQIKSYDRGGSTCSTDNVFQKKKSCQQTFLTKNAYPLSCVSKKFHKIEERKQQNTTSNPETLTRRDLRDPHKKNENNTXCXEFIXXXXXXXXPCECNNFYVADITRPLSVRRKNEQETYT

SEQ ID NO: 27279 - protein, 109 aa, Diabrotica virgifera
  misc_feature: Coding regions on vcDNA: vcDNA=SeqID_6976; Strand=+; Position=773-1099
  misc_feature (74)..(88): Xaa can be any naturally occurring amino acid
  misc_feature (92)..(100): Xaa can be any naturally occurring amino acid
LNKNALLCLFFLIGIIFNNQGINLIPIITIDSKLNNEILILNPIPYISFIISPYNLVNLRVTLPSINLLKFQRXXXXXXXXXXXXXXXVKLXXXXXXXXXAPLNFFGVY

SEQ ID NO: 27280 - protein, 97 aa, Diabrotica virgifera
  misc_feature: Coding regions on vcDNA: vcDNA=SeqID_6977; Strand=-; Position=3-293
  misc_feature (16)..(31): Xaa can be any naturally occurring amino acid
SYFLVAFLQLTCFDGXXXXXXXXXXXXXXXXDNDTQFGHRNVNKIIFLVKLWLISHQNKLIKRCTYITTYITIIVAYIVHHWKQQILKCKIITKLKP

SEQ ID NO: 27281 - protein, 42 aa, Diabrotica virgifera
  misc_feature: Coding regions on vcDNA: vcDNA=SeqID_6978; Strand=-; Position=2-127
  misc_feature (2)..(11): Xaa can be any naturally occurring amino acid
GXXXXXXXXXXFRIRFELNPVWPPNCFFQPIFFFSAQGFFGG

SEQ ID NO: 27282 - protein, 143 aa, Diabrotica virgifera
  misc_feature: Coding regions on vcDNA: vcDNA=SeqID_6979; Strand=+; Position=45-476
  misc_feature: Homolog annotation: Hit_ID=XP_392347.1; Match level="QueryCoverage =86%, HitCoverage=92%, E-value=2e-09, Identity=32%"; Hit description =similar to CG31363-PC [Apis mellifera]
MATYATYRHIELDKVGYGKKRVSNQSSEIFNVLCTPPSNKTNGHITPRRSLQSNDSFNKLFGSPENKRPHPRRGSLTKQERNPVTGETYTIVSPATTPTKPMTNGFTNGTSTPSLNGNSTPLTNGNAHSLINGNGIHTPNGNV

SEQ ID NO: 27283 - protein, 291 aa, Diabrotica virgifera
  misc_feature: Coding regions on vcDNA: vcDNA=SeqID_6980; Strand=+; Position=2-877
  misc_feature: Homolog annotation: Hit_ID=NP_689808.2; Match level="QueryCoverage =53%, HitCoverage=28%, E-value=7e-10, Identity=30%"; Hit description =piggyBac transposable element derived 4 [Homo sapiens]
MKVKPELEECKFESNNMEVPILNQSLVEDIKLESQILKHETIDPVYLSSTMQDIKVEIKEETEELDVPIDHNDEKKIMENEPGPPKKVKCDSEKHHKLTEAELLAALDESDEEIDPFYDPSDPLYDSDSDIESEEDSTVSSDMGNIAPNDWSFTEIPNQSLPFTKTAGFLVDVNSAEPFDYFQLLATDDFFNMLCEKANKYPIDVIAQDSGSKSRITSWYDVNVTEMKIFLGLLFHMGSIRMDRMNDYWEINNLVWFPSFISWVPSFMSCNRVLNDFPKAYSLKDTGPRIT

SEQ ID NO: 27284 - protein, 70 aa, Diabrotica virgifera
  misc_feature: Coding regions on vcDNA: vcDNA=SeqID_6981; Strand=+; Position=106-318
SAIVAVAFHVPKVIQKTLNYADFGNKEYNSFITTTKCPRPKANQKKVKAVTSLFRFLNEDYVNFNEMLNG

SEQ ID NO: 27285 - protein, 121 aa, Diabrotica virgifera
  misc_feature: Coding regions on vcDNA: vcDNA=SeqID_6982; Strand=+; Position=104-468
  misc_feature: Homolog annotation: Hit_ID=EAL38899.1; Match level="QueryCoverage =97%, HitCoverage=36%, E-value=1e-25, Identity=47%"; Hit description =ENSANGP00000028377 [Anopheles gambiae str. PEST] ref|XP_552575.1| ENSANGP00000028377 [Anopheles gambiae st
  misc_feature: Gene Ontology Annotation: Molecular function=triacylglycerol lipase activity; Cellular component=extracellular; Biological process =triacylglycerol metabolism
  misc_feature (56)..(56): Xaa can be any naturally occurring amino acid
RTDNRIDASDAENVQIIHTNGGKMGYLAPCGDSDFYPNGGKSQPGCGFDLGGGCAXSRSYAIYAESLTSTGFVGQQCNSYEEYQKGKCTGPKASMGMFHIDKMASGSYYLKTHSKSPFHKG

SEQ ID NO: 27286 - protein, 246 aa, Diabrotica virgifera
  misc_feature: Coding regions on vcDNA: vcDNA=SeqID_6983; Strand=+; Position=1-741
  misc_feature: Homolog annotation: Hit_ID=BAB71625.1; Match level="QueryCoverage =99%, HitCoverage=90%, E-value=2e-97, Identity=63%"; Hit description =unnamed protein product [Homo sapiens]
  misc_feature: Pfam annotation: Pfam_ID=DUF323; Match level="Score=335.2, E-value =9.6e-98, Copies=1"; Pfam description=Domain of unknown function (DUF323)
NEGPLRNVTVNTFYLDKYEVSNQQFYDFVKKTGYKTEAEVFGDSFLFEMCLPEKERKKYEDIRAAQAPWWIKMSGVSWKHPEGPDSTIEGKMNHPVIHVSWNDAVKYCEYLGKRLPTEAEWELACRGGLKQKLYPWGNKLHPKGQHWANIWQGEFPHTNTAEDGFVFTSPVDSFPANKYGLYNMAGNVWEWTQDNWKNDPDTKVKKGGSYLCHESYCWRYRCAARSSNTKDSSASNLGFRCAADKI

SEQ ID NO: 27287 - protein, 240 aa, Diabrotica virgifera
  misc_feature: Coding regions on vcDNA: vcDNA=SeqID_6984; Strand=+; Position=52-771
  misc_feature: Homolog annotation: Hit_ID=EAL30551.1; Match level="QueryCoverage =97%, HitCoverage=27%, E-value=6e-48, Identity=41%"; Hit description =GA11700-PA [Drosophila pseudoobscura]
  misc_feature: Gene Ontology Annotation: Molecular function=microtubule motor activity; Cellular component=kinesin complex; Biological process =female meiosis chromosome segregation
  misc_feature: Pfam annotation: Pfam_ID=Kinesin; Match level="Score=-75.5, E-value =6.1e-10, Copies=1"; Pfam description=Kinesin motor domain
ATKYTPTPRKLRREKTTVSTSSSDSEKDPVHVYCRLRPLRDSDTNTCMNLLSPQEICVSSESKGVRRDISYKFRHIFTAYSSQKEVFDHVAYPLLDDLLKGKNGILFTYGVTGSGKTYTLTGDHNNPGIMPRCINTIFNSVGEFQTPKFIIKSDRMNGFEIQTEEDATQDRLSENRFNSKTPKSARKVNGDKGFTNDGNRIPVLNEMNAYAVFISYVEIYNNNVCDLLDDSTSGKTFPNK

SEQ ID NO: 27288 - protein, 83 aa, Diabrotica virgifera
  misc_feature: Coding regions on vcDNA: vcDNA=SeqID_6985; Strand=+; Position=396-646
  misc_feature: Homolog annotation: Hit_ID=BAA75470.1; Match level="QueryCoverage =85%, HitCoverage=10%, E-value=2e-13, Identity=53%"; Hit description =prophenoloxidase [Tenebrio molitor]
  misc_feature (24)..(24): Xaa can be any naturally occurring amino acid
  misc_feature (53)..(53): Xaa can be any naturally occurring amino acid
SSSSLLNIRYTDVNPYLIHYALIXSIVHRTDTHNVNLTSFIRSCPDLYIHRKXFLQGRDQMNLGSTTSRTPIEIPRHFTASYL

SEQ ID NO: 27289 - protein, 75 aa, Diabrotica virgifera
  misc_feature: Coding regions on vcDNA: vcDNA=SeqID_6986; Strand=-; Position=0-224
WPLYDLVVRIPRDKHEGSQNSIRSCILLHTFVRPGSILYALTLKLVVGLSVLCTYEAPGARGGPRIPRRSPHACP

SEQ ID NO: 27290 - protein, 20 aa, Diabrotica virgifera
  misc_feature: Coding regions on vcDNA: vcDNA=SeqID_6987; Strand=-; Position=1-60
  misc_feature (7)..(14): Xaa can be any naturally occurring amino acid
GHKHLNXXXXXXXXIIRGGG

SEQ ID NO: 27291 - protein, 141 aa, Diabrotica virgifera
  misc_feature: Coding regions on vcDNA: vcDNA=SeqID_6988; Strand=-; Position=0-422
NKNLFLMNTYIGSFAIEILSTTKNTHIKYKQPILVYDFKCLNNKSRYIIVVNTIPTNKLHAQQRMSLTGLQLGQQDVCKGAYTQQEEKSCQVSRILLSRRSIKTMMMIFYNEIDVTKVAYLKSTIHNVFSLRHFLLSCEKG

SEQ ID NO: 27292 - protein, 256 aa, Diabrotica virgifera
  misc_feature: Coding regions on vcDNA: vcDNA=SeqID_6989; Strand=-; Position=0-767
  misc_feature (3)..(11): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(249): Xaa can be any naturally occurring amino acid
  misc_feature (251)..(255): Xaa can be any naturally occurring amino acid
PFXXXXXXXXXIETNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXV

SEQ ID NO: 27293 - protein, 153 aa, Diabrotica virgifera
  misc_feature: Coding regions on vcDNA: vcDNA=SeqID_6990; Strand=-; Position=459-920
  misc_feature (5)..(19): Xaa can be any naturally occurring amino acid
  misc_feature (28)..(55): Xaa can be any naturally occurring amino acid
  misc_feature (83)..(96): Xaa can be any naturally occurring amino acid
KKFLXXXXXXXXXXXXXXXRGGVVFAPXXXXXXXXXXXXXXXXXXXXXXXXXXXXQENFHSTKMVRWGFFEQCGVLLILFSPXXXXXXXXXXXXXXPKGIPREKNQNGGKFGEKPTIYDKVIPGGEKGGVLNKGFTTEGGASGGGVYRNLVNT

SEQ ID NO: 27294 - protein, 209 aa, Diabrotica virgifera
  misc_feature: Coding regions on vcDNA: vcDNA=SeqID_6991; Strand=+; Position=1-630
  misc_feature (4)..(132): Xaa can be any naturally occurring amino acid
  misc_feature (135)..(154): Xaa can be any naturally occurring amino acid
  misc_feature (157)..(166): Xaa can be any naturally occurring amino acid
  misc_feature (171)..(198): Xaa can be any naturally occurring amino acid
MLFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSPXXXXXXXXXXXXXXXXXXXXLIXXXXXXXXXXGLDEXXXXXXXXXXXXXXXXXXXXXXXXXXXXLALSKIINQFF

SEQ ID NO: 27295 - protein, 85 aa, Diabrotica virgifera
  misc_feature: Coding regions on vcDNA: vcDNA=SeqID_6992; Strand=-; Position=367-624
  misc_feature: Homolog annotation: Hit_ID=EAL40346.1; Match level="QueryCoverage =68%, HitCoverage=15%, E-value=2e-09, Identity=41%"; Hit description =ENSANGP00000027010 [Anopheles gambiae str. PEST] ref|XP_558079.1| ENSANGP00000027010 [Anopheles gambiae st
MEDSLLNEYWKMMTLKRREQLVIQKSRIAEVLRQLHDSPLGGHLGVKKILQRIRERFYWMNNSNDVKDWCMKCTTCATSNSLGAK

SEQ ID NO: 27296 - protein, 76 aa, Diabrotica virgifera
  misc_feature: Coding regions on vcDNA: vcDNA=SeqID_6993; Strand=+; Position=1-231
RGPVRRRRPEYCGGFLETMDAPINHGHALVRHEKYRRPCVYTIRLICAFVEDMLRVVPRRPGHIARSTKKKNFLRL

SEQ ID NO: 27297 - protein, 88 aa, Diabrotica virgifera
  misc_feature: Coding regions on vcDNA: vcDNA=SeqID_6994; Strand=+; Position=707-970
  misc_feature (20)..(20): Xaa can be any naturally occurring amino acid
LAVCICYCRESFPFLPLHLXHSGVQLVVLLSISECGRLCILCSIHSRRRYFMYLTIFPLFNSLSFRLLFSFFFLLSLLHWGPSIILII

SEQ ID NO: 27298 - protein, 175 aa, Diabrotica virgifera; identical to SEQ ID NO: 27001
  misc_feature: Coding regions on vcDNA: vcDNA=SeqID_6995; Strand=+; Position=66-737
  misc_feature: Homolog annotation: Hit_ID=AAF87759.1; Match level="QueryCoverage =100%, HitCoverage=50%, E-value=4e-70, Identity=65%"; Hit description= cytochrome oxidase subunit I [Diabrotica virgifera virgifera]
  misc_feature: Pfam annotation: Pfam_ID=COX1; Match level="Score=-136.5, E-value =1.3e-06, Copies=1"; Pfam description=Cytochrome C and Quinol oxidase polyp
  misc_feature (2)..(2): Xaa can be any naturally occurring amino acid
  misc_feature (10)..(10): Xaa can be any naturally occurring amino acid
  misc_feature (35)..(43): Xaa can be any naturally occurring amino acid
  misc_feature (70)..(70): Xaa can be any naturally occurring amino acid
  misc_feature (124)..(124): Xaa can be any naturally occurring amino acid
  misc_feature (159)..(159): Xaa can be any naturally occurring amino acid

SEQ ID NO: 27299 - protein, 64 aa, Diabrotica virgifera
  misc_feature: Coding regions on vcDNA: vcDNA=SeqID_6996; Strand=-; Position=85-279
TISVVAEGTVDSSLTSAELCSTSLAGSLVALTSAAGAAGCGSTEAVSSDLPSTNPDLDWKHLRI

SEQ ID NO: 27300 - protein, 78 aa, Diabrotica virgifera
  misc_feature: Coding regions on vcDNA: vcDNA=SeqID_6997; Strand=-; Position=2-235
  misc_feature (11)..(34): Xaa can be any naturally occurring amino acid
SQLIRYRNTEXXXXXXXXXXXXXXXXXXXXXXXXAPKLSFHLYLGRPILLLPNGDLSLAILTILDSDILLMCSFHSSF

SEQ ID NO: 27301 - protein, 78 aa, Diabrotica virgifera
  misc_feature: Coding regions on vcDNA: vcDNA=SeqID_6998; Strand=-; Position=151-387
IWLWYKGRPQSRARKLVFLSTPCSTPPLYIFDNTYFCCFLVRGVCVNFVIVVWHRGHSGVTIRRAIWVGVPLIRSYFY

SEQ ID NO: 27302 - protein, 118 aa, Diabrotica virgifera
  misc_feature: Coding regions on vcDNA: vcDNA=SeqID_6999; Strand=+; Position=212-568
  misc_feature (26)..(33): Xaa can be any naturally occurring amino acid
  misc_feature (85)..(91): Xaa can be any naturally occurring amino acid
  misc_feature (100)..(106): Xaa can be any naturally occurring amino acid
LFLLRFARLLDQFVGTCIDIVCYYSXXXXXXXXWRYTGTNENIVFSPNFKKKECVCTMYARKKIFFYYIIGNLNEVNILKRLFVXXXXXXXTNFLIYHFXXXXXXXTKNKTKYESLGN

SEQ ID NO: 27303 - protein, 61 aa, Diabrotica virgifera
  misc_feature: Coding regions on vcDNA: vcDNA=SeqID_7000; Strand=-; Position=2-184
SLRDYTKVVVLGGNSVSIYFLCLRNRESGLILRMFPMLSSPLHILRCSLAWLVLGMPSRSR

SEQ ID NO: 27304 - protein, 93 aa, Diabrotica virgifera
  misc_feature: Coding regions on vcDNA: vcDNA=SeqID_7001; Strand=+; Position=289-570
LFILLEDVLASVVFAHPLSFVDSRLTVLLHRILRSNVLFHPPHQKQKLLELLPKRRSITTLTPETLHYTRSHWSVIRRQLLPICNVYPECQET

SEQ ID NO: 27305 - protein, 64 aa, Diabrotica virgifera
  misc_feature: Coding regions on vcDNA: vcDNA=SeqID_7002; Strand=+; Position=44-238
RVTKLPLDCLIFLPILQNRLSNAHTFLFYVNLCTGWYLNEKYIWNFTLEYTFSSSTKDNKFICH

SEQ ID NO: 27306 - protein, 79 aa, Diabrotica virgifera
  misc_feature: Coding regions on vcDNA: vcDNA=SeqID_7003; Strand=-; Position=2-238
  misc_feature (1)..(13): Xaa can be any naturally occurring amino acid
  misc_feature (16)..(26): Xaa can be any naturally occurring amino acid
  misc_feature (36)..(43): Xaa can be any naturally occurring amino acid
  misc_feature (46)..(59): Xaa can be any naturally occurring amino acid
  misc_feature (65)..(78): Xaa can be any naturally occurring amino acid
XXXXXXXXXXXXXPFXXXXXXXXXXXTNLAHTGLNXXXXXXXXSNXXXXXXXXXXXXXXPTSRSXXXXXXXXXXXXXXV

SEQ ID NO: 27307 - protein, 256 aa, Diabrotica virgifera
  misc_feature: Coding regions on vcDNA: vcDNA=SeqID_7004; Strand=+; Position=3-770
  misc_feature: Homolog annotation: Hit_ID=BAD86655.1; Match level="QueryCoverage =100%, HitCoverage=18%, E-value=4e-42, Identity=38%"; Hit description= reverse transcriptase [Bombyx mori]
ILARIKDSKYFSKLDTSSGFYQIRLDPESQSLTTFITPFGRYLFTRVPFGITCAPEYFSILLNKILAGLDGVISHIDDILIHAPTLEEHNKILDEVLSRIQAEGIALNKDKCVIAVQKLQYLGHEISNEGVSIAPERISAFVNFPEPTNKTELLQFLGMINFSCRFIPNRSEILEPLTSLLKKSVTFIWDSPQKQAFVRGKELLQKSPCLAYFDPTKQIAVSADASSFGLGACLIQFNEGKKENCAYASRLLSSTE

SEQ ID NO: 27308 - protein, 21 aa, Diabrotica virgifera
  misc_feature: Coding regions on vcDNA: vcDNA=SeqID_7005; Strand=-; Position=1-63
IFRCTLYSCTIHLCCVKPFFK

SEQ ID NO: 27309 - protein, 131 aa, Diabrotica virgifera
  misc_feature: Coding regions on vcDNA: vcDNA=SeqID_7006; Strand=+; Position=338-730
  misc_feature (35)..(91): Xaa can be any naturally occurring amino acid
SNYFGNLLYYNYVMICSGEFGFYRKSIFYRTLKVXXXXXXXXXXXXXXXXXXXXXXXXXXXXXXXXXXXXXXXXXXXXXXXXXXXXXXXXXRLKGSNFTNGGWERIIFFMGPLKLISGAGFLNGGDGKTRG

SEQ ID NO: 27310 - protein, 127 aa, Diabrotica virgifera
  misc_feature: Coding regions on vcDNA: vcDNA=SeqID_7007; Strand=-; Position=2-382
  misc_feature (64)..(74): Xaa can be any naturally occurring amino acid
EKMSFVRNQLIEICWENTSKIRNTFQIENDVLFSSIFRMLLLAINPHKVVSSFESRTVISFLRXXXXXXXXXXXLAVFIGDFYNKESIPAPLRIRNMAKNSQLFADTFNCKDNFERKQFPFLKPVNP

SEQ ID NO: 27311 - protein, 29 aa, Diabrotica virgifera
  misc_feature: Coding regions on vcDNA: vcDNA=SeqID_7008; Strand=+; Position=2-91
AVRPPGGVPHDAKINDVKDGLNAVHLLPR

SEQ ID NO: 27312 - protein, 292 aa, Diabrotica virgifera
  misc_feature: Coding regions on vcDNA: vcDNA=SeqID_7009; Strand=+; Position=83-957
  misc_feature: Homolog annotation: Hit_ID=AAH85449.1; Match level="QueryCoverage =98%, HitCoverage=79%, E-value=2e-88, Identity=60%"; Hit description =Zgc:101831 [Danio rerio] ref|NP_001007385.1| zgc:101831 [Danio rerio]
  misc_feature: Gene Ontology Annotation: Molecular function=tRNA methyltransferase activity; Cellular component=cytoplasm; Biological process=tRNA modification
  misc_feature: Pfam annotation: Pfam_ID=FtsJ; Match level="Score=236.5, E-value=5e -68, Copies=1"; Pfam description=FtsJ-like methyltransferase
  misc_feature (46)..(51): Xaa can be any naturally occurring amino acid
  misc_feature (70)..(75): Xaa can be any naturally occurring amino acid
  misc_feature (241)..(241): Xaa can be any naturally occurring amino acid
  misc_feature (254)..(254): Xaa can be any naturally occurring amino acid
  misc_feature (260)..(260): Xaa can be any naturally occurring amino acid
MGKVSKDKRDIYYRKAKEQGWRARSAFKLLQIDEKYNIFDGVTRAXXXXXXPGSWSQVLSRKLYLGESIXXXXXXYLFYSDIELQSKLEELEPSESSSKNDNVKIVAVDLQPMSPLPGVIQLQGDITKYSTAQQIIGHFEGDHADLVVCDGAPDVTGLHSMDIYIQAQLLLGALHICCNVLKPGGTFVAKIFRGKDNDLLTNQLLTLFKEVDIAKPSSSRNSSIESFVVCRNYSPPEGFDXKLMTPYLDISHRXFNSLTXVNRVIFPFVVCGDVSAFDSDTTYSLQLQGRET

SEQ ID NO: 27313 - protein, 35 aa, Diabrotica virgifera
  misc_feature: Coding regions on vcDNA: vcDNA=SeqID_7010; Strand=-; Position=0-104
  misc_feature (2)..(26): Xaa can be any naturally occurring amino acid
  misc_feature (29)..(34): Xaa can be any naturally occurring amino acid
PXXXXXXXXXXXXXXXXXXXXXXXXXFLXXXXXXL

SEQ ID NO: 27314 - protein, 135 aa, Diabrotica virgifera
  misc_feature: Coding regions on vcDNA: vcDNA=SeqID_7011; Strand=-; Position=904-1311
  misc_feature (3)..(17): Xaa can be any naturally occurring amino acid
  misc_feature (23)..(33): Xaa can be any naturally occurring amino acid
  misc_feature (41)..(57): Xaa can be any naturally occurring amino acid
  misc_feature (60)..(70): Xaa can be any naturally occurring amino acid
  misc_feature (118)..(124): Xaa can be any naturally occurring amino acid
GGXXXXXXXXXXXXXXXGFVFLXXXXXXXXXXXPSPTFFGXXXXXXXXXXXXXXXXXPVXXXXXXXXXXXLKPKFFGFLESPGLIPSQWTTHLFFIQGPMLSPALGIPFKNLLEYFLXXXXXXXDLHFSSIMGKK

SEQ ID NO: 27315 - protein, 37 aa, Diabrotica virgifera
  misc_feature: Coding regions on vcDNA: vcDNA=SeqID_7012; Strand=-; Position=0-110
  misc_feature (8)..(19): Xaa can be any naturally occurring amino acid
NQHEFHAXXXXXXXXXXXXYSFFLGGLCASVEKENLP

SEQ ID NO: 27316 - protein, 229 aa, Diabrotica virgifera
  misc_feature: Coding regions on vcDNA: vcDNA=SeqID_7013; Strand=+; Position=1-690
  misc_feature: Homolog annotation: Hit_ID=XP_313961.1; Match level="QueryCoverage =95%, HitCoverage=6%, E-value=1e-30, Identity=33%"; Hit description =ENSANGP00000003439 [Anopheles gambiae]
  misc_feature: Gene Ontology Annotation: Molecular function=intracellular transporter activity; Cellular component=intracellular; Biological process=Golgi to endosome transport
  misc_feature (52)..(60): Xaa can be any naturally occurring amino acid
IPPDSNLEQIADVAQSRLTDFKEMSSLGLQYAVEKRPLVDLNVDLQAPILLXXXXXXXXXNENILLVNLGRVKVFSYGRRCTATEVKRLNEEGKTQAEIFAFMKEHSYDNFKLELTNVQILAAERGENWSEALTTGKSKMHILNPVSLSITFSTCLITDDPRLPLNKVAGVIPSIDLVISDARLLLVIGLFTSIKFPGDEIPEAQPLRKAASSTLLLKYKEMQATGQKY

SEQ ID NO: 27317 - protein, 72 aa, Diabrotica virgifera
  misc_feature: Coding regions on vcDNA: vcDNA=SeqID_7014; Strand=-; Position=176-394
IRHSITPLLPVAIQTKKLPFFTLICQQLSFSSELRREFLYLQCTRYTVPKKSICNLACNLDILIVGISDITK

SEQ ID NO: 27318 - protein, 71 aa, Diabrotica virgifera
  misc_feature: Coding regions on vcDNA: vcDNA=SeqID_7015; Strand=+; Position=520-735
ALMEKSQYYCKRCQCQKHLFSDILLKTKQYMDSSTSNLFFYGQGLQNIHFFCVAIFIKNYRYCLFVITHSL

SEQ ID NO: 27319 - protein, 44 aa, Diabrotica virgifera
  misc_feature: Coding regions on vcDNA: vcDNA=SeqID_7016; Strand=+; Position=3-134
LSYICLLLYLTLCGLQLGLLLSKFSTTKTGLSEADMVTHSSPKT

SEQ ID NO: 27320 - protein, 149 aa, Diabrotica virgifera
  misc_feature: Coding regions on vcDNA: vcDNA=SeqID_7017; Strand=+; Position=3-452
  misc_feature: Homolog annotation: Hit_ID=XP_392124.1; Match level="QueryCoverage =58%, HitCoverage=6%, E-value=5e-44, Identity=97%"; Hit description =similar to ENSANGP00000016735 [Apis mellifera]
  misc_feature: Gene Ontology Annotation: Molecular function=1-phosphatidylinositol-4- phosphate 5-kinase activity; Cellular component=cellular_component unknown; Biological process=peripheral nervous system development
RRVGVGGEITYKKIQSTQIMGSIQLGIQHAVGGLASKPERDLLMQDFMTVETTNFPSEGSNHTPAHHYSEFKFKNYAPIAFRYFRDLLMQDFMTVETTNFPSEGSNHTPVHHYSEFKFKNYAPIAFRYFRELFGIQPDDFFDVTGEQRD

SEQ ID NO: 27321 - protein, 109 aa, Diabrotica virgifera
  misc_feature: Coding regions on vcDNA: vcDNA=SeqID_7018; Strand=-; Position=822-1151
  misc_feature (19)..(26): Xaa can be any naturally occurring amino acid
  misc_feature (43)..(50): Xaa can be any naturally occurring amino acid
  misc_feature (59)..(68): Xaa can be any naturally occurring amino acid
GGKNCFPFFYIVCARFMGXXXXXXXXSFFPQKGFFVFYKCWCXXXXXXXXSAHQPLTNXXXXXXXXXXQIWLKWGTKGMGTKMRIPLIPPQLFQCQILFFNVAILKLRV

SEQ ID NO: 27322 - protein, 59 aa, Diabrotica virgifera
  misc_feature: Coding regions on vcDNA: vcDNA=SeqID_7019; Strand=-; Position=2-178
  misc_feature (4)..(10): Xaa can be any naturally occurring amino acid
  misc_feature (48)..(48): Xaa can be any naturally occurring amino acid
SLVXXXXXXXLFFKLHQKHFLLARVHPGAIFLLLPRSKDKVKGPPPAXGGWLSALLKGE

SEQ ID NO: 27323 - protein, 70 aa, Diabrotica virgifera
  misc_feature: Coding regions on vcDNA: vcDNA=SeqID_7020; Strand=-; Position=746-958
  misc_feature (11)..(23): Xaa can be any naturally occurring amino acid
WSFPRWGFFPXXXXXXXXXXXXXGPGGFQGLSQGEWCKISIASPFTDDMVLIADSRLGLQRLHGQGQLDL

SEQ ID NO: 27324 - protein, 306 aa, Diabrotica virgifera
  misc_feature: Coding regions on vcDNA: vcDNA=SeqID_7021; Strand=+; Position=1-918
  misc_feature (2)..(280): Xaa can be any naturally occurring amino acid
  misc_feature (282)..(294): Xaa can be any naturally occurring amino acid
  misc_feature (301)..(305): Xaa can be any naturally occurring amino acid
IXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTXXXXXXXXXXXXXCDLDVGXXXXXG

SEQ ID NO: 27325 - protein, 128 aa, Diabrotica virgifera
  misc_feature: Coding regions on vcDNA: vcDNA=SeqID_7022; Strand=+; Position=1-384
  misc_feature: Homolog annotation: Hit_ID=ZP_00151252.1; Match level="QueryCoverage =100%, HitCoverage=13%, E-value=4e-35, Identity=55%"; Hit description= COG3501: Uncharacterized protein conserved in bacteria [Dechloromonas aromatica RCB]
ADANHPGTLSGWHSQGLDGQGHSQWLFDDTAGQVRTRLSSSIAASQLGLGYLVKQGADEASRGQWRGTGFELRSDAWTVVRSGQGMLLSANARESAASTQADTREALALMRGAKNAAQRISDAATQRQ

SEQ ID NO: 27326 - protein, 257 aa, Diabrotica virgifera
  misc_feature: Coding regions on vcDNA: vcDNA=SeqID_7023; Strand=+; Position=39-809
  misc_feature: Homolog annotation: Hit_ID=AAH79701.1; Match level="QueryCoverage =99%, HitCoverage=20%, E-value=1e-110, Identity=75%"; Hit description= MGC81010 protein [Xenopus laevis]
  misc_feature: Gene Ontology Annotation: Molecular function=chromatin binding; Cellular component=dosage compensation complex (sensu Drosophila); Biological process=dosage compensation, by hyperactivation of X chromosome
  misc_feature: Pfam annotation: Pfam_ID=Helicase_C; Match level="Score=61.6, E-value= 2.2e-15, Copies=1"; Pfam description=Helicase conserved C-terminal domain
  misc_feature (219)..(226): Xaa can be any naturally occurring amino acid
GNYSDLTRNVMSRLNEKEVSFELLEALLDYIKTQSIPGAVLVFLPGWNLIFAMMKHLQNHPVYGGSQYSILPLHSQIPREDQKRVFQPVPDHVTKVILATNIAETSITINDVVFVIDSCKAKMKMFTSHNNMTSYATVWASRTNLEQRKGRAGRVRPGICFHLCSKARFDKLDEHMTPEMFRTPLHELALSIKLLRLGSIGHFLSKAIEPPPLDAVIEXXXXXXXXKCLDQNDELTPLGRIIAKLPIEPRLGKMMVL

SEQ ID NO: 27327 - protein, 59 aa, Diabrotica virgifera
  misc_feature: Coding regions on vcDNA: vcDNA=SeqID_7024; Strand=+; Position=8-187
RLVELPVIVKRSDSVSRPAPNGTSITDMNSIEDARSREPRFESTTDRVASGRPARLPHT

SEQ ID NO: 27328 - protein, 64 aa, Diabrotica virgifera
  misc_feature: Coding regions on vcDNA: vcDNA=SeqID_7025; Strand=+; Position=70-261
  misc_feature: Homolog annotation: Hit_ID=NP_523396.1; Match level="QueryCoverage =89%, HitCoverage=21%, E-value=6e-09, Identity=61%"; Hit description =CG7113-PA [Drosophila melanogaster] gb|AAF48797.1| CG7113-PA [Drosophila melanogaster]
MTKGAVSLVTGGASGLRTATVETLALQGCTVPLCDSPASKGKEPASTIGAHKVLFAPRKPLFTD

SEQ ID NO: 27329 - protein, 93 aa, Diabrotica virgifera
  misc_feature: Coding regions on vcDNA: vcDNA=SeqID_7026; Strand=+; Position=463-744
  misc_feature (25)..(55): Xaa can be any naturally occurring amino acid
RYGTHPRPRNRNEYTLNPLTRINWXXXXXXXXXXXXXXXXXXXXXXXXXXXXXXXSHVAGSSYAVSTGVSWDVLPVGLARKGGPTQSRRGALD

SEQ ID NO: 27330 - protein, 94 aa, Diabrotica virgifera
  misc_feature: Coding regions on vcDNA: vcDNA=SeqID_7027; Strand=+; Position=117-401
  misc_feature (4)..(10): Xaa can be any naturally occurring amino acid
PHKXXXXXXXCVIVLGRININWSLPTDDKKKAYYRSLPRINFSQADAKNTDVIYTLFTNSSPTEGQIVNKDTSNSIITEKNIPTCTNNARMDYR

SEQ ID NO: 27331 - protein, 281 aa, Diabrotica virgifera
  misc_feature: Coding regions on vcDNA: vcDNA=SeqID_7028; Strand=+; Position=1-843
  misc_feature: Homolog annotation: Hit_ID=XP_317322.1; Match level="QueryCoverage =100%, HitCoverage=18%, E-value=1e-104, Identity=62%"; Hit description=ENSANGP00000010415 [Anopheles gambiae]
  misc_feature: Gene Ontology Annotation: Molecular function=transmembrane receptor activity; Cellular component=integral to membrane; Biological process=intracellular protein transport
LDQELSMPEDSFVLKYFKYLNEYLSMGPPVYFVVKGGLNYSDVKAQNLICTGRYCKSNSVVAQIYAASKDPEDTYIAKPSSSWIDDYFDWAENDKCCKKYANDSSFCPHNTKGFVCKMCNIKFQGVENRPVPEDFQRYVSFFLRDNPDENCPKGGHAAYGQGVNYKTNATTKLSTVGASYFMTYHTILKSSEDYYESMRSSRKIAANLTDTIGVEVFPYSVFYVFYEQYLTMWSDTLFSVGISLLAIFVVTFFLMGFDIFSSIVVIITITMILVNLGGLMY

SEQ ID NO: 27332 - protein, 236 aa, Diabrotica virgifera
  misc_feature: Coding regions on vcDNA: vcDNA=SeqID_7029; Strand=+; Position=92-797
  misc_feature: Homolog annotation: Hit_ID=XP_313929.1; Match level="QueryCoverage =88%, HitCoverage=79%, E-value=1e-69, Identity=58%"; Hit description =ENSANGP00000021775 [Anopheles gambiae]
  misc_feature: Gene Ontology Annotation: Biological process=regulation of CDK activity
  misc_feature: Pfam annotation: Pfam_ID=Cyclin_N; Match level="Score=35.8, E-value =1.3e-07, Copies=1"; Pfam description=Cyclin, N-terminal domain
  misc_feature (140)..(140): Xaa can be any naturally occurring amino acid
  misc_feature (158)..(158): Xaa can be any naturally occurring amino acid
  misc_feature (209)..(209): Xaa can be any naturally occurring amino acid
MKDVIDVMELQREKSRKNLEFNNGYTAARFIFECGIKLNGQPLTVATAAIIMHRFFKEVDPTNYDPFLIASSALYLAGKVKDDPLKIRDIINVAHNTLHRGSSLLEIGDEYWSMRDAIVQAELLIMRILKFEVSTTHPHXKFMLHYLRSMEGWLGKEXWKSVPVARAAATFLQDYHHDPSILDYDPRHVAIACISLSLQCYGIQLPPYXKTPDDEAWYNIFVKDLPKEKHCEIMEK

SEQ ID NO: 27333 - protein, 172 aa, Diabrotica virgifera
  misc_feature: Coding regions on vcDNA: vcDNA=SeqID_7030; Strand=+; Position=2-520
  misc_feature: Homolog annotation: Hit_ID=T30319; Match level="QueryCoverage=94%, HitCoverage=13%, E-value=3e-23, Identity=32%"; Hit description=Lian -Aa1 retrotransposition protein - yellow fever mosquito gb|AAB65093.1| Lian-Aa1
  misc_feature (22)..(22): Xaa can be any naturally occurring amino acid
REELDTLAEHNEVKLIWVPGHXGIAGNEKADELARRGSATRYFGPEPALGVPRSTIRDRIRGWIRRQYKEYWEEITTQKHAKRFIPQTCAKRAEELFKMNRNQLKITTGFLTGHFPVKGHLHTIRLYNGDLSCRLCNRETETVRHLLCDCEALDRKRQAIYGDCRPSPTVYG

SEQ ID NO: 27334 - protein, 224 aa, Diabrotica virgifera
  misc_feature: Coding regions on vcDNA: vcDNA=SeqID_7031; Strand=+; Position=170-846
  misc_feature: Homolog annotation: Hit_ID=AAF87761.1; Match level="QueryCoverage =80%, HitCoverage=40%, E-value=4e-50, Identity=61%"; Hit description =cytochrome oxidase subunit I [Diabrotica viridula]
  misc_feature: Pfam annotation: Pfam_ID=COX1; Match level="Score=-220.5, E-value =0.00093, Copies=1"; Pfam description=Cytochrome C and Quinol oxidase polyp
  misc_feature (29)..(29): Xaa can be any naturally occurring amino acid
  misc_feature (59)..(59): Xaa can be any naturally occurring amino acid
  misc_feature (74)..(74): Xaa can be any naturally occurring amino acid
  misc_feature (82)..(82): Xaa can be any naturally occurring amino acid
  misc_feature (86)..(86): Xaa can be any naturally occurring amino acid
  misc_feature (121)..(121): Xaa can be any naturally occurring amino acid
  misc_feature (171)..(171): Xaa can be any naturally occurring amino acid
  misc_feature (183)..(183): Xaa can be any naturally occurring amino acid
HRYTYYICRIWKLILHPYYLAAPLYSIPXTSNIKSGVLPPSLLLVLSSGILQWGVVTAXTVYPPLSSSIAPEGXQVDSSYFXLHYXAGISCNLYGAINFITTVISIPPRGITFDRIPRLVXGAVSTALRLLLSLPVLPGAITILLTDRNLNTSFFDPAVGGDRILYQHLFXFFGPTEPYILIXPGFALISRIGRQFWYFRDNLCYNSQLAYYSLLLELIIYLQL

SEQ ID NO: 27335 - protein, 88 aa, Diabrotica virgifera
  misc_feature: Coding regions on vcDNA: vcDNA=SeqID_7032; Strand=-; Position=640-906
  misc_feature (20)..(20): Xaa can be any naturally occurring amino acid
  misc_feature (41)..(41): Xaa can be any naturally occurring amino acid
GTRCLQNPNVYRHVHRNSFXCFSVVVSPARRGKLNLNFIAXIILYCFLKYLATNQFEFVYYYCIALMEKFRFLSILAIRRDKLYKQVL

SEQ ID NO: 27336 - protein, 32 aa, Diabrotica virgifera
  misc_feature: Coding regions on vcDNA: vcDNA=SeqID_7033; Strand=-; Position=0-95
  misc_feature (12)..(12): Xaa can be any naturally occurring amino acid
FSPACVLCLGGXVGAKGRRVLACVGLVLSKGR

SEQ ID NO: 27337 - protein, 104 aa, Diabrotica virgifera
  misc_feature: Coding regions on vcDNA: vcDNA=SeqID_7034; Strand=+; Position=245-559
  misc_feature: Homolog annotation: Hit_ID=XP_394511.1; Match level="QueryCoverage =84%, HitCoverage=4%, E-value=5e-20, Identity=55%"; Hit description =similar to echinus [Apis mellifera]
MKKRDEMESIAPEQIAEELREVEMLNAVVQKTLNQQSDSGLNEDNRRRLSKKKSVSFCDQVILVATADEQEDDRFIPNPILERVLRTAMNKPETAAIRQEIISL

SEQ ID NO: 27338 - protein, 39 aa, Diabrotica virgifera
  misc_feature: Coding regions on vcDNA: vcDNA=SeqID_7035; Strand=-; Position=2-118
SVTVFRYTIVVLFVCMHSDVIREKGRERLRSRPTRPKKR

SEQ ID NO: 27339 - protein, 60 aa, Diabrotica virgifera
  misc_feature: Coding regions on vcDNA: vcDNA=SeqID_7036; Strand=+; Position=101-280
CKTIISYFIRKTGSRYISLLNELKMLEKSVLISKNYSMLKYINRLLTLASPDDTKARTLF

SEQ ID NO: 27340 - protein, 111 aa, Diabrotica virgifera
  misc_feature: Coding regions on vcDNA: vcDNA=SeqID_7037; Strand=+; Position=1-336
  misc_feature (25)..(49): Xaa can be any naturally occurring amino acid
VKTNVDVFATIISSMFTPNYTYQRXXXXXXXXXXXXXXXXXXXXXXXXXGHCLTMELLSIVRSIEHNLLGGLLLVGKSLRGVLPLRVVSLALIDCPYCLVANPIVGEQPDL

SEQ ID NO: 27341 - protein, 161 aa, Diabrotica virgifera
  misc_feature: Coding regions on vcDNA: vcDNA=SeqID_7038; Strand=+; Position=78-563
  misc_feature: Homolog annotation: Hit_ID=CAB63528.1; Match level="QueryCoverage =80%, HitCoverage=85%, E-value=5e-47, Identity=72%"; Hit description =EG:BACH59J11.1 [Drosophila melanogaster]
  misc_feature: Gene Ontology Annotation: Molecular function=molecular_function unknown; Cellular component=mitochondrial ribosome; Biological process=mechanosensory behavior
  misc_feature: Pfam annotation: Pfam_ID=Ribosomal_S12; Match level="Score=123.3, E -value=6e-34, Copies=1"; Pfam description=Ribosomal protein S12
MNFLKQLIPKVPVRQTLVSIAKSVVEKKSLTDFSTLLSTQFSALQIQERCASSLYQMHRKGPHIKQRKSRNPFDGRPFMKGVVLKTLIRKPKKPNSANRKCVLVRLSNGKEMIAYIPGIGHNLQEHNIVLCRVGRLQDCPGVKIKCVRGKYDLSHVVINRK

SEQ ID NO: 27342 - protein, 162 aa, Diabrotica virgifera
  misc_feature: Coding regions on vcDNA: vcDNA=SeqID_7039; Strand=+; Position=2-487
  misc_feature (6)..(7): Xaa can be any naturally occurring amino acid
  misc_feature (13)..(13): Xaa can be any naturally occurring amino acid
  misc_feature (20)..(20): Xaa can be any naturally occurring amino acid
  misc_feature (26)..(27): Xaa can be any naturally occurring amino acid
  misc_feature (44)..(44): Xaa can be any naturally occurring amino acid
  misc_feature (59)..(61): Xaa can be any naturally occurring amino acid
  misc_feature (75)..(75): Xaa can be any naturally occurring amino acid
  misc_feature (97)..(97): Xaa can be any naturally occurring amino acid
  misc_feature (101)..(101): Xaa can be any naturally occurring amino acid
  misc_feature (110)..(110): Xaa can be any naturally occurring amino acid
  misc_feature (123)..(123): Xaa can be any naturally occurring amino acid
QRPGKXXRREREXTFKEGGXRERAPXXRRRSRAPRHSTTRTRGXPQPARAARGAARRQXXXRTRTTTTASRGSGXTGPKERDKPGQPQPPATRPQRXTAGXQPPPSSAKXRDEKGERTDSSRXTRAAQTRRKREAATRRTRHTREQPGGGETKGKGEGGQTS

SEQ ID NO: 27343 - protein, 80 aa, Diabrotica virgifera
  misc_feature: Coding regions on vcDNA: vcDNA=SeqID_7040; Strand=+; Position=2-244
LIFFATIKDLMTTATFMVFSSLFEMILELLCTELKLYYLYTPQDHRIERSFRMVVEEYRASLTASPYGVLLTETGATPMV

SEQ ID NO: 27344 - protein, 253 aa, Diabrotica virgifera
  misc_feature: Coding regions on vcDNA: vcDNA=SeqID_7041; Strand=+; Position=13-771
MKGLLIVCLAVLALTSAADKEDKKGKKRSFPAYSGYSSGYSGAVPAVQYNSASQLFGQSSSVYGGGLDSSSQLLGSGYGSGYGSGYGSGFGSGSGVENLNVQTYSQGLQGLQGLQSSQVLGEGQSFQSGQAFEQGYSQGLEGLQGVQGFQGVQGLQSSQVLGEVQGFQSAHAQLPLAQTYSQVQLPVGSTQSVQAQLPAVQSYTHEQHVHPTHSYNYINKAVPVYVPKPVPYEVTKTVQVPTPYKVTVPKPYA

SEQ ID NO: 27345 - protein, 66 aa, Diabrotica virgifera
  misc_feature: Coding regions on vcDNA: vcDNA=SeqID_7042; Strand=+; Position=729-929
  misc_feature (2)..(8): Xaa can be any naturally occurring amino acid
  misc_feature (55)..(55): Xaa can be any naturally occurring amino acid
  misc_feature (66)..(66): Xaa can be any naturally occurring amino acid
VXXXXXXXLYDYRLVNLFGNQRSICLSSSRRCKTTTDEEYIFPFCHILLLIFVIXYFTAAQITTPX

SEQ ID NO: 27346 - protein, 66 aa, Diabrotica virgifera
  misc_feature: Coding regions on vcDNA: vcDNA=SeqID_7043; Strand=+; Position=33-230
  misc_feature (34)..(45): Xaa can be any naturally occurring amino acid
  misc_feature (55)..(63): Xaa can be any naturally occurring amino acid
FFWRGPINNKNCDPHVGIKVYYLGNQVYLLNLFXXXXXXXXXXXXRGEPGWVSFXXXXXXXXXQKG

SEQ ID NO: 27347 - protein, 71 aa, Diabrotica virgifera
  misc_feature: Coding regions on vcDNA: vcDNA=SeqID_7044; Strand=-; Position=104-319
  misc_feature (2)..(48): Xaa can be any naturally occurring amino acid
NXXXXXXXXXXXXXXXXXXXXXXXXXXXXXXXXXXXXXXXXXXXXXXXLVNNILLLSLILIQHRGRKLSYR

SEQ ID NO: 27348 - protein, 240 aa, Diabrotica virgifera
  misc_feature: Coding regions on vcDNA: vcDNA=SeqID_7045; Strand=+; Position=20-742
  misc_feature: Homolog annotation: Hit_ID=EAL39852.1; Match level="QueryCoverage =95%, HitCoverage=73%, E-value=6e-70, Identity=55%"; Hit description =ENSANGP00000027407 [Anopheles gambiae str. PEST] ref|XP_556168.1| ENSANGP00000027407 [Anopheles gambiae st
  misc_feature: Gene Ontology Annotation: Molecular function=molecular_function unknown; Cellular component=integral to membrane; Biological process= biological_process unknown
  misc_feature: Pfam annotation: Pfam_ID=UPF0005; Match level="Score=102.8, E-value =8.6e-28, Copies=1"; Pfam description=Uncharacterised protein family UPF000
METKQDSHDIEAQTVKGFEFNDTSIRRGFIRKVYAILSLQVAITTGVISWFIFHEPTKLYVQRHPVLLLIALVLILVTIIALACCGQLRRQYPANLIFLFIFTIAESFLLGTISSYYDIDVVAIAAGATVIICLGLTVFAFQSRIDFSVCSGILVALSLVILSFGITAIFYQNDKFRLLIAAFIVIFFSIYLVVDTQLIIGGAGKISLSPEEYIFAALNLYLDVINIFLYILLIVGRAAR

SEQ ID NO: 27349 - protein, 250 aa, Diabrotica virgifera
  misc_feature: Coding regions on vcDNA: vcDNA=SeqID_7046; Strand=+; Position=3-755
  misc_feature: Homolog annotation: Hit_ID=EAL32811.1; Match level="QueryCoverage =85%, HitCoverage=65%, E-value=1e-15, Identity=27%"; Hit description =GA10373-PA [Drosophila pseudoobscura]
  misc_feature: Gene Ontology Annotation: Biological process=eggshell formation (sensu Insecta)
ENKQAEVETTVLKFAGTIPTKETTLGHLKTRPLPISEDLKSDIKKHTVNLTDKLRLQHKEASKNSRYKIVNLHRPNLDSSDKETDDKFTILDVETDINENSSQAVNKNDTEEQKYVYDLYYTNSDKLCEREIEEYVSIYPLNDSLLMGSARDNGLDESDSEDSEDSNAESNWRNEYPDEDDMESINEDDMVEAMKNVDLDDLSSDSEDHIYSAGSDDEYHDAVDDADVNMYGKRYAAFKAKHKHGVCRDY

SEQ ID NO: 27350 - protein, 374 aa, Diabrotica virgifera
  misc_feature: Coding regions on vcDNA: vcDNA=SeqID_7047; Strand=-; Position=2-1123
  misc_feature (2)..(16): Xaa can be any naturally occurring amino acid
  misc_feature (28)..(34): Xaa can be any naturally occurring amino acid
  misc_feature (57)..(64): Xaa can be any naturally occurring amino acid
  misc_feature (66)..(71): Xaa can be any naturally occurring amino acid
  misc_feature (78)..(131): Xaa can be any naturally occurring amino acid
  misc_feature (133)..(176): Xaa can be any naturally occurring amino acid
  misc_feature (179)..(374): Xaa can be any naturally occurring amino acid
PXXXXXXXXXXXXXXXPGPPPGFKPQYXXXXXXXGTDFKKNRFSPQLKILNPTLGGXXXXXXXXTXXXXXXAVIPKGXXXXXXXXXXXXXXXXXXXXXXXXXXXXXXXXXXXXXXXXXXXXXXXXXXXXXXFXXXXXXXXXXXXXXXXXXXXXXXXXXXXXXXXXXXXXXXXXXXXIMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27351 - protein, 252 aa, Diabrotica virgifera
  misc_feature: Coding regions on vcDNA: vcDNA=SeqID_7048; Strand=+; Position=3-759
  misc_feature: Homolog annotation: Hit_ID=XP_317312.1; Match level="QueryCoverage =100%, HitCoverage=22%, E-value=2e-70, Identity=57%"; Hit description= ENSANGP00000006850 [Anopheles gambiae]
  misc_feature: Gene Ontology Annotation: Molecular function=DNA-directed RNA polymerase activity; Cellular component=DNA-directed RNA polymerase III complex; Biological process=transcription from Pol III promoter
  misc_feature: Pfam annotation: Pfam_ID=RNA_pol_Rpb2_3; Match level="Score=50.9, E -value=3.6e-12, Copies=1"; Pfam description=RNA polymerase Rpb2, domain 3
  misc_feature (9)..(9): Xaa can be any naturally occurring amino acid
  misc_feature (85)..(85): Xaa can be any naturally occurring amino acid
  misc_feature (114)..(114): Xaa can be any naturally occurring amino acid
  misc_feature (150)..(150): Xaa can be any naturally occurring amino acid
  misc_feature (175)..(175): Xaa can be any naturally occurring amino acid
  misc_feature (191)..(191): Xaa can be any naturally occurring amino acid
ADEALDLLXTTVLAHVPVEEYNFRLKAIYLRLMIHKDIEAQNHSQLLDDRNYYGNKRLKLNGSLISLMFEYVIQKRSTVELTAIXHKRPVPEITATQFDVIKYMRSDLITSCLXFAISTLNWTIQRFRMERLGVTRALSRMSYISALCMXTRENSQLEKTRKVSSPTCLHSTQRXMLCPSDTPEGESCGLXTNMAWMTHITTESDQFPLIILSRNAGVDDLNKDASFAIHSPSTCIAFLDGSILLISNHYRK

SEQ ID NO: 27352 - protein, 90 aa, Diabrotica virgifera
  misc_feature: Coding regions on vcDNA: vcDNA=SeqID_7049; Strand=-; Position=3-272
  misc_feature (14)..(23): Xaa can be any naturally occurring amino acid
  misc_feature (28)..(37): Xaa can be any naturally occurring amino acid
  misc_feature (53)..(53): Xaa can be any naturally occurring amino acid
  misc_feature (57)..(70): Xaa can be any naturally occurring amino acid
  misc_feature (77)..(89): Xaa can be any naturally occurring amino acid
IFLVFEDCLVKYYXXXXXXXXXXGPFVXXXXXXXXXXTQPGSHRFKLRSCKIXKVEXXXXXXXXXXXXXXSNIEVAXXXXXXXXXXXXXC

SEQ ID NO: 27353 - protein, 95 aa, Diabrotica virgifera
  misc_feature: Coding regions on vcDNA: vcDNA=SeqID_7050; Strand=+; Position=235-522
  misc_feature (69)..(79): Xaa can be any naturally occurring amino acid
IKSMCFISPGINDARVKNCGLKCTKVVPKFMNNIGALLKVHDHFFGIWNHSVAYKKWSRSCQDLEYYKXXXXXXXXXXXVYRVSPKMVRSFEVWI

SEQ ID NO: 27354 - protein, 31 aa, Diabrotica virgifera
  misc_feature: Coding regions on vcDNA: vcDNA=SeqID_7051; Strand=+; Position=1-93
FSASLFSDFACIDLLGAFNVIYLPPKVDNTV

SEQ ID NO: 27355 - protein, 285 aa, Diabrotica virgifera
  misc_feature: Coding regions on vcDNA: vcDNA=SeqID_7052; Strand=+; Position=108-965
MMLLKRCCVVLIILSSTIDESQSIIASRSLRSGFRRTSLGTHISSLGSRSRSRLSGSSFVVSGSRGSLFRSSGSRGSPFRSGSPGSSSSGSFNSSFGSHETSFASGSSSQDSSSSLGSSGTYRWSITAKPVTSRPVHRFDPVTSRFQTVTNRTQPASSRFHTAAPVKPVTSRPASRFDPVTSRFQPVNNRTQPASSRFHTATPTKPVTSRPVPRFDPVTSRFQPVTNRIQPALSRFHTAPPLRTYSRHLVLNPNFNAAPSKDIISPSRNATTKPAFNSSFTHLHS

SEQ ID NO: 27356 - protein, 31 aa, Diabrotica virgifera
  misc_feature: Coding regions on vcDNA: vcDNA=SeqID_7053; Strand=+; Position=2-94
FVRLTIFHIKYLFPICICDWTKKLQTYTNRS

SEQ ID NO: 27357 - protein, 92 aa, Diabrotica virgifera
  misc_feature: Coding regions on vcDNA: vcDNA=SeqID_7054; Strand=-; Position=40-318
DEPLATLRCVSRPHAYPVSLRDGQPVPPEVASRICATFLLHALVGARVAIKSAPAITSSHPFPTKPPTFPSFPVLLLEEKPQKHRFQNRKNA

SEQ ID NO: 27358 - protein, 222 aa, Diabrotica virgifera
  misc_feature: Coding regions on vcDNA: vcDNA=SeqID_7055; Strand=+; Position=3-668
  misc_feature (1)..(29): Xaa can be any naturally occurring amino acid
  misc_feature (31)..(37): Xaa can be any naturally occurring amino acid
  misc_feature (41)..(50): Xaa can be any naturally occurring amino acid
  misc_feature (52)..(79): Xaa can be any naturally occurring amino acid
  misc_feature (85)..(106): Xaa can be any naturally occurring amino acid
  misc_feature (109)..(139): Xaa can be any naturally occurring amino acid
  misc_feature (153)..(159): Xaa can be any naturally occurring amino acid
  misc_feature (181)..(187): Xaa can be any naturally occurring amino acid
  misc_feature (200)..(217): Xaa can be any naturally occurring amino acid
XXXXXXXXXXXXXXXXXXXXXXXXXXXXXPXXXXXXXNIIXXXXXXXXXXGXXXXXXXXXXXXXXXXXXXXXXXXXXXXKNPIKXXXXXXXXXXXXXXXXXXXXXXGGXXXXXXXXXXXXXXXXXXXXXXXXXXXXXXXLGEHGGIFLGEVQXXXXXXXPRGGIKFFKWGVNPLFLKLCSXXXXXXXYSGVLNAGGGPGXXXXXXXXXXXXXXXXXXKRGAH

SEQ ID NO: 27359 - protein, 162 aa, Diabrotica virgifera
  misc_feature: Coding regions on vcDNA: vcDNA=SeqID_7056; Strand=+; Position=58-546
  misc_feature: Homolog annotation: Hit_ID=NP_723361.1; Match level="QueryCoverage =78%, HitCoverage=64%, E-value=5e-22, Identity=39%"; Hit description =CG8409-PB, isoform B [Drosophila melanogaster] ref|NP_476755.1| CG8409-PA, isoform A [Drosophila
  misc_feature: Gene Ontology Annotation: Molecular function=lamin/chromatin binding; Cellular component=nuclear membrane; Biological process=eggshell pattern formation (sensu Insecta)
  misc_feature: Pfam annotation: Pfam_ID=Chromo; Match level="Score=84.0, E-value=4e -22, Copies=1"; Pfam description='chromo' (CHRromatin Organisation MOdi
  misc_feature (72)..(78): Xaa can be any naturally occurring amino acid
  misc_feature (93)..(103): Xaa can be any naturally occurring amino acid
MGKKKVQESESEEEYSVEKIIDRRVVDGKVQYYLKWKGYSQDDNTWEPEDNLDCPELISEFERNRKSKKAAXXXXXXXRDNSTSSVDSNNSSXXXXXXXXXXXRSPSPESESEPSSKKSKIDDSDDDKKSKKKSSSKDADSDDALDDDSDDEKSKKSKKKRF

SEQ ID NO: 27360 - protein, 63 aa, Diabrotica virgifera
  misc_feature: Coding regions on vcDNA: vcDNA=SeqID_7057; Strand=+; Position=390-581
ISLLSNIMKHKQHIKLILKVFLVMLYFISFWCNKPQPIKFNIKIGNDCVTKIISSLQLIFHPR

SEQ ID NO: 27361 - protein, 180 aa, Diabrotica virgifera
  misc_feature: Coding regions on vcDNA: vcDNA=SeqID_7058; Strand=+; Position=137-680
  misc_feature: Homolog annotation: Hit_ID=EAL28906.1; Match level="QueryCoverage =97%, HitCoverage=70%, E-value=5e-47, Identity=53%"; Hit description =GA10033-PA [Drosophila pseudoobscura]
  misc_feature: Pfam annotation: Pfam_ID=DTW; Match level="Score=76.1, E-value=9.2e -20, Copies=1"; Pfam description=DTW domain
  misc_feature (165)..(165): Xaa can be any naturally occurring amino acid
MIEEELDALSDLASIHADPPVMRDICSKCHRPSTVCYCKWIPVPPMCPKSSIILLQHPAEEKRCLRTATMLQLGLDSSKCLVFKGKRFPGKYNILEDILTASNTLLLYPSKTAVDIREVLRENSHKFYNIVLIDGTWAQAKAIYTGSSILHNIKQIKILHNDTSXYIIRNQPTDGWLKAI

SEQ ID NO: 27362 - protein, 52 aa, Diabrotica virgifera
  misc_feature: Coding regions on vcDNA: vcDNA=SeqID_7059; Strand=-; Position=1-156
  misc_feature (1)..(51): Xaa can be any naturally occurring amino acid
XXXXXXXXXXXXXXXXXXXXXXXXXXXXXXXXXXXXXXXXXXXXXXXXXXXK

SEQ ID NO: 27363 - protein, 94 aa, Diabrotica virgifera
  misc_feature: Coding regions on vcDNA: vcDNA=SeqID_7060; Strand=+; Position=17-301
LSFFPCLCFPLYFFICLFQYFSPHLSLLRFPLTSLYNMRENSVTRGKRRKQKENNFCLFLPLFHLRFLTTLLLLYMGEFTPWTFLIIFEEFPSE

SEQ ID NO: 27364 - protein, 305 aa, Diabrotica virgifera
  misc_feature: Coding regions on vcDNA: vcDNA=SeqID_7061; Strand=+; Position=55-969
  misc_feature: Homolog annotation: Hit_ID=NP_610309.1; Match level="QueryCoverage =73%, HitCoverage=74%, E-value=2e-35, Identity=38%"; Hit description =CG2065-PA [Drosophila melanogaster] gb|AAF59213.1| CG2065-PA [Drosophila melanogaster]
  misc_feature: Gene Ontology Annotation: Molecular function=electron transporter activity; Cellular component=mitochondrion; Biological process =induction of apoptosis
  misc_feature: Pfam annotation: Pfam_ID=adh_short; Match level="Score=58.7, E-value =1.7e-14, Copies=1"; Pfam description=short chain dehydrogenase
MWLVVLLSIFGCILSIVVLFLFLLWLYVHFEYVACTSDVCLVGKTALVTGGSKGIGYDIVLQLASRGCKVIIASRTIDEKLRQQIIWETNNPNIVLEHVNMSSFKSVRQLASRLNESESKLDILINNAGIPQCLDVPTEDGLNETMQVNHFSAFLLTHLLVDLLKKSAGARVIFTGSFLSYFHMMSRVSVRDFKIENAMFRIFDYPNSKFCNIISADMFAVKLKRWNITCNSYQPGIVKTEIFNTAKELKSLFDILLFYSTIYLFAKFGVKQESLARAPFIAHKEFECNRKIFVGRYFNNVRPRA

SEQ ID NO: 27365 - protein, 64 aa, Diabrotica virgifera
  misc_feature: Coding regions on vcDNA: vcDNA=SeqID_7062; Strand=+; Position=201-392
MRHPIKTSIPDPKPIAATAITYGLSLDRCLSSTDLGAPPIPPGRSHHESRQMRRILWKDFHRKM

SEQ ID NO: 27366 - protein, 182 aa, Diabrotica virgifera
  misc_feature: Coding regions on vcDNA: vcDNA=SeqID_7063; Strand=+; Position=1-549
  misc_feature: Homolog annotation: Hit_ID=XP_393988.1; Match level="QueryCoverage =84%, HitCoverage=7%, E-value=3e-12, Identity=34%"; Hit description =similar to ENSANGP00000003674 [Apis mellifera]
  misc_feature: Gene Ontology Annotation: Molecular function=transmembrane receptor activity; Cellular component=membrane fraction; Biological process =Rho protein signal transduction
VSKSFIFENTTVSESTESSVDDKLFSTTILDESKTTEKLTTGQHETLADTSTEMKTEPERTTEVSTESVHETTVFEAVTTENYVKVKSVFTVPTVQTTTTVLPEISSASTKSISTASTTSSPTPPSVLTEISSSTSSTLFSTASTTSPTTTQLQDLQLPSRLGLIHQQPNLGITLMIWVEPL

SEQ ID NO: 27367 - protein, 106 aa, Diabrotica virgifera
  misc_feature: Coding regions on vcDNA: vcDNA=SeqID_7064; Strand=-; Position=4-324
  misc_feature (4)..(14): Xaa can be any naturally occurring amino acid
  misc_feature (20)..(26): Xaa can be any naturally occurring amino acid
  misc_feature (60)..(106): Xaa can be any naturally occurring amino acid
WDLXXXXXXXXXXXNVIIIXXXXXXXREGINQNLDGIINRPNTVLNQFIGKLKLDVGSKXXXXXXXXXXXXXXXXXXXXXXXXXXXXXXXXXXXXXXXXXXXXXXX

SEQ ID NO: 27368 - protein, 50 aa, Diabrotica virgifera
  misc_feature: Coding regions on vcDNA: vcDNA=SeqID_7065; Strand=-; Position=2-151
  misc_feature (32)..(48): Xaa can be any naturally occurring amino acid
TACWPNSMSLYRSTTPDPPSASHRERAQARDXXXXXXXXXXXXXXXXXER

SEQ ID NO: 27369 - protein, 95 aa, Diabrotica virgifera
  misc_feature: Coding regions on vcDNA: vcDNA=SeqID_7066; Strand=-; Position=45-332
  misc_feature (69)..(93): Xaa can be any naturally occurring amino acid
KLPKIAKFQSKTRLEKMQPSKFKIGIRQQNASSRLPMEQFPSFPFCSQATRVEPSNQCIIKCQACSFLXXXXXXXXXXXXXXXXXXXXXXXXXSK

SEQ ID NO: 27370 - protein, 246 aa, Diabrotica virgifera
  misc_feature: Coding regions on vcDNA: vcDNA=SeqID_7067; Strand=+; Position=129-866
  misc_feature: Homolog annotation: Hit_ID=AAH65614.1; Match level="QueryCoverage =91%, HitCoverage=66%, E-value=2e-29, Identity=29%"; Hit description =Zgc:56068 protein [Danio rerio]
  misc_feature: Gene Ontology Annotation: Molecular function=molecular_function unknown; Cellular component=cellular_component unknown; Biological process=biological_process unknown
  misc_feature: Pfam annotation: Pfam_ID=GDPD; Match level="Score=6.5, E-value=3.3e -06, Copies=1"; Pfam description=Glycerophosphoryl diester phosphodies
MKPDFLYLIPSALTVVYATYGSWFLIAEIFTTLIPLTLIFTGILVGVVVIFRVPPPEKDTVEAILGKEIDDPTGDNGFVIKTIAHRGAGLDAPENTIEAFKKCHEKGCDVIEIDVVLTSDGVPVVFHDSNLERMADLNIAIKDMKYEDLAKIDISVKHAYRDSFPNSHVPTLEQAVEQMLGMGQRIFIDIKENNNKMVPVILKLFEKFPELKQKAVITSFFPNIIYLIRRNKPEIVGLLAWQPCIF

SEQ ID NO: 27371 - protein, 104 aa, Diabrotica virgifera
  misc_feature: Coding regions on vcDNA: vcDNA=SeqID_7068; Strand=-; Position=172-486
  misc_feature (18)..(25): Xaa can be any naturally occurring amino acid
  misc_feature (27)..(35): Xaa can be any naturally occurring amino acid
  misc_feature (78)..(86): Xaa can be any naturally occurring amino acid
NSLFVFYFIIKLILILPXXXXXXXXNXXXXXXXXXESSVSGFEPGTSAICSRMLYQYPIRALFNTYYLTPEEDKSKDXXXXXXXXXENTNIFFSNLICADTDIT

SEQ ID NO: 27372 - protein, 243 aa, Diabrotica virgifera
  misc_feature: Coding regions on vcDNA: vcDNA=SeqID_7069; Strand=+; Position=119-850
MADRDPYKREQQRLIQLYDDITSDEENSDAAYEGEFSSDENYVPSESSASQSDESEDSDLNELPELSNVETSNNTLHNPQQYNLPEESEVEEPDALDQDSQKIIQKSQDSIPLQALQNQNSDSSDDIDTEWEFTTADIPDFNFDESTNRLKINLNAEDSPKDVFEYLFTDDIMSYLVECTNNYGEDLTRSNRPKTRNARDNSFRPVTIDMKKFLALCLLQGQITTSTCAGCFIWRCIVLSSNF

SEQ ID NO: 27373 - protein, 41 aa, Diabrotica virgifera
  misc_feature: Coding regions on vcDNA: vcDNA=SeqID_7070; Strand=-; Position=1-123
  misc_feature (28)..(38): Xaa can be any naturally occurring amino acid
GGKIWGIFSDVKNPLKITPLGPPHCFFXXXXXXXXXXXANQ

SEQ ID NO: 27374 - protein, 105 aa, Diabrotica virgifera
  misc_feature: Coding regions on vcDNA: vcDNA=SeqID_7071; Strand=-; Position=2-316
AHASILVRHSSRLLMSNSPRHSPTPFLVPSAPHSQCSIPYRHTPTSNATTTPAPPAADDAQTITGSTESTSTCGPFAGSVPSTHTACTFPHKCPYLTPTRAHLSS

SEQ ID NO: 27375 - protein, 81 aa, Diabrotica virgifera
  misc_feature: Coding regions on vcDNA: vcDNA=SeqID_7072; Strand=-; Position=1-243
NYLSFISSHPFVLLSLSCPSSLSPYTFPHHSPLLPSPPLYFLSVSLLLLSPLPSSIPSRGILFTSLSLFFSTSFLSLPSTS

SEQ ID NO: 27376 - protein, 124 aa, Diabrotica virgifera
  misc_feature: Coding regions on vcDNA: vcDNA=SeqID_7073; Strand=+; Position=333-707
  misc_feature (110)..(121): Xaa can be any naturally occurring amino acid
SKDDSNLITEQGLHYVFICMYFGFNVASSEHQVPRRCKRNKIFFVCFIKKTIPKCTNVSNLNINTNQFIKIAYNKLTHNTPNGENTGSSYTNGLVCIIKYAFSSSSGANXXXXXXXXXXXXRQL

SEQ ID NO: 27377 - protein, 182 aa, Diabrotica virgifera
  misc_feature: Coding regions on vcDNA: vcDNA=SeqID_7074; Strand=+; Position=291-836
  misc_feature: Homolog annotation: Hit_ID=XP_397353.1; Match level="QueryCoverage =52%, HitCoverage=24%, E-value=6e-35, Identity=68%"; Hit description =similar to ENSANGP00000016465 [Apis mellifera]
MRLKRRRRAQVSGWRVMRRCVIFFTAICVIPVLLVLMVATDRYLQPVRRQTQYMHRQVNEVGKIQTGSLLNKNMSLIAKRLENRKRHMKNMCKLLGLDRPGNDSLHKPNSWEFLVDNKHHLIWCNVFKAASTSWMYNFNILAGYSPKFLKKSKLVPMTLARQKYPRPSLKDLRKAFTLPYRF

SEQ ID NO: 27378 - protein, 267 aa, Diabrotica virgifera
  misc_feature: Coding regions on vcDNA: vcDNA=SeqID_7075; Strand=+; Position=2-805
  misc_feature (262)..(262): Xaa can be any naturally occurring amino acid
QPIDEINRKKRMKKRAKPLFKVCHVNQDIGLPNLDKVNKEIKGKPIKTFSTPTVLSFAPANHAFKPSNNMHSVQFAKPVERNRKPNNSLLSSQKPANATKSLIKSESRINVAKNHPRTETRANGNVSKDKSIEPRITQKKPVTQQREIIKKPTNHTKSYTAKTNLFSPQMTANNGQLAKPSQASKNVGWNLHDTFDMSDDICDQKERSGKKYKKTPIKPRNQINKSIEQPTPDEISPIEKKGSGLKKSVGKHVTPNKNISTXHKLTK

SEQ ID NO: 27379 - protein, 182 aa, Diabrotica virgifera
  misc_feature: Coding regions on vcDNA: vcDNA=SeqID_7076; Strand=+; Position=2-547
  misc_feature (1)..(29): Xaa can be any naturally occurring amino acid
  misc_feature (33)..(90): Xaa can be any naturally occurring amino acid
  misc_feature (96)..(111): Xaa can be any naturally occurring amino acid
  misc_feature (138)..(145): Xaa can be any naturally occurring amino acid
  misc_feature (161)..(176): Xaa can be any naturally occurring amino acid
XXXXXXXXXXXXXXXXXXXXXXXXXXXXXRPYXXXXXXXXXXXXXXXXXXXXXXXXXXXXXXXXXXXXXXXXXXXXXXXXXXXXXXXXXXLREKRXXXXXXXXXXXXXXXXDPPRLGIKGLINLGGTTLIFIKDFVPXXXXXXXXDFGSLKTRGGGPQGWXXXXXXXXXXXXXXXXSKRGRP

SEQ ID NO: 27380 - protein, 55 aa, Diabrotica virgifera
  misc_feature: Coding regions on vcDNA: vcDNA=SeqID_7077; Strand=-; Position=0-164
FRGDVFVRRILSSGCWSSPLSVCRSAFSLPRGLALAVFSSASGRRWGRGGGSRPG

SEQ ID NO: 27381 - protein, 54 aa, Diabrotica virgifera
  misc_feature: Coding regions on vcDNA: vcDNA=SeqID_7078; Strand=+; Position=138-302
CIGYLPFLCNGPPILKPNFSRSDDGELSLIHHEYGNDPPDKENHRSYERADNHK

SEQ ID NO: 27382 - protein, 61 aa, Diabrotica virgifera
  misc_feature: Coding regions on vcDNA: vcDNA=SeqID_7079; Strand=-; Position=3-185
  misc_feature (13)..(19): Xaa can be any naturally occurring amino acid
QNPFKKCVLSSGXXXXXXXGKPLQGFFAAFGEANLGSYPPSGPPKVFSSFFFLFPQGFRGG

SEQ ID NO: 27383 - protein, 29 aa, Diabrotica virgifera
  misc_feature: Coding regions on vcDNA: vcDNA=SeqID_7080; Strand=-; Position=1-87
RISVTMLMLLDRGWYQDGVSHVPFSIQAL

SEQ ID NO: 27384 - protein, 91 aa, Diabrotica virgifera
  misc_feature: Coding regions on vcDNA: vcDNA=SeqID_7081; Strand=+; Position=20-295
  misc_feature: Homolog annotation: Hit_ID=XP_321047.1; Match level="QueryCoverage =82%, HitCoverage=63%, E-value=1e-11, Identity=42%"; Hit description =ENSANGP00000011351 [Anopheles gambiae] gb|EAA01460.1| ENSANGP00000011351 [Anopheles gambiae
EVKRKFVIVLVLLLALSLEVDARRKILRGRKTVNRTYLRAAAIPSYVIVILVAIGQMIIGGLFYVILKLCILDKPISPRYQAAPVHSRNGP

SEQ ID NO: 27385 - protein, 77 aa, Diabrotica virgifera
  misc_feature: Coding regions on vcDNA: vcDNA=SeqID_7082; Strand=+; Position=155-385
YKFYDQNGVLIICDLCYKILKDLKDGRRPGRRDILPNIPFTYENHVTSILDGTLKNLSTNVLFTNVGAAENLRRHCG

SEQ ID NO: 27386 - protein, 266 aa, Diabrotica virgifera
  misc_feature: Coding regions on vcDNA: vcDNA=SeqID_7083; Strand=+; Position=1-798
  misc_feature (88)..(264): Xaa can be any naturally occurring amino acid
EKQVIVFCPPSVKKVLNFHLKIEDNDAKVRLDVNIDEFSCFYFVLSFLLYSTGEYVCCEWPSVEVLFSVFFRILSRKYEYWCYGRKYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRL

SEQ ID NO: 27387 - protein, 68 aa, Diabrotica virgifera
  misc_feature: Coding regions on vcDNA: vcDNA=SeqID_7084; Strand=+; Position=171-377
SLGFKSEERGRHSTNNNLPIHLGHSVCKNVSFLLKYCKMSYLELKPFRSLKLFRCTLFLMKIHCNFNM

SEQ ID NO: 27388 - protein, 97 aa, Diabrotica virgifera
  misc_feature: Coding regions on vcDNA: vcDNA=SeqID_7085; Strand=-; Position=3-293
YHFKPSRVRRTIVVPLCIDSQSEDSHVCASLCSCLRVSCRVPVSFAWCRCFLSLSEEVLDDFFFLGCRSGFLQFVGGFSPLRGNTISYMIMGGHKSS

SEQ ID NO: 27389 - protein, 148 aa, Diabrotica virgifera
  misc_feature: Coding regions on vcDNA: vcDNA=SeqID_7086; Strand=-; Position=858-1304
  misc_feature (6)..(22): Xaa can be any naturally occurring amino acid
  misc_feature (29)..(39): Xaa can be any naturally occurring amino acid
  misc_feature (59)..(77): Xaa can be any naturally occurring amino acid
  misc_feature (82)..(88): Xaa can be any naturally occurring amino acid
  misc_feature (102)..(108): Xaa can be any naturally occurring amino acid
  misc_feature (117)..(124): Xaa can be any naturally occurring amino acid
PPPLCXXXXXXXXXXXXXXXXXAAIFVQXXXXXXXXXXXVVVGGGFFTQKRRGDCCWFXXXXXXXXXXXXXXXXXXXKPDHXXXXXXXYEGNIKKSLVSPPXXXXXXXFPIFTQWGXXXXXXXXRLTVPRKGVPKFFSEIIYKFPPPP

SEQ ID NO: 27390 - protein, 197 aa, Diabrotica virgifera
  misc_feature: Coding regions on vcDNA: vcDNA=SeqID_7087; Strand=+; Position=22-615
  misc_feature: Homolog annotation: Hit_ID=EAL33101.1; Match level="QueryCoverage =81%, HitCoverage=80%, E-value=4e-49, Identity=58%"; Hit description =GA19347-PA [Drosophila pseudoobscura]
  misc_feature: Gene Ontology Annotation: Molecular function=molecular_function unknown; Cellular component=cellular_component unknown; Biological process=biological_process unknown
  misc_feature: Pfam annotation: Pfam_ID=RF-1; Match level="Score=25.1, E-value=2.9e -08, Copies=1"; Pfam description=Peptidyl-tRNA hydrolase domain
QGTIELIQHVKIYNLFQSTQVYRPVTSYKSALSLEHLYPNSTLKITTPQPPSSTNEFTGYIPMEELDITYSRSSGPGGQNVNKVNTKVDIRFHLQSAKWLNEKTKQKIAEKFSTQLTKEGYLIFRSDITRSQQLNLADCLEKIRKAVRGALMVPAEPSVESQERARRRLERAAKERLMVKREKSQVKHYRNDSNIVV

SEQ ID NO: 27391 - protein, 76 aa, Diabrotica virgifera
  misc_feature: Coding regions on vcDNA: vcDNA=SeqID_7088; Strand=-; Position=464-694
  misc_feature (37)..(43): Xaa can be any naturally occurring amino acid
  misc_feature (47)..(54): Xaa can be any naturally occurring amino acid
HLRHFKKTPHPKTLISIELPENLFESTSSTTPPHIPXXXXXXXQFSXXXXXXXXTFCTRKTQCNPLKFLDLCYVVS

SEQ ID NO: 27392 - protein, 128 aa, Diabrotica virgifera
  misc_feature: Coding regions on vcDNA: vcDNA=SeqID_7089; Strand=-; Position=1-384
  misc_feature (9)..(24): Xaa can be any naturally occurring amino acid
  misc_feature (28)..(48): Xaa can be any naturally occurring amino acid
  misc_feature (51)..(60): Xaa can be any naturally occurring amino acid
  misc_feature (67)..(106): Xaa can be any naturally occurring amino acid
  misc_feature (108)..(128): Xaa can be any naturally occurring amino acid
KKNKEIEEXXXXXXXXXXXXXXXXRPTXXXXXXXXXXXXXXXXXXXXXEKXXXXXXXXXXAPAARAXXXXXXXXXXXXXXXXXXXXXXXXXXXXXXXXXXXXXXXXCXXXXXXXXXXXXXXXXXXXXX

SEQ ID NO: 27393 - protein, 92 aa, Diabrotica virgifera
  misc_feature: Coding regions on vcDNA: vcDNA=SeqID_7090; Strand=-; Position=54-332
CISSTWTLSSLPAARATSSSKRSVSSDSLPTSGRPIGAFVRSGHVRLLCHKLCDRGYHFSDLFRLRWTQKNTKKRLCVAKNRRYIIPQALCL

SEQ ID NO: 27394 - protein, 120 aa, Diabrotica virgifera
  misc_feature: Coding regions on vcDNA: vcDNA=SeqID_7091; Strand=+; Position=321-683
  misc_feature (4)..(10): Xaa can be any naturally occurring amino acid
  misc_feature (91)..(97): Xaa can be any naturally occurring amino acid
SKKXXXXXXXSWSCHPSSIHGTLGMTTYQNHHQWRYIVCSLSIFNLTSQSSSTLRVSLRRLLFPSTFVCPMSLLPLVSLPFSPDPAKLFAXXXXXXXNFLITKYNNLVFSWLRYIFKISF

SEQ ID NO: 27395 - protein, 22 aa, Diabrotica virgifera
  misc_feature: Coding regions on vcDNA: vcDNA=SeqID_7092; Strand=+; Position=1-66
  misc_feature (3)..(12): Xaa can be any naturally occurring amino acid
ILXXXXXXXXXXLYSDRLLLNF

SEQ ID NO: 27396 - protein, 226 aa, Diabrotica virgifera
  misc_feature: Coding regions on vcDNA: vcDNA=SeqID_7093; Strand=+; Position=62-739
  misc_feature: Homolog annotation: Hit_ID=XP_392693.1; Match level="QueryCoverage =100%, HitCoverage=62%, E-value=1e-101, Identity=75%"; Hit description=similar to ENSANGP00000011676 [Apis mellifera]
  misc_feature: Gene Ontology Annotation: Molecular function=RNA binding; Cellular component=nuclear outer membrane; Biological process=mRNA-nucleus export
  misc_feature: Pfam annotation: Pfam_ID=WD40; Match level="Score=76.2, E-value=9e -20, Copies=3"; Pfam description=WD domain, G-beta repeat
MFNQSGLGTFGAATTPSPANPMKDFEVVSPPEDSISSMAFSPATLPQNFLIAGSWDNNVRCWEIEHNGTSVPKSMQTCGAPVLDVCWSDDGSKVFMAGCDKQAKMWDLASNQVVQVAMHDAPIKTCHWIKASNYSCLMTGSWDKTLKFWDTRSPNPMMSINLPERCYCADVDYPMAVVGTAGRQIIVYQLDSKPQEYRKLDSPLKYQHRCVAIFKDKKKQPTGYAL

SEQ ID NO: 27397 - protein, 211 aa, Diabrotica virgifera
  misc_feature: Coding regions on vcDNA: vcDNA=SeqID_7094; Strand=+; Position=2-638
  misc_feature: Homolog annotation: Hit_ID=XP_394528.1; Match level="QueryCoverage =100%, HitCoverage=39%, E-value=7e-97, Identity=80%"; Hit description= similar to CG4258-PA [Apis mellifera]
  misc_feature: Gene Ontology Annotation: Molecular function=molecular_function unknown; Cellular component=nucleolus; Biological process=rRNA processing
  misc_feature: Pfam annotation: Pfam_ID=KH_1; Match level="Score=14.3, E-value =0.021, Copies=1"; Pfam description=KH domain
  misc_feature (205)..(205): Xaa can be any naturally occurring amino acid
IKARDVIKLMSRSVPFEQAKRVLEDDVGCDIIKIGKITRNKEKFVKRRQRLIGPNGCTLKSIEILTNCYVLVQGQTVSALGPYKGLQQVRKIVEDTMKNIHPIYNIKALMIKRELAKDPKLKNENWERFLPKFVNKNISKRKQPKNKKDKKPYTPFPPAQQESKIDKELATGEYFLNKTQKKAKKQKEKDDKHSEAAKKREEKRXQAFIPP

SEQ ID NO: 27398 - protein, 167 aa, Diabrotica virgifera
  misc_feature: Coding regions on vcDNA: vcDNA=SeqID_7095; Strand=-; Position=3-503
  misc_feature (1)..(11): Xaa can be any naturally occurring amino acid
  misc_feature (16)..(24): Xaa can be any naturally occurring amino acid
  misc_feature (35)..(42): Xaa can be any naturally occurring amino acid
  misc_feature (45)..(51): Xaa can be any naturally occurring amino acid
  misc_feature (64)..(77): Xaa can be any naturally occurring amino acid
  misc_feature (79)..(167): Xaa can be any naturally occurring amino acid
XXXXXXXXXXXSFPYXXXXXXXXXRNQPGSHRFNXXXXXXXXSNXXXXXXXSPIINFNPTSRSXXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27399 - protein, 86 aa, Diabrotica virgifera
  misc_feature: Coding regions on vcDNA: vcDNA=SeqID_7096; Strand=+; Position=2-259
  misc_feature (1)..(16): Xaa can be any naturally occurring amino acid
  misc_feature (19)..(26): Xaa can be any naturally occurring amino acid
  misc_feature (29)..(38): Xaa can be any naturally occurring amino acid
  misc_feature (42)..(55): Xaa can be any naturally occurring amino acid
  misc_feature (58)..(80): Xaa can be any naturally occurring amino acid
XXXXXXXXXXXXXXXXLNXXXXXXXXPYXXXXXXXXXXFFCXXXXXXXXXXXXXXGGXXXXXXXXXXXXXXXXXXXXXXXVLHIFF

SEQ ID NO: 27400 - protein, 19 aa, Diabrotica virgifera
  misc_feature: Coding regions on vcDNA: vcDNA=SeqID_7097; Strand=+; Position=2-58
MQLMVQTQLNHLINHRLIR

SEQ ID NO: 27401 - protein, 78 aa, Diabrotica virgifera
  misc_feature: Coding regions on vcDNA: vcDNA=SeqID_7098; Strand=+; Position=3-239
SCGLWSYAFLVWDFQLEFIYMAGEVGQQTETLRVLLGKKSSKAIPDHHVLPVIKHDNKLYYMGVMFKDRRKNVFQFCQ

SEQ ID NO: 27402 - protein, 61 aa, Diabrotica virgifera
  misc_feature: Coding regions on vcDNA: vcDNA=SeqID_7099; Strand=+; Position=219-404
SYIDRVIRLAFFYCFISIVYASFLAFFCLVKKVKLVKDVLNFSVLTVHIYFIGIFIYVPLL

SEQ ID NO: 27403 - protein, 178 aa, Diabrotica virgifera
  misc_feature: Coding regions on vcDNA: vcDNA=SeqID_7100; Strand=+; Position=96-632
MKGTLLFLFLLISSTIAQHRIVRAKLGNLGAPQTIDLPDLGFAQGFLPSSLANAKHVNIKISKAKSSGFGAGSGNAEHGENIGFTARGAFSDNSGANINGIRGGFGFSSNGGSTASAGNTGFGVKAHLSANNAGVRGGFDFSSNRGNAVNAGNTAFGATGLDNSAKDSANFHQNTGKN

SEQ ID NO: 27404 - protein, 193 aa, Diabrotica virgifera
  misc_feature: Coding regions on vcDNA: vcDNA=SeqID_7101; Strand=+; Position=48-630
  misc_feature: Homolog annotation: Hit_ID=XP_319740.1; Match level="QueryCoverage =86%, HitCoverage=37%, E-value=1e-49, Identity=55%"; Hit description =ENSANGP00000019452 [Anopheles gambiae]
  misc_feature: Gene Ontology Annotation: Cellular component=extracellular space
  misc_feature (143)..(143): Xaa can be any naturally occurring amino acid
MKSPDNLIRVLIFGLCGPIGSNLPPVVFIPGAGGAQLEAKINKTRKIHYICESVSNDFFNIWLNLELLVPLVVDCWIDNAKLIYDNKTRTTPTNDGVDITVPGWGGSEAVEWLDPSHASTGKYFAEIGNTLVGMGYVRNVSIXGAPYDFRTAPNENQDFFVNLKTLLEHIYKENQHSLQCYCLAHSMGWAHEN

SEQ ID NO: 27405 - protein, 148 aa, Diabrotica virgifera
  misc_feature: Coding regions on vcDNA: vcDNA=SeqID_7102; Strand=+; Position=52-495
  misc_feature (27)..(27): Xaa can be any naturally occurring amino acid
  misc_feature (32)..(32): Xaa can be any naturally occurring amino acid
  misc_feature (119)..(119): Xaa can be any naturally occurring amino acid
AARHNQHDEGEPRGAKKTEQAPPTREXTNREXTRGGPNPEKPKQDTGDQTQEPRRAKKGNHAEPEKPATAHAGEGQHTKTTTKETTGRRRPGRTKGRRTTPKTTAAQTEAKREEKRDTXRKPTTRAAETGNADTADKEGETGAPPKEQ

SEQ ID NO: 27406 - protein, 91 aa, Diabrotica virgifera
  misc_feature: Coding regions on vcDNA: vcDNA=SeqID_7103; Strand=+; Position=437-708
  misc_feature: Homolog annotation: Hit_ID=AAH50341.1; Match level="QueryCoverage =97%, HitCoverage=7%, E-value=8e-10, Identity=40%"; Hit description =TIP120 protein [Homo sapiens]
  misc_feature (25)..(25): Xaa can be any naturally occurring amino acid
  misc_feature (51)..(51): Xaa can be any naturally occurring amino acid
  misc_feature (65)..(65): Xaa can be any naturally occurring amino acid
YNIITCQEILALVKPTNDIPKVKHXLNSPTPLSRTTGVSADKFTISDHAAXTDPLSKRCIGRDLXNPLQDPDLNVKESCIRAAIHYSDTLI

SEQ ID NO: 27407 - protein, 175 aa, Diabrotica virgifera
  misc_feature: Coding regions on vcDNA: vcDNA=SeqID_7104; Strand=+; Position=2-529
  misc_feature: Homolog annotation: Hit_ID=BAD36642.1; Match level="QueryCoverage =97%, HitCoverage=87%, E-value=5e-24, Identity=40%"; Hit description =putative glycine rich protein [Oryza sativa (japonica cultivar -group)]
  misc_feature: Gene Ontology Annotation: Molecular function=RNA polymerase II transcription factor activity; Cellular component=transcription factor TFIID complex; Biological process=RNA processing
GGPGGRGMGRGGPGGFRGRGGPGGGRGGPGGPGGPGVPGQKRAPGQFGGQGGPPGGIKRPRFENGQGANGFQGGQQSYSNQYGGGGGQYGGYNQYGGGQGGYESGGYSTQYSNPSSNYGSGGGDYSGYSQQGADQYGGGGYNTGAQGGYNSQGYDDMSGGYAQQGGYGSAPPRRY

SEQ ID NO: 27408 - protein, 42 aa, Diabrotica virgifera
  misc_feature: Coding regions on vcDNA: vcDNA=SeqID_7105; Strand=-; Position=29-157
  misc_feature (1)..(6): Xaa can be any naturally occurring amino acid
  misc_feature (20)..(28): Xaa can be any naturally occurring amino acid
XXXXXXFLFHLMEKENFILXXXXXXXXXSNMLPHQLQLDKAS

SEQ ID NO: 27409 - protein, 171 aa, Diabrotica virgifera
  misc_feature: Coding regions on vcDNA: vcDNA=SeqID_7106; Strand=-; Position=1-513
  misc_feature (1)..(24): Xaa can be any naturally occurring amino acid
  misc_feature (27)..(33): Xaa can be any naturally occurring amino acid
  misc_feature (49)..(60): Xaa can be any naturally occurring amino acid
  misc_feature (62)..(168): Xaa can be any naturally occurring amino acid
XXXXXXXXXXXXXXXXXXXXXXXXTKXXXXXXXPNTITTQKTKQTPQTXXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLPS

SEQ ID NO: 27410 - protein, 59 aa, Diabrotica virgifera
  misc_feature: Coding regions on vcDNA: vcDNA=SeqID_7107; Strand=-; Position=307-486
SLFVVCHPVDYFFTEIASFPISFIYHYCLLLRFKYLRIMKFIVDSFGTIEQFFKLCFFY

SEQ ID NO: 27411 - protein, 83 aa, Diabrotica virgifera
  misc_feature: Coding regions on vcDNA: vcDNA=SeqID_7108; Strand=+; Position=272-523
ARLFGIPRSGRGVPPSEINIYLFNWTNPEDIKNHSEKAKFEELGPYMFYEVMGKSNISFVDELGNYKIYYEAVFRREERRAEV

SEQ ID NO: 27412 - protein, 125 aa, Diabrotica virgifera
  misc_feature: Coding regions on vcDNA: vcDNA=SeqID_7109; Strand=-; Position=61-438
  misc_feature (19)..(66): Xaa can be any naturally occurring amino acid
  misc_feature (68)..(83): Xaa can be any naturally occurring amino acid
  misc_feature (92)..(98): Xaa can be any naturally occurring amino acid
RKKKSWGVTAGRGGAARPXXXXXXXXXXXXXXXXXXXXXXXXXXXXXXXXXXXXXXXXXXXXXXXXPXXXXXXXXXXXXXXXXGSPPVLTFXXXXXXXVEQNLKNIVFPQIINLNPTWGVQIFYY

SEQ ID NO: 27413 - protein, 54 aa, Diabrotica virgifera
  misc_feature: Coding regions on vcDNA: vcDNA=SeqID_7110; Strand=-; Position=82-246
ITMQGGSERNRIDIKDIQSSEMADMKFLGFNITRHYSETKRKSEILRNKMIMVI

SEQ ID NO: 27414 - protein, 54 aa, Diabrotica virgifera
  misc_feature: Coding regions on vcDNA: vcDNA=SeqID_7111; Strand=-; Position=101-265
SGDSTLCGYRTVLVTTDYSSVYHIFEIFIGTSYSGSPFYFLTYLSDALIAFENN

SEQ ID NO: 27415 - protein, 124 aa, Diabrotica virgifera
  misc_feature: Coding regions on vcDNA: vcDNA=SeqID_7112; Strand=-; Position=64-439
  misc_feature: Homolog annotation: Hit_ID=AAD44045.1; Match level="QueryCoverage =99%, HitCoverage=34%, E-value=8e-24, Identity=49%"; Hit description =polyprotein [Bovine viral diarrhea virus genotype 2]
  misc_feature: Pfam annotation: Pfam_ID=ubiquitin; Match level="Score=7.7, E-value =0.025, Copies=1"; Pfam description=Ubiquitin family
  misc_feature (40)..(40): Xaa can be any naturally occurring amino acid
  misc_feature (62)..(62): Xaa can be any naturally occurring amino acid
  misc_feature (68)..(68): Xaa can be any naturally occurring amino acid
  misc_feature (78)..(78): Xaa can be any naturally occurring amino acid
NDLLKIQCILDIPPDHPRDKYTRKQRVDSGSVSWVNIQKXSAVQMVLRPCGGRLIVFNAITXKCLLPXLDPSDAFENXKVKSQDKEGVPPDHQRLIFLSDHLDDIRILSGGNLQKESALHVVVR

SEQ ID NO: 27416 - protein, 63 aa, Diabrotica virgifera
  misc_feature: Coding regions on vcDNA: vcDNA=SeqID_7113; Strand=-; Position=601-792
QTFFSVVFLAFWTPPSGITQEHQKHQDTTHAPECFSGLFAFAATFLHFTANPEEDKILNGDTQ

SEQ ID NO: 27417 - protein, 125 aa, Diabrotica virgifera
  misc_feature: Coding regions on vcDNA: vcDNA=SeqID_7114; Strand=-; Position=113-490
  misc_feature (53)..(61): Xaa can be any naturally occurring amino acid
  misc_feature (69)..(79): Xaa can be any naturally occurring amino acid
  misc_feature (116)..(122): Xaa can be any naturally occurring amino acid
RNSVAVAKFSSVTNILYHLRMFYSLHIPLFLYLIKILLLFCTHNFSFMTPDRXXXXXXXXXSSDGRYYXXXXXXXXXXXIKSLTFISIFNINHSSHTLSKSFSSSTKIHNITFSLXXXXXXXQRL

SEQ ID NO: 27418 - protein, 216 aa, Diabrotica virgifera
  misc_feature: Coding regions on vcDNA: vcDNA=SeqID_7115; Strand=-; Position=59-708
  misc_feature: Homolog annotation: Hit_ID=EAL39934.1; Match level="QueryCoverage =99%, HitCoverage=27%, E-value=3e-39, Identity=37%"; Hit description =ENSANGP00000028171 [Anopheles gambiae str. PEST] ref|XP_556470.1| ENSANGP00000028171 [Anopheles gambiae st
  misc_feature: Gene Ontology Annotation: Molecular function=molecular_function unknown; Cellular component=cellular_component unknown; Biological process=biological_process unknown
  misc_feature (55)..(55): Xaa can be any naturally occurring amino acid
  misc_feature (133)..(133): Xaa can be any naturally occurring amino acid
  misc_feature (162)..(162): Xaa can be any naturally occurring amino acid
KNKNGGNLSEENEIMSRWREFFQEMLQARWYHEENNVANQRIEVDNVDPITINEXQEAIAEIKNRKAPGYDRITSEMIKKMGQNATELLLKIFNADWREEQIPMDWQKTQIVPIYKKGDRRDCNNYRGITLLXSTGMKIYEKLLNNRIIGKIDSTLEESQSXFRKGRSTQDHIFTIKQIIEKYQQQEKKMYMAYIDLEKAFDTVPRQKLWEILENK

SEQ ID NO: 27419 - protein, 157 aa, Diabrotica virgifera
  misc_feature: Coding regions on vcDNA: vcDNA=SeqID_7116; Strand=+; Position=2-475
  misc_feature: Homolog annotation: Hit_ID=XP_392567.1; Match level="QueryCoverage =81%, HitCoverage=8%, E-value=3e-18, Identity=39%"; Hit description =similar to ENSANGP00000014052 [Apis mellifera]
THLRPITHAGPHRRLWMGPQFTFKTYKTIAGSPLSVGESQPIYLGHSKPINMPITKANAVLIESSSASSCEQHLLENYHRTLEEGGGVGELQLKEDLADAMLESPGLRDTGDATDYPVREVQDDPSSVSRFSSASRASPTPFGENLLHFPGDCSGSM

SEQ ID NO: 27420 - protein, 92 aa, Diabrotica virgifera
  misc_feature: Coding regions on vcDNA: vcDNA=SeqID_7117; Strand=-; Position=1-276
  misc_feature (66)..(66): Xaa can be any naturally occurring amino acid
  misc_feature (78)..(78): Xaa can be any naturally occurring amino acid
ASMIFLVFLVFLFFFNIFSVLFLLLFNFGFIDWFCKVSHRHQHKEPFSSPSEDFGSPEFIPGLSPXHLQNGIFSPHVXLSKSFERGPPQCMP

SEQ ID NO: 27421 - protein, 72 aa, Diabrotica virgifera
  misc_feature: Coding regions on vcDNA: vcDNA=SeqID_7118; Strand=+; Position=486-704
RYSITLVKYWSRPLLARIRLVESNQVYWFVDTIYVYSALIPIWYGVNESNPSNSKVTILPSPVIVIVTFRYS

SEQ ID NO: 27422 - protein, 121 aa, Diabrotica virgifera
  misc_feature: Coding regions on vcDNA: vcDNA=SeqID_7119; Strand=-; Position=1-363
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(120): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXP

SEQ ID NO: 27423 - protein, 44 aa, Diabrotica virgifera
  misc_feature: Coding regions on vcDNA: vcDNA=SeqID_7120; Strand=+; Position=1-132
PPHLLDLHGILRISPYWLTKCTCLQPHTTPEFPHNTNPLPSSRG

SEQ ID NO: 27424 - protein, 97 aa, Diabrotica virgifera
  misc_feature: Coding regions on vcDNA: vcDNA=SeqID_7121; Strand=+; Position=91-383
  misc_feature: Homolog annotation: Hit_ID=CAE47499.1; Match level="QueryCoverage =77%, HitCoverage=23%, E-value=1e-15, Identity=57%"; Hit description =cathepsin L-like proteinase [Diabrotica virgifera virgifera]
  misc_feature (51)..(51): Xaa can be any naturally occurring amino acid
  misc_feature (59)..(59): Xaa can be any naturally occurring amino acid
LPLTEDHSSKDGHLKKKPVLFRIVSQTLHRTEKHNARYQNAEGSFYLTGYXMVADMTSXEFRLCLTPILIHQPKRYLTSRVCSMTPQCDSHHKSYRL

SEQ ID NO: 27425 - protein, 20 aa, Diabrotica virgifera
  misc_feature: Coding regions on vcDNA: vcDNA=SeqID_7122; Strand=-; Position=0-59
LPSPTKKGSSSLSQPTYILT

SEQ ID NO: 27426 - protein, 244 aa, Diabrotica virgifera
  misc_feature: Coding regions on vcDNA: vcDNA=SeqID_7123; Strand=+; Position=2-733
  misc_feature (3)..(123): Xaa can be any naturally occurring amino acid
  misc_feature (125)..(139): Xaa can be any naturally occurring amino acid
  misc_feature (146)..(153): Xaa can be any naturally occurring amino acid
  misc_feature (155)..(168): Xaa can be any naturally occurring amino acid
  misc_feature (201)..(208): Xaa can be any naturally occurring amino acid
  misc_feature (220)..(226): Xaa can be any naturally occurring amino acid
FRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXGFTNFLXXXXXXXXFXXXXXXXXXXXXXXYTFHLFTFTNDDNITLTKLSIQYTSSRFHQRTXXXXXXXXLYSQPALSGFIXXXXXXXGLFSPAPPFSPGNKPIFI

SEQ ID NO: 27427 - protein, 245 aa, Diabrotica virgifera
  misc_feature: Coding regions on vcDNA: vcDNA=SeqID_7124; Strand=+; Position=81-815
  misc_feature: Homolog annotation: Hit_ID=XP_395350.1; Match level="QueryCoverage =93%, HitCoverage=49%, E-value=1e-82, Identity=62%"; Hit description =similar to RIKEN cDNA 2410075D05 [Apis mellifera]
  misc_feature: Gene Ontology Annotation: Molecular function=molecular_function unknown; Cellular component=cellular_component unknown; Biological process=biological_process unknown
  misc_feature: Pfam annotation: Pfam_ID=N6_N4_Mtase; Match level="Score=-23.3, E -value=0.05, Copies=1"; Pfam description=DNA methylase
  misc_feature (65)..(75): Xaa can be any naturally occurring amino acid
  misc_feature (216)..(216): Xaa can be any naturally occurring amino acid
MKFVQQPKDIEPYWIVEFSSERDVKLLASRSVSLRNCLELWAHANSVPELHDKMKKYPQNLLQSXXXXXXXXXXXVETFCRHFTQKEKVEKLEAFSYLPVLGPVNLKNPDTTLQYIEYYGTRANDPPELPYDVFFGKWIANGLRQLIKKLSLKTRKFIGNTSMDPQLSLLMANQAKIKEGDIVLDPFVGSGSLLVAAAQFGGYVLGTDIDYLMLHXRTRPSRISQKSRAKDESIRANMEQYNLQH

SEQ ID NO: 27428 - protein, 100 aa, Diabrotica virgifera
  misc_feature: Coding regions on vcDNA: vcDNA=SeqID_7125; Strand=+; Position=1-303
  misc_feature (4)..(17): Xaa can be any naturally occurring amino acid
  misc_feature (19)..(61): Xaa can be any naturally occurring amino acid
  misc_feature (67)..(89): Xaa can be any naturally occurring amino acid
TTCXXXXXXXXXXXXXXKXXXXXXXXXXXXXXXXXXXXXXXXXXXXXXXXXXXXXXXXXXXQFKRAXXXXXXXXXXXXXXXXXXXXXXXFKVYLILVERN

SEQ ID NO: 27429 - protein, 267 aa, Diabrotica virgifera
  misc_feature: Coding regions on vcDNA: vcDNA=SeqID_7126; Strand=-; Position=1-800
  misc_feature: Homolog annotation: Hit_ID=XP_394536.1; Match level="QueryCoverage =97%, HitCoverage=62%, E-value=3e-57, Identity=51%"; Hit description =similar to ENSANGP00000012356 [Apis mellifera]
  misc_feature: Gene Ontology Annotation: Molecular function=protein binding; Cellular component=cytoplasm; Biological process=response to pathogenic bacteria
  misc_feature (37)..(37): Xaa can be any naturally occurring amino acid
  misc_feature (59)..(59): Xaa can be any naturally occurring amino acid
  misc_feature (93)..(93): Xaa can be any naturally occurring amino acid
  misc_feature (111)..(111): Xaa can be any naturally occurring amino acid
KPPKKCKNINKNFQRYYLKIIDLGPFGGGPKEEGILXKEFLLQTIKFNFQVDHPYQCLXKIAKMSKKGQKVNWQKMVQMAWTFVNDSLSATIXLQWGNPEIIAVALMYLAXGKLSKFEVIDWIGRHSKHCRWWDMFVEDVTMDLLEDICHQVLDLYSQSDTNPPDSPPMAQKGPQTPSPIPRASNGHEKPSSPEQPPPMVKIPPHSEVPQFPYQTFTCGPPPTAVYPTPVPTFSAPPTTHPPHLTGPPPGPPPHISAPPPNVFPSFV

SEQ ID NO: 27430 - protein, 58 aa, Diabrotica virgifera
  misc_feature: Coding regions on vcDNA: vcDNA=SeqID_7127; Strand=-; Position=58-234
  misc_feature (13)..(13): Xaa can be any naturally occurring amino acid
  misc_feature (23)..(36): Xaa can be any naturally occurring amino acid
SSFKIYLWLEIGXPVYRMISYIXXXXXXXXXXXXXXLCCHHPKLTLYPVFSDLLTRNK

SEQ ID NO: 27431 - protein, 80 aa, Diabrotica virgifera
  misc_feature: Coding regions on vcDNA: vcDNA=SeqID_7128; Strand=+; Position=106-348
  misc_feature (36)..(47): Xaa can be any naturally occurring amino acid
  misc_feature (55)..(62): Xaa can be any naturally occurring amino acid
LPVDRTLVRHKKTGDHDRACSAPSYSYCVGWGIFIXXXXXXXXXXXXRLIYFNVXXXXXXXXYHLSEIWSPFFTIFTYNT

SEQ ID NO: 27432 - protein, 51 aa, Diabrotica virgifera
  misc_feature: Coding regions on vcDNA: vcDNA=SeqID_7129; Strand=+; Position=1-153
LSYLVFWKKQDTFLFSLVLENLNNGKISTTTELPHTYCPLPINNRRKFRFL

SEQ ID NO: 27433 - protein, 32 aa, Diabrotica virgifera
  misc_feature: Coding regions on vcDNA: vcDNA=SeqID_7130; Strand=-; Position=1-96
GLKLRNYYIRTQRSDPKNTRTRALPGRPPTTP

SEQ ID NO: 27434 - protein, 123 aa, Diabrotica virgifera
  misc_feature: Coding regions on vcDNA: vcDNA=SeqID_7131; Strand=-; Position=158-529
  misc_feature (2)..(12): Xaa can be any naturally occurring amino acid
  misc_feature (69)..(77): Xaa can be any naturally occurring amino acid
  misc_feature (88)..(103): Xaa can be any naturally occurring amino acid
  misc_feature (107)..(121): Xaa can be any naturally occurring amino acid
SXXXXXXXXXXXTPKSTSRLSERFERLCLTIPFFIIQINTVIFHPTSSFQLSIPKLINILPSHGQNSAXXXXXXXXXESEYLIQQDKXXXXXXXXXXXXXXXXLYIXXXXXXXXXXXXXXXYI

SEQ ID NO: 27435 - protein, 245 aa, Diabrotica virgifera
  misc_feature: Coding regions on vcDNA: vcDNA=SeqID_7132; Strand=-; Position=0-734
  misc_feature (4)..(14): Xaa can be any naturally occurring amino acid
  misc_feature (24)..(32): Xaa can be any naturally occurring amino acid
  misc_feature (34)..(47): Xaa can be any naturally occurring amino acid
  misc_feature (54)..(66): Xaa can be any naturally occurring amino acid
  misc_feature (68)..(244): Xaa can be any naturally occurring amino acid
VLSXXXXXXXXXXXTNLAHTGLNXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXL

SEQ ID NO: 27436 - protein, 30 aa, Diabrotica virgifera
  misc_feature: Coding regions on vcDNA: vcDNA=SeqID_7133; Strand=+; Position=1-90
PKTSNTYLLRGAFFRLKWWVRTPKLAIFLT

SEQ ID NO: 27437 - protein, 18 aa, Diabrotica virgifera
  misc_feature: Coding regions on vcDNA: vcDNA=SeqID_7134; Strand=-; Position=0-53
TLGLPHKGAPPYVSSRAP

SEQ ID NO: 27438 - protein, 181 aa, Diabrotica virgifera
  misc_feature: Coding regions on vcDNA: vcDNA=SeqID_7135; Strand=-; Position=275-819
  misc_feature: Homolog annotation: Hit_ID=XP_315081.1; Match level="QueryCoverage =77%, HitCoverage=22%, E-value=3e-15, Identity=35%"; Hit description =ENSANGP00000002442 [Anopheles gambiae]
  misc_feature (34)..(41): Xaa can be any naturally occurring amino acid
  misc_feature (51)..(51): Xaa can be any naturally occurring amino acid
  misc_feature (106)..(106): Xaa can be any naturally occurring amino acid
NICEIRRSRYCICTLFVLSLTVGTPDVSHSEQTXXXXXXXXFSSGQAQIVXSFVDFIVSHKKTGEGISNEILTKLKEDGLDVNDCRGQGLDNGSNMAGIYNSDATXVQAHIDNINDLARFVPCAAHSLNLVGVNAAEVSPIMITFFGIVQSIFCLASCSAIRWECFNKYLSSSLKVHSYTR

SEQ ID NO: 27439 - protein, 124 aa, Diabrotica virgifera
  misc_feature: Coding regions on vcDNA: vcDNA=SeqID_7136; Strand=+; Position=486-860
IKTNIKRIEYTTFHPIKGLTSINLTNNQIVYITNLLIHLYHLYDINLHYNLIIALYPDYFASSKISALSIITNQMYQIGKRIFIDLSFTTISLTVNLISTIEHCIIDDTKDVLILKLVSNMIDD

SEQ ID NO: 27440 - protein, 105 aa, Diabrotica virgifera
  misc_feature: Coding regions on vcDNA: vcDNA=SeqID_7137; Strand=+; Position=326-643
TNLIQQYRVLTTAVTTCLHRVTILKQDTKMSIRQLNNDLMVTQDSLETDDEKFILVNLASVEMMFGRKLDDVLASAKKECDKSLNDVTACKNILKNDLADGGREA

SEQ ID NO: 27441 - protein, 260 aa, Diabrotica virgifera
  misc_feature: Coding regions on vcDNA: vcDNA=SeqID_7138; Strand=+; Position=2-784
  misc_feature: Homolog annotation: Hit_ID=XP_312053.1; Match level="QueryCoverage =99%, HitCoverage=49%, E-value=3e-43, Identity=37%"; Hit description =ENSANGP00000016169 [Anopheles gambiae]
  misc_feature (92)..(150): Xaa can be any naturally occurring amino acid
KVVNDVVTYREKNNVYRKDFMHLLIQLKNIGKVTDDGTIKTDSSKDVHLTMKEITAHSFVFFIAGFETSSTAMTYALFHLAQNEVLQDKARXXXXXXXXXXXXXXXXXXXXXXXXXXXXXXXXXXXXXXXXXXXXXXXXXXXXXXXXXXXEKGTVLNISTRGIHYDPDIYPNPNVFDPDRFSPENKSSTSPMAFLAFGEGPRLCIGLRFGKLQAKVGLCSILRTCRVTLNEKTQLPLKYDSKTHFPNVEGGVWLNLESLE

SEQ ID NO: 27442 - protein, 245 aa, Diabrotica virgifera
  misc_feature: Coding regions on vcDNA: vcDNA=SeqID_7139; Strand=+; Position=34-771
  misc_feature: Homolog annotation: Hit_ID=XP_394508.1; Match level="QueryCoverage =57%, HitCoverage=19%, E-value=7e-32, Identity=48%"; Hit description =similar to zinc finger protein 62 homolog [Apis mellifera]
  misc_feature: Pfam annotation: Pfam_ID=zf-AD; Match level="Score=78.5, E-value=1.7e- 20, Copies=1"; Pfam description=Zinc-finger associated domain (zf-AD)
MNHNNNMLQLCRLCLVKDEVNIPIFEEQGDIRQIFLKISSCLPVKVSRDDQLPKKICDGCSYKLDMLYEFWNTSANAEKQLLTWLGEAGMTSQMTDGTISAVAQQIKPADAFVKQETIDPPDILKDDDDEDEEDKDYMKQEESSNNVEEPPPKRARRTAAVKAAIADDDSGEPMTKVEDDTDDSDNDDGPPFVDVPSTSADDQPGPSGVGKDGVEAPFYGNSYSINSYPSTLDNIDLELAIGMFP

SEQ ID NO: 27443 - protein, 194 aa, Diabrotica virgifera
  misc_feature: Coding regions on vcDNA: vcDNA=SeqID_7140; Strand=+; Position=3-584
  misc_feature (153)..(164): Xaa can be any naturally occurring amino acid
ARRGAPFKLVVLKITNHEKGEAVFSAGGGKVLKGFENNVQKVELQTKVEHRVENFPLPVDSSGLVMTHPPKQGKEERRDFFLESNKGRVKIEAEVTPVQKILPLEPRLGETLLPGRGHIFDLGGIPFNMVVLEGKIYGEEEAVFSAKGGNVLXXXXXXXXXXXXVEHKVQKVRLPVHSAGLVLVHPEKENDDHR

SEQ ID NO: 27444 - protein, 207 aa, Diabrotica virgifera
  misc_feature: Coding regions on vcDNA: vcDNA=SeqID_7141; Strand=+; Position=24-644
  misc_feature (32)..(38): Xaa can be any naturally occurring amino acid
QFFFTLIGSPLRKNAEYTPASKHLPSFHSTLXXXXXXXQTIRIAMEDFTADTDLPYQFKAEDLIAEGRASKEHVDEIRTFVSNLTDKYVPLRIQDEMIIIFLLSCAHDVELTKKTIVNYYYLKWHGPEIYDDRHMDRPDIQLAIKTIRMSSIPVRTEENDVYHYFNLKDTNYRNFEMIPIMKVSYMLMDIAQEKNPPSVLFVGIDMK

SEQ ID NO: 27445 - protein, 56 aa, Diabrotica virgifera
  misc_feature: Coding regions on vcDNA: vcDNA=SeqID_7142; Strand=+; Position=87-257
QEVLSSHGMGIIFSLITLISEINCSILDIDTCSHSITTSYLPLNHRSRTYFEYITW

SEQ ID NO: 27446 - protein, 177 aa, Diabrotica virgifera
  misc_feature: Coding regions on vcDNA: vcDNA=SeqID_7143; Strand=+; Position=2-535
  misc_feature: Homolog annotation: Hit_ID=XP_392827.1; Match level="QueryCoverage =96%, HitCoverage=7%, E-value=1e-57, Identity=68%"; Hit description =similar to ENSANGP00000004133 [Apis mellifera]
  misc_feature: Gene Ontology Annotation: Molecular function=calmodulin binding
FRRSDDQQKLEMGCFLTNSIEKNAIGSTLKDYIIALEIVKNALEYITMHAPWGGPTLLRVDSDELKDFISKPALEYILRFLTGLAHSHEKTELAIAAAETIPIIHRLEQVSSDEHVGSLAENLVEALCTNPDGAKQIDAGREVTRSGKKRLGLGMREKQLGPVGMRTHDKGPVTGKA

SEQ ID NO: 27447 - protein, 57 aa, Diabrotica virgifera
  misc_feature: Coding regions on vcDNA: vcDNA=SeqID_7144; Strand=+; Position=301-474
QISKGCFNFLYLFIYVEYTYLYLLMLRLLTRRIIRSANLLILERLYLMSLLKSVNHF

SEQ ID NO: 27448 - protein, 88 aa, Diabrotica virgifera
  misc_feature: Coding regions on vcDNA: vcDNA=SeqID_7145; Strand=-; Position=0-263
INKSLTPVPSPFPNRQQSTSPSHTDDKQSDISNKNQSFHPQTTRTALSIPETEKQAYPYTSPRAAGGRPREFPPAPPPPRAARPPPPP

SEQ ID NO: 27449 - protein, 149 aa, Diabrotica virgifera
  misc_feature: Coding regions on vcDNA: vcDNA=SeqID_7146; Strand=+; Position=58-507
  misc_feature: Homolog annotation: Hit_ID=EAL41008.1; Match level="QueryCoverage =100%, HitCoverage=100%, E-value=1e-27, Identity=48%"; Hit description=ENSANGP00000026688 [Anopheles gambiae str. PEST] ref|XP _558976.1| ENSANGP00000026688 [Anopheles gambiae
  misc_feature: Gene Ontology Annotation: Molecular function=NADH dehydrogenase (ubiquinone) activity; Cellular component=membrane fraction
  misc_feature (104)..(117): Xaa can be any naturally occurring amino acid
MASLLAKSFRAVCRNSSSLRSFSTRPLAVTLVNRCSDILQNSSQSKPGSLIDIQTRFYSPEVIKPKPSEEEIKQRVLKVCSSYDKVTAEKLTLNSHFINDLGLXXXXXXXXXXXXXXEFGFEIPDADAEKLLRPADIVRYVGDKEDIYE

SEQ ID NO: 27450 - protein, 25 aa, Diabrotica virgifera
  misc_feature: Coding regions on vcDNA: vcDNA=SeqID_7147; Strand=-; Position=1-75
  misc_feature (11)..(18): Xaa can be any naturally occurring amino acid
KNSAKPEEKKXXXXXXXXAGASFSL

SEQ ID NO: 27451 - protein, 66 aa, Diabrotica virgifera
  misc_feature: Coding regions on vcDNA: vcDNA=SeqID_7148; Strand=+; Position=345-545
KILLIIYDSFILAIQTYIIHFKVEDFKMILPIFMSCVPGTTLLKDSSFDYMKSTPTNSRIFVTKKS

SEQ ID NO: 27452 - protein, 390 aa, Diabrotica virgifera
  misc_feature: Coding regions on vcDNA: vcDNA=SeqID_7149; Strand=+; Position=1-1173
  misc_feature (1)..(194): Xaa can be any naturally occurring amino acid
  misc_feature (233)..(238): Xaa can be any naturally occurring amino acid
  misc_feature (241)..(250): Xaa can be any naturally occurring amino acid
  misc_feature (265)..(282): Xaa can be any naturally occurring amino acid
  misc_feature (286)..(338): Xaa can be any naturally occurring amino acid
  misc_feature (367)..(376): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYRFKKEFRNLFFPLVIKTMLFALKISLPRPLVYLNGRGXXXXXXEHXXXXXXXXXXEGGAKKKPALFQFIXXXXXXXXXXXXXXXXXXPQRXXXXXXXXXXXXXXXXXXXXXXXXXXXXXXXXXXXXXXXXXXXXXXXXXXXXXPRETPEFFWGGHPQNKMPPPARAVNGIYXXXXXXXXXXSPPLPKIFSLLPGA

SEQ ID NO: 27453 - protein, 112 aa, Diabrotica virgifera
  misc_feature: Coding regions on vcDNA: vcDNA=SeqID_7150; Strand=-; Position=195-533
  misc_feature (79)..(90): Xaa can be any naturally occurring amino acid
KEYYTVMSALKTSKITQKMENIFSCEIVRDKSYSVERHSLISHVIKKVQLFLIEGVSLATSHLKRVTNSSLVNFAVAYXXXXXXXXXXXXQVSNYVKVKSKIYVIIKLSCVF

SEQ ID NO: 27454 - protein, 66 aa, Diabrotica virgifera; identical to SEQ ID NO: 26808
  misc_feature: Coding regions on vcDNA: vcDNA=SeqID_7151; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 27455 - protein, 308 aa, Diabrotica virgifera
  misc_feature: Coding regions on vcDNA: vcDNA=SeqID_7152; Strand=+; Position=3-926
  misc_feature: Homolog annotation: Hit_ID=XP_319377.1; Match level="QueryCoverage =98%, HitCoverage=34%, E-value=1e-89, Identity=54%"; Hit description =ENSANGP00000012190 [Anopheles gambiae]
  misc_feature: Gene Ontology Annotation: Molecular function=ribonucleoside -diphosphate reductase activity; Cellular component=ribonucleoside -diphosphate reductase complex; Biological process=DNA replication
  misc_feature: Pfam annotation: Pfam_ID=Ribonuc_red_lgC; Match level="Score=36.2, E -value=9.6e-17, Copies=1"; Pfam description=Ribonucleotide reductase, barrel doma
  misc_feature (157)..(182): Xaa can be any naturally occurring amino acid
  misc_feature (270)..(271): Xaa can be any naturally occurring amino acid
  misc_feature (273)..(273): Xaa can be any naturally occurring amino acid
  misc_feature (277)..(277): Xaa can be any naturally occurring amino acid
  misc_feature (297)..(297): Xaa can be any naturally occurring amino acid
YIEPWHADILEFLNLSKPGGKEEVRTRDLSYALWVPDLFMKRVESNGKWSLMCPHQSPGLTDSYGDKFEQLYEKYEKEGKYIKQIQAQELWRAIIVLQAETGGPVMMYKDVCNRKSNQKHIGTIRGGSYSGEVVAYTSDEEIVACPQASIAVNMFVXXXXXXXXXXXXXXXXXXXXXXXXXXIDVSFYPVPEEKKSNLNHRAIGIGVQGLADTFILMRMPCDSEEARKLNKQIFETLYYGALEASSNLAELNGPYPMYEGQSCHRQRCSXXMXLWDXKPSDLMGIGHHLKKQSLKLXVRNSLLFCTDV

SEQ ID NO: 27456 - protein, 237 aa, Diabrotica virgifera
  misc_feature: Coding regions on vcDNA: vcDNA=SeqID_7153; Strand=-; Position=51-762
  misc_feature: Homolog annotation: Hit_ID=XP_312124.1; Match level="QueryCoverage =100%, HitCoverage=91%, E-value=1e-40, Identity=38%"; Hit description= ENSANGP00000023417 [Anopheles gambiae]
  misc_feature (86)..(86): Xaa can be any naturally occurring amino acid
  misc_feature (138)..(138): Xaa can be any naturally occurring amino acid
  misc_feature (144)..(144): Xaa can be any naturally occurring amino acid
  misc_feature (206)..(206): Xaa can be any naturally occurring amino acid
ADDINIIASRKADLFTVLKAAAKGIGLYVDTNKTNYVRVTNNNEVAKPEDIMVGTYYTFEGVREFVYLGSQINQINTISAEINTHXLANRAYCGLKKLLTSNIVTKRTKILIYRTLIKPVVTYVSETWTKTKTGEERXGSFERXILRHIYKGVQENGLWHRYYNFELYCLYREPSIGRSIKINRLWWLGHLERMNEVEPSTYIYIXRPDGVRRKSRPRTRFKDQVKDDLRMLGVRNW

SEQ ID NO: 27457 - protein, 48 aa, Diabrotica virgifera
  misc_feature: Coding regions on vcDNA: vcDNA=SeqID_7154; Strand=+; Position=46-192
NLKLLIYVKLKRTIGESQLTKPQEYSEELSRINHTYMSIEDSKEKSTP

SEQ ID NO: 27458 - protein, 87 aa, Diabrotica virgifera
  misc_feature: Coding regions on vcDNA: vcDNA=SeqID_7155; Strand=+; Position=243-506
SRTFTRQCSYKNRLKLLQIKCLGLRLNLNPEIILTDFEIAIHNAIRTVFPNSKIVGCRFHLAQACHKTVKQSTIESVISKTTRVTYS

SEQ ID NO: 27459 - protein, 119 aa, Diabrotica virgifera
  misc_feature: Coding regions on vcDNA: vcDNA=SeqID_7156; Strand=-; Position=362-721
VYFFCFPNSPILIPLVDAVDAPFTVDTSSMIKLVQHYGLRSPPFYSVVYLYRFNKLSIYSDFHFVVLADLFNSFYDIFESYSVKCFLQVNQTQKRFMYEGNFLEIYDIKSYTNYVKILR

SEQ ID NO: 27460 - protein, 106 aa, Diabrotica virgifera
  misc_feature: Coding regions on vcDNA: vcDNA=SeqID_7157; Strand=+; Position=3-323
  misc_feature: Homolog annotation: Hit_ID=B46361; Match level="QueryCoverage=98%, HitCoverage=24%, E-value=4e-14, Identity=38%"; Hit description=P element homolog (Lu-P2 element) - greenbottle fly (Lucilia cuprina)
LSGYICHKLKLPLSTDTSHFTWTDQVSEGGLKKPPEEMVTKTVELERIFNQIHGNGLKPGKNFLKRLLTSANDVDCDDKIKTLFFRSRMYFRIKELNLNLKDSKTK

SEQ ID NO: 27461 - protein, 170 aa, Diabrotica virgifera
  misc_feature: Coding regions on vcDNA: vcDNA=SeqID_7158; Strand=+; Position=3-512
DGGEEEGRRAQDTLCTQRGATNTPRENRKRHRRGNGIALRLERRPTRKPQEGGRAQTGRGGAQKAKHKNPEGPRGGTTENGRSYRPSYPRWSLREPELQPRGDRDWYFACSCRRCRRPQKPKNVLRGSRGRLRLRRDCPGCWEVVWMWEMIYAWDPWVCGARPMRCGTRG

SEQ ID NO: 27462 - protein, 65 aa, Diabrotica virgifera
  misc_feature: Coding regions on vcDNA: vcDNA=SeqID_7159; Strand=+; Position=3-197
  misc_feature (17)..(31): Xaa can be any naturally occurring amino acid
YIIRRIISFREIYSLLXXXXXXXXXXXXXXXPCISEIIYHNQYHHMLYIFHTYNQSVQNSINIYC

SEQ ID NO: 27463 - protein, 255 aa, Diabrotica virgifera
  misc_feature: Coding regions on vcDNA: vcDNA=SeqID_7160; Strand=-; Position=0-764
  misc_feature (1)..(37): Xaa can be any naturally occurring amino acid
  misc_feature (40)..(56): Xaa can be any naturally occurring amino acid
  misc_feature (59)..(91): Xaa can be any naturally occurring amino acid
  misc_feature (99)..(157): Xaa can be any naturally occurring amino acid
  misc_feature (160)..(186): Xaa can be any naturally occurring amino acid
  misc_feature (192)..(228): Xaa can be any naturally occurring amino acid
  misc_feature (230)..(249): Xaa can be any naturally occurring amino acid
XXXXXXXXXXXXXXXXXXXXXXXXXXXXXXXXXXXXXENXXXXXXXXXXXXXXXXXGGXXXXXXXXXXXXXXXXXXXXXXXXXXXXXXXXXAPPPPLAXXXXXXXXXXXXXXXXXXXXXXXXXXXXXXXXXXXXXXXXXXXXXXXXXXXXXXXXXXXIKXXXXXXXXXXXXXXXXXXXXXXXXXXXRGGGAXXXXXXXXXXXXXXXXXXXXXXXXXXXXXXXXXXXXXGXXXXXXXXXXXXXXXXXXXXRGEPPA

SEQ ID NO: 27464 - protein, 95 aa, Diabrotica virgifera
  misc_feature: Coding regions on vcDNA: vcDNA=SeqID_7161; Strand=-; Position=2-286
  misc_feature (47)..(95): Xaa can be any naturally occurring amino acid
KVGQTLIIKFLPQIINFNPTLEFASFIFDLTSPIKITLLSLKVIYSXXXXXXXXXXXXXXXXXXXXXXXXXXXXXXXXXXXXXXXXXXXXXXXXX

SEQ ID NO: 27465 - protein, 95 aa, Diabrotica virgifera
  misc_feature: Coding regions on vcDNA: vcDNA=SeqID_7162; Strand=-; Position=383-670
KLPSVERKKHKHNSRLYQKQREEQKLLKYHLKLAREKSTTKSYIKGNKLFVDGSSYSIEDLQIQGKIYTKQIVSRIHQLSTRPLRQKYQYLNKNQ

SEQ ID NO: 27466 - protein, 122 aa, Diabrotica virgifera
  misc_feature: Coding regions on vcDNA: vcDNA=SeqID_7163; Strand=+; Position=1-369
  misc_feature (8)..(14): Xaa can be any naturally occurring amino acid
PWGAQGSXXXXXXXTQRKPIRSFREKLPEFPVSPQVGSQQCPPLGRHKSPGDVRADCIKKRGRAGEGHGRIRAYQGTHSNWGGGKLILKPLTQTGPHKGYLNPPRAKERGGSFRGGGGWKRP

SEQ ID NO: 27467 - protein, 120 aa, Diabrotica virgifera
  misc_feature: Coding regions on vcDNA: vcDNA=SeqID_7164; Strand=-; Position=2-361
  misc_feature (7)..(24): Xaa can be any naturally occurring amino acid
  misc_feature (49)..(54): Xaa can be any naturally occurring amino acid
  misc_feature (69)..(75): Xaa can be any naturally occurring amino acid
  misc_feature (78)..(84): Xaa can be any naturally occurring amino acid
  misc_feature (90)..(97): Xaa can be any naturally occurring amino acid
  misc_feature (100)..(119): Xaa can be any naturally occurring amino acid
GGPPFGXXXXXXXXXXXXXXXXXXTPGLPPRGYNPHRPEKNFIKCGNQXXXXXXGSPPIKKFYSPPWRXXXXXXXFEXXXXXXXLFSLKXXXXXXXXKLXXXXXXXXXXXXXXXXXXXXP

SEQ ID NO: 27468 - protein, 255 aa, Diabrotica virgifera
  misc_feature: Coding regions on vcDNA: vcDNA=SeqID_7165; Strand=+; Position=112-879
MTFQYIELNSDPEPLIPGTMEGSLSKWGQPDEFIGMKNPSTNNFSCNTEIPERPENRKPTDQKFLIAFAVAVIILLPFLIYTLVYSDLDHYKGYDQCGNVCGQKNKKYDNWACSGEDNTNKPYLLYYTSVHNLEGERKCVERCEDGDYPGNGAYCTKITSSDDFGDGLSDYLNKHAGTIVFACFLSLGVGLIMLFLFKSATDVVVWVGLVGALFSGTIFVFNHHVMEERIGNVKYPEEVFLFAALVYTYIDTVGF

SEQ ID NO: 27469 - protein, 299 aa, Diabrotica virgifera
  misc_feature: Coding regions on vcDNA: vcDNA=SeqID_7166; Strand=+; Position=3-902
  misc_feature: Homolog annotation: Hit_ID=XP_392165.1; Match level="QueryCoverage =34%, HitCoverage=12%, E-value=1e-40, Identity=66%"; Hit description =similar to CG31653-PA [Apis mellifera]
  misc_feature: Pfam annotation: Pfam_ID=zf-CCCH; Match level="Score=8.3, E-value =0.092, Copies=1"; Pfam description=Zinc finger C-x8-C-x5-C-x3-H type (an
QKSYSFGLDNFFKKMTDLDSPKKNNDCYFYYYSTCSKGDSCIFRHEPSALGCETMCSFWKEGKCFNIQCNFRHMELRKNRKAIPCYWESQPGGCLKGHCSFLHQNPRPVDAVNRSYLSTAESVGNLNNSERNVTVGEDLVVNFEEESDNESMPTYSPAKHKERICTVKSLEEIRLEKIQAESAAYYSYSDDSFQYDGQANMMRERIFSRMQNKLPTERTVVIPKRQNDSQFVPTLPKKRRLVFHNEDGNLEIRINKGKNKLMPKTNSIHKLERTIENQLYRRTTIPNHFLLYNNLEISK

SEQ ID NO: 27470 - protein, 240 aa, Diabrotica virgifera
  misc_feature: Coding regions on vcDNA: vcDNA=SeqID_7167; Strand=+; Position=90-809
  misc_feature: Homolog annotation: Hit_ID=XP_313680.1; Match level="QueryCoverage =95%, HitCoverage=47%, E-value=1e-78, Identity=61%"; Hit description =ENSANGP00000013071 [Anopheles gambiae]
  misc_feature (224)..(224): Xaa can be any naturally occurring amino acid
  misc_feature (233)..(233): Xaa can be any naturally occurring amino acid
MAVSVRGFSHRIGHLSSVLATVKSSPRTYFTYTNEPSQPIKGKEPKWCTPEEAFQDLQSGQTVFSQGAAATPIDCLNAMTKVGKSKNLKDITVCHMHTEGPAAYTDPSCEGIFRSCSFFMGGNVRKAVADGRGDAIPIFLSEIPLLFTRQIVKPDIAVIQVSPPDQHGYCSLGTSVDCVRAGMSHSKIIVAQINPRMPRTFGDGIIHISHIDYAVKVDTPLPCXRGKPPSDVXTQIGKNI

SEQ ID NO: 27471 - protein, 136 aa, Diabrotica virgifera
  misc_feature: Coding regions on vcDNA: vcDNA=SeqID_7168; Strand=-; Position=148-558
CKSLLNCLACIRAVRLVPYQYTKLCAESCSLSYYPQITFTQISSTFIGRTYGHNISRRCPSASELSHPSASHVNSCRIRGAKRAAISNEAQALSITRVEEFSIPVYQYNSHYMEIERHSGVAAYQGGHIEDISQPF

SEQ ID NO: 27472 - protein, 216 aa, Diabrotica virgifera
  misc_feature: Coding regions on vcDNA: vcDNA=SeqID_7169; Strand=+; Position=211-858
  misc_feature: Homolog annotation: Hit_ID=NP_001004509.1; Match level="QueryCoverage= 67%, HitCoverage=11%, E-value=4e-15, Identity=31%"; Hit description =si:busm1-180o5.3 [Danio rerio] emb|CAD60788.1| novel protein similar to DNA polymerases [Danio
MFCGNTNGPALNLLYHEGHFNVITSLTAAFCCRYYCEECHQPFNNKNDHRCGGTCFACRRSPACSKDCVKIPCDQCGRNFYGKACFNAHVGSVCDKIKRCKTCYKIYTKSHVCGEVFCKTCKKNCPSDHLCYIQPDSGRPPSKDFLFIFYDLETRQETVMPDGSLLQEPNLCVFKQCCDKCLESDTRMCTMWWSPASFKKHPIERFMEVLKSRKYQ

SEQ ID NO: 27473 - protein, 78 aa, Diabrotica virgifera
  misc_feature: Coding regions on vcDNA: vcDNA=SeqID_7170; Strand=+; Position=3-240
  misc_feature: Homolog annotation: Hit_ID=BAD12051.1; Match level="QueryCoverage =94%, HitCoverage=52%, E-value=2e-20, Identity=67%"; Hit description =proliferating cell nuclear antigen [Lucilia sericata]
  misc_feature: Gene Ontology Annotation: Molecular function=DNA binding; Cellular component=replication fork; Biological process=DNA replication
  misc_feature: Pfam annotation: Pfam_ID=PCNA_N; Match level="Score=39.2, E-value =5.8e-10, Copies=1"; Pfam description=Proliferating cell nuclear antigen, N-
  misc_feature (25)..(25): Xaa can be any naturally occurring amino acid
  misc_feature (31)..(31): Xaa can be any naturally occurring amino acid
  misc_feature (41)..(41): Xaa can be any naturally occurring amino acid
CSESGIQLQAMDTSHVSLVSLTLKXDGSDKXRCDRNLIMGXNLGSMSKIFLSPRNDATAAIKAYDDDGIVTLMFAVKK

SEQ ID NO: 27474 - protein, 23 aa, Diabrotica virgifera
  misc_feature: Coding regions on vcDNA: vcDNA=SeqID_7171; Strand=-; Position=2-70
  misc_feature (3)..(13): Xaa can be any naturally occurring amino acid
PFXXXXXXXXXXXTNLAHTGLNS

SEQ ID NO: 27475 - protein, 136 aa, Diabrotica virgifera
  misc_feature: Coding regions on vcDNA: vcDNA=SeqID_7172; Strand=+; Position=472-883
  misc_feature: Homolog annotation: Hit_ID=EAA44861.2; Match level="QueryCoverage =92%, HitCoverage=16%, E-value=2e-39, Identity=69%"; Hit description =ENSANGP00000022812 [Anopheles gambiae str. PEST] ref|XP_563225.1| ENSANGP00000022812 [Anopheles gambiae st
  misc_feature: Gene Ontology Annotation: Molecular function=transcription cofactor activity; Cellular component=nucleus; Biological process=SMAD protein heteromerization
  misc_feature: Pfam annotation: Pfam_ID=MH1; Match level="Score=16.1, E-value=5e-05, Copies=1"; Pfam description=MH1 domain
  misc_feature (48)..(54): Xaa can be any naturally occurring amino acid
  misc_feature (59)..(59): Xaa can be any naturally occurring amino acid
  misc_feature (93)..(93): Xaa can be any naturally occurring amino acid
  misc_feature (106)..(106): Xaa can be any naturally occurring amino acid
  misc_feature (116)..(116): Xaa can be any naturally occurring amino acid
YIVEGMSTINTNAPSSADACLSIVHSLMCHRQGGESEGFAKRAIESLXXXXXXXRDEIXSLITAITTSGAHPSKWVTIQRTLNGRLPVAGKKXFSSRKYLIQIWKXPDLPKKELKXVKIGQFALDLKGGPGGALIP

SEQ ID NO: 27476 - protein, 126 aa, Diabrotica virgifera
  misc_feature: Coding regions on vcDNA: vcDNA=SeqID_7173; Strand=-; Position=21-401
KPLLYLKKLDIGCVVTMEATSINEEYICCQLYWSHGSNISICNANTIIFTLSKTTNGQYKTIYLKHVTLFDSSFYAEKMTLFPWGKSDISVGCRSRLFNKNVFRRKVSDRAEWKNIVKPATTHKGL

SEQ ID NO: 27477 - protein, 63 aa, Diabrotica virgifera
  misc_feature: Coding regions on vcDNA: vcDNA=SeqID_7174; Strand=+; Position=1-189
  misc_feature: Homolog annotation: Hit_ID=YP_054532.1; Match level="QueryCoverage =80%, HitCoverage=9%, E-value=3e-09, Identity=60%"; Hit description =cytochrome c oxidase subunit I [Thermobia domestica] gb|AAT69281.1| cytochrome c oxidase subunit
  misc_feature (7)..(15): Xaa can be any naturally occurring amino acid
  misc_feature (36)..(43): Xaa can be any naturally occurring amino acid
  misc_feature (52)..(60): Xaa can be any naturally occurring amino acid
NHKDIGXXXXXXXXXAGMVGTSLRILVRAELGRPGXXXXXXXXYNVIVTAHXXXXXXXXXILL

SEQ ID NO: 27478 - protein, 54 aa, Diabrotica virgifera
  misc_feature: Coding regions on vcDNA: vcDNA=SeqID_7175; Strand=-; Position=2-163
  misc_feature (11)..(18): Xaa can be any naturally occurring amino acid
  misc_feature (21)..(34): Xaa can be any naturally occurring amino acid
  misc_feature (40)..(53): Xaa can be any naturally occurring amino acid
KPTLGPTGLNXXXXXXXXSNXXXXXXXXXXXXXXPTSRSXXXXXXXXXXXXXXV

SEQ ID NO: 27479 - protein, 68 aa, Diabrotica virgifera
  misc_feature: Coding regions on vcDNA: vcDNA=SeqID_7176; Strand=-; Position=439-645
  misc_feature (5)..(5): Xaa can be any naturally occurring amino acid
  misc_feature (28)..(28): Xaa can be any naturally occurring amino acid
MPHYXMTFHHDNAPAHTSAIAMAKLVEXGYKLLSRPLYSPDLTLNGLFVFPTLGKSLAGQTFKRKPSR

SEQ ID NO: 27480 - protein, 60 aa, Diabrotica virgifera
  misc_feature: Coding regions on vcDNA: vcDNA=SeqID_7177; Strand=+; Position=2-181
  misc_feature (1)..(51): Xaa can be any naturally occurring amino acid
XXXXXXXXXXXXXXXXXXXXXXXXXXXXXXXXXXXXXXXXXXXXXXXXXXXLFTRGDYKS

SEQ ID NO: 27481 - protein, 268 aa, Diabrotica virgifera
  misc_feature: Coding regions on vcDNA: vcDNA=SeqID_7178; Strand=+; Position=1-807
  misc_feature: Homolog annotation: Hit_ID=XP_307589.1; Match level="QueryCoverage =94%, HitCoverage=86%, E-value=5e-26, Identity=29%"; Hit description =ENSANGP00000016317 [Anopheles gambiae]
  misc_feature: Pfam annotation: Pfam_ID=Exo_endo_phos; Match level="Score=-15.0, E -value=0.032, Copies=1"; Pfam description =Endonuclease/Exonuclease/phosphatase
  misc_feature (173)..(184): Xaa can be any naturally occurring amino acid
IILVETWLTDNFTDHELCFNNYSVFRADRNLNTSSKNRGGGVLILVNSKFKSTHLTTHFINVEHLFVSLSSHNETVIIGAVYIPPSSNHDIYVDHCSAVEFIVENNPNSSLYLFGDYNLPHATWNYSTEDGLSVSCPAEYPALTVCESFSYLNLRQANVVANQHGVLLDLCFXXXXXXXXXXXXTAVDTLLSNNYHHVALSCELTVSDINPLSCDILYYDFKNADYIALNDYFAPINWEHFLANDDINISIEIFYQILKLAFRFVCTY

SEQ ID NO: 27482 - protein, 126 aa, Diabrotica virgifera
  misc_feature: Coding regions on vcDNA: vcDNA=SeqID_7179; Strand=-; Position=3-380
PRFVRFPYYRGQGGGKPVLIPFIPALLLVDHLPYITSPAFLLLALIFPRSPSVLFEEEVKEKNPDWSKKGDEKKVQQAEEMTFHLLLKPLLSTIKGICRIFRVITIVDFDYIKIIFIRLRFLSTAK

SEQ ID NO: 27483 - protein, 266 aa, Diabrotica virgifera
  misc_feature: Coding regions on vcDNA: vcDNA=SeqID_7180; Strand=-; Position=81-881
  misc_feature: Homolog annotation: Hit_ID=CAG32092.1; Match level="QueryCoverage =92%, HitCoverage=37%, E-value=2e-36, Identity=33%"; Hit description =hypothetical protein [Gallus gallus] ref|NP_001006195.1| similar to Protein C22orf19 (NF2/meningioma
  misc_feature: Gene Ontology Annotation: Molecular function=protein binding; Biological process=negative regulation of macrophage differentiation
GEWVEDDNGLKSPNPITKFQIKKIGLTSFQSLVPQIGYAYHWAQRVCERDFLNKKMDSDELGRTNVEIIMKIIFKRLESRYQLATQLQQLEQNTIPTMPKPADCPVSFTCSISKWTAISYQKYCQLEFTKTFLEEELVAPSDLFYSLQISRGSASLEAFIVIKSNYPSTLPIISVCVNYNGVHHSENDDEIRDMERLLNVSVREALSPSVLSLQIVRLCSYFDVYLETTNPKEFPQTVTFVKSVSARNRRRPFIYRKVGNGIFTQY

SEQ ID NO: 27484 - protein, 77 aa, Diabrotica virgifera
  misc_feature: Coding regions on vcDNA: vcDNA=SeqID_7181; Strand=-; Position=67-300
  misc_feature (17)..(24): Xaa can be any naturally occurring amino acid
LPSKCVILFTNKLALPXXXXXXXXCSVTPKIFPLNQKHSNKNSPHFSSAQCYFFPISFNKNFTRKIRVFQKKSAIFN

SEQ ID NO: 27485 - protein, 86 aa, Diabrotica virgifera
  misc_feature: Coding regions on vcDNA: vcDNA=SeqID_7182; Strand=+; Position=68-326
  misc_feature: Homolog annotation: Hit_ID=O61703; Match level="QueryCoverage=94%, HitCoverage=24%, E-value=9e-18, Identity=58%"; Hit description =Phosphate carrier protein, mitochondrial precursor (Phosphate transport protein) (PTP)
  misc_feature: Gene Ontology Annotation: Molecular function=phosphate carrier activity; Cellular component=integral to plasma membrane; Biological process=transport
  misc_feature (33)..(33): Xaa can be any naturally occurring amino acid
  misc_feature (52)..(52): Xaa can be any naturally occurring amino acid
LFAERDTREVVSRHYVGLCGIGGILSCGITHTXAVVPPELEKGRIRGQHDKXKSVLNGFKVSHEEEGTRGKAKGRGPTFCLCKFGL

SEQ ID NO: 27486 - protein, 69 aa, Diabrotica virgifera
  misc_feature: Coding regions on vcDNA: vcDNA=SeqID_7183; Strand=-; Position=350-559
SQTNKDKNGKFSLFSSTSKKLGILNQFESKKLTNRIKNFNMAFAEYIQPYWLPRKLQNKSYSLSSYKYS

SEQ ID NO: 27487 - protein, 66 aa, Diabrotica virgifera; identical to SEQ ID NO: 26808
  misc_feature: Coding regions on vcDNA: vcDNA=SeqID_7184; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 27488 - protein, 283 aa, Diabrotica virgifera
  misc_feature: Coding regions on vcDNA: vcDNA=SeqID_7185; Strand=+; Position=80-931
  misc_feature (5)..(14): Xaa can be any naturally occurring amino acid
  misc_feature (23)..(33): Xaa can be any naturally occurring amino acid
  misc_feature (49)..(66): Xaa can be any naturally occurring amino acid
  misc_feature (71)..(103): Xaa can be any naturally occurring amino acid
  misc_feature (108)..(156): Xaa can be any naturally occurring amino acid
  misc_feature (170)..(179): Xaa can be any naturally occurring amino acid
  misc_feature (187)..(221): Xaa can be any naturally occurring amino acid
  misc_feature (235)..(248): Xaa can be any naturally occurring amino acid
  misc_feature (255)..(273): Xaa can be any naturally occurring amino acid
  misc_feature (277)..(283): Xaa can be any naturally occurring amino acid
DNTFXXXXXXXXXXPWVSGIITXXXXXXXXXXXQTSHITPFIVKYIFYXXXXXXXXXXXXXXXXXXHINSXXXXXXXXXXXXXXXXXXXXXXXXXXXXXXXXXNFYIXXXXXXXXXXXXXXXXXXXXXXXXXXXXXXXXXXXXXXXXXXXXXXXXXLYIQYKYIGLITEXXXXXXXXXXQTCLLALXXXXXXXXXXXXXXXXXXXXXXXXXXXXXXXXXXXGWMNQQLSLSNLYXXXXXXXXXXXXXXPKDPYRXXXXXXXXXXXXXXXXXXXHLIXXXXXXX

SEQ ID NO: 27489 - protein, 123 aa, Diabrotica virgifera
  misc_feature: Coding regions on vcDNA: vcDNA=SeqID_7186; Strand=+; Position=122-491
  misc_feature: Homolog annotation: Hit_ID=XP_311467.1; Match level="QueryCoverage =88%, HitCoverage=49%, E-value=7e-34, Identity=67%"; Hit description =ENSANGP00000023564 [Anopheles gambiae]
  misc_feature: Gene Ontology Annotation: Molecular function=GTPase inhibitor activity; Cellular component=cytoplasm; Biological process=signal transduction
  misc_feature (76)..(76): Xaa can be any naturally occurring amino acid
  misc_feature (102)..(102): Xaa can be any naturally occurring amino acid
MQNPNEDTEWNDVLRAKGIIPQKEKEITEDQIVSMLEETIEKKTANGKNLSELDLDELDELEDSEDEAVLLEYRNXRIEELRALSERQKFGFGGEICAQDYXTEVDKAGRGNMRNFWFSHSKD

SEQ ID NO: 27490 - protein, 159 aa, Diabrotica virgifera
  misc_feature: Coding regions on vcDNA: vcDNA=SeqID_7187; Strand=-; Position=270-749
  misc_feature (7)..(16): Xaa can be any naturally occurring amino acid
  misc_feature (30)..(36): Xaa can be any naturally occurring amino acid
PAGAREXXXXXXXXXXAGPAPPGGVCLWPXXXXXXXHAPPPIKKPKGPKTHGPSKRKKRVGKCFPRSPGFFISIFQKRKAIPFVFFKGFATLLVIFVCKREEGGGVLRPFFPLGLEWGGLDFPFCSSSLPSKPIWNILPDWSPCHPTVCNQAFWEYHPN

SEQ ID NO: 27491 - protein, 36 aa, Diabrotica virgifera
  misc_feature: Coding regions on vcDNA: vcDNA=SeqID_7188; Strand=-; Position=20-130
LCSGRLVRTTKRGANIIDIWSESYGMQTQQSLQILR

SEQ ID NO: 27492 - protein, 66 aa, Diabrotica virgifera; identical to SEQ ID NO: 26808
  misc_feature: Coding regions on vcDNA: vcDNA=SeqID_7189; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 27493 - protein, 138 aa, Diabrotica virgifera
  misc_feature: Coding regions on vcDNA: vcDNA=SeqID_7190; Strand=-; Position=91-507
  misc_feature: Homolog annotation: Hit_ID=BAC82590.1; Match level="QueryCoverage =81%, HitCoverage=10%, E-value=4e-12, Identity=32%"; Hit description =reverse transcriptase [Ciona intestinalis]
  misc_feature (34)..(51): Xaa can be any naturally occurring amino acid
  misc_feature (92)..(98): Xaa can be any naturally occurring amino acid
VQEKSLEYNKPAYLCFVDLKKAFDRVTLKDVINXXXXXXXXXXXXXXXXXXYQNNTIKVKVEDELTDPIEAGNGIKQGDSLSPLLFNLIMGXXXXXXXTKKGYQMGEKQLKIICYADDAILLLLLVPIRLEYWRSFWL

SEQ ID NO: 27494 - protein, 290 aa, Diabrotica virgifera
  misc_feature: Coding regions on vcDNA: vcDNA=SeqID_7191; Strand=+; Position=59-927
  misc_feature: Homolog annotation: Hit_ID=NP_524958.2; Match level="QueryCoverage =78%, HitCoverage=56%, E-value=1e-17, Identity=27%"; Hit description =CG9456-PA [Drosophila melanogaster] gb|AAF57408.2| CG9456-PA [Drosophila melanogaster]
  misc_feature: Gene Ontology Annotation: Molecular function=serpin; Cellular component=cellular_component unknown; Biological process=peripheral nervous system development
  misc_feature: Pfam annotation: Pfam_ID=Serpin; Match level="Score=-138.1, E-value =7.4e-05, Copies=1"; Pfam description=Serpin (serine protease inhibitor)
  misc_feature (254)..(254): Xaa can be any naturally occurring amino acid
MKILAALVLLCTLNYHSSLASDDGFKGIISPTNQKMYGQALEAIFTMGFRLQDILNMSTEQNLVVSPLSTAAIIGQLMIGADGEFREELHELLGLPPSLASFNVTHFSKERNESQILPYATFHLQLAILIKNLRQRKPGEEFVLNVANAMFYNSDIDLRTVFTSSLNKMYDTDITPLDFSKDTTRIINQWAADRTNGLIKSFLTSPPPRNTASMFLNSIYFYADWETPFSDSLNHMDTFTVSPTHNVSVLYMVXQNERRTIHRNEKYKLVCLPYKNRELGMDVFLPRIHH

SEQ ID NO: 27495 - protein, 140 aa, Diabrotica virgifera
  misc_feature: Coding regions on vcDNA: vcDNA=SeqID_7192; Strand=+; Position=367-789
  misc_feature: Homolog annotation: Hit_ID=CAD29192.1; Match level="QueryCoverage =79%, HitCoverage=39%, E-value=1e-20, Identity=52%"; Hit description =putative actin [Chelonus inanitus]
  misc_feature: Gene Ontology Annotation: Molecular function=structural constituent of cytoskeleton; Cellular component=cytoskeleton; Biological process= actin cytoskeleton organization and biogenesis
  misc_feature (71)..(71): Xaa can be any naturally occurring amino acid
  misc_feature (130)..(130): Xaa can be any naturally occurring amino acid
NYAVIPKVIYSYPSIGSSRDLACPVSNLYDRGNWTDGSVSKAEAGVLHTEPLYEGKKLSNAILGLEFGAAXTRPANLLEGLLLERGYPFTTAVDREFVRDIRQKPCYVALYFEEEMAAAAASTSPRKEVXLPDGKGLPYW

SEQ ID NO: 27496 - protein, 66 aa, Diabrotica virgifera
  misc_feature: Coding regions on vcDNA: vcDNA=SeqID_7193; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (57)..(65): Xaa can be any naturally occurring amino acid
PFXXXXXXXXXXXTTLAHTGLNXXXXXXXXSNXXXXXXXXXXXXXXPTSRSQSILSXXXXXXXXXV

SEQ ID NO: 27497 - protein, 98 aa, Diabrotica virgifera
  misc_feature: Coding regions on vcDNA: vcDNA=SeqID_7194; Strand=-; Position=446-742
WIFCRVSIQLYGRVVEYIGQCRVDDSVAVTPARPIAGMMPMQASSHHAFGLCRCWAGDMVRTYLVTSTHGEQGAFSTRGFSRDLQGFVQSMRMSAMSP

SEQ ID NO: 27498 - protein, 68 aa, Diabrotica virgifera
  misc_feature: Coding regions on vcDNA: vcDNA=SeqID_7195; Strand=+; Position=473-676
  misc_feature (15)..(25): Xaa can be any naturally occurring amino acid
VEGYLKEQHLKMIQXXXXXXXXXXXAVASFLNIRSQKEDDLRCTLYISDRIILKHINQKDYFSLRISL

SEQ ID NO: 27499 - protein, 20 aa, Diabrotica virgifera
  misc_feature: Coding regions on vcDNA: vcDNA=SeqID_7196; Strand=-; Position=1-60
VVRYINNIMVFVSVYRSRMM

SEQ ID NO: 27500 - protein, 101 aa, Diabrotica virgifera
  misc_feature: Coding regions on vcDNA: vcDNA=SeqID_7197; Strand=-; Position=424-729
  misc_feature (5)..(15): Xaa can be any naturally occurring amino acid
  misc_feature (92)..(101): Xaa can be any naturally occurring amino acid
KSPGXXXXXXXXXXXVEFFKEKCKIFVPLLNSLRHPIRESLCRLFRSFFLPIQGKLYINRFFWLDITKHMQFSINMGNNYLFSVGIKLIEHXXXXXXXXXX

SEQ ID NO: 27501 - protein, 259 aa, Diabrotica virgifera
  misc_feature: Coding regions on vcDNA: vcDNA=SeqID_7198; Strand=+; Position=1-780
  misc_feature: Homolog annotation: Hit_ID=XP_322034.1; Match level="QueryCoverage =96%, HitCoverage=58%, E-value=3e-72, Identity=53%"; Hit description =ENSANGP00000012075 [Anopheles gambiae]
  misc_feature: Gene Ontology Annotation: Molecular function=glycine dehydrogenase (decarboxylating) activity; Cellular component=mitochondrion; Biological process=glycine metabolism
  misc_feature: Pfam annotation: Pfam_ID=GCV_T; Match level="Score=20.8, E-value=1.1e- 08, Copies=1"; Pfam description=Glycine cleavage T-protein (aminometh
ILKNFSGNSVIRLLSNDAKGETTALYNFHVENGGKIVNFGGFMLPVQYNNLSIVNSHLFTRSNASLFDVSHMLQTEIRGAKCVEFFETTCTADLQGLKKNTGSLTVFTNEKGGILDDLIVTKIDEDHLYVVSNAARKQHDQQLMLRALDAYKKNNSAADINIKFYEPSGRSLLALQGPKAAESLQNLTEVKLSELYFMNTTTGSVAGVSDCRITRCGYTGENGFEISIPASETVKVAKTLLENINVKLAGLGARDSLKI

SEQ ID NO: 27502 - protein, 66 aa, Diabrotica virgifera
  misc_feature: Coding regions on vcDNA: vcDNA=SeqID_7199; Strand=-; Position=1-198
  misc_feature (4)..(14): Xaa can be any naturally occurring amino acid
  misc_feature (23)..(30): Xaa can be any naturally occurring amino acid
  misc_feature (52)..(64): Xaa can be any naturally occurring amino acid
VLFXXXXXXXXXXXPPGLTPFKXXXXXXXXSNRLYNIAATPIINLIQHRGRXXXXXXXXXXXXXLL

SEQ ID NO: 27503 - protein, 312 aa, Diabrotica virgifera
  misc_feature: Coding regions on vcDNA: vcDNA=SeqID_7200; Strand=-; Position=3-937
  misc_feature: Homolog annotation: Hit_ID=AAF87760.1; Match level="QueryCoverage =100%, HitCoverage=70%, E-value=1e-131, Identity=77%"; Hit description=cytochrome oxidase subunit I [Diabrotica virgifera zeae]
  misc_feature: Pfam annotation: Pfam_ID=COX1; Match level="Score=144.0, E-value=3.4e- 40, Copies=1"; Pfam description=Cytochrome C and Quinol oxidase polyp
  misc_feature (11)..(11): Xaa can be any naturally occurring amino acid
  misc_feature (15)..(15): Xaa can be any naturally occurring amino acid
  misc_feature (25)..(25): Xaa can be any naturally occurring amino acid
  misc_feature (71)..(71): Xaa can be any naturally occurring amino acid
  misc_feature (74)..(74): Xaa can be any naturally occurring amino acid
  misc_feature (88)..(88): Xaa can be any naturally occurring amino acid
  misc_feature (123)..(123): Xaa can be any naturally occurring amino acid
  misc_feature (140)..(140): Xaa can be any naturally occurring amino acid
  misc_feature (143)..(149): Xaa can be any naturally occurring amino acid
  misc_feature (196)..(196): Xaa can be any naturally occurring amino acid
  misc_feature (203)..(219): Xaa can be any naturally occurring amino acid
  misc_feature (250)..(250): Xaa can be any naturally occurring amino acid
  misc_feature (266)..(273): Xaa can be any naturally occurring amino acid
  misc_feature (294)..(294): Xaa can be any naturally occurring amino acid
VLAGAITILLXDRNXNTSFFDPAGXGDPILYQHLFDFLGHPEVYILILPGLGLISHMFRQERRKKEAFGTXGIXYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAHFHYVLSIGAVFAIIAGFIQXFPLFTGXXXXXXXXXXXXXXXXXGVNLTFFPQHFLGLIGIPRRYSDYPDVFILXNIVSSIGSLISLIGVXXXXXXXXEAFSFQRKRLRPLRITSSIEXLQFNPPAEHRYSELPILS

SEQ ID NO: 27504 - protein, 24 aa, Diabrotica virgifera
  misc_feature: Coding regions on vcDNA: vcDNA=SeqID_7201; Strand=-; Position=1-72
  misc_feature (16)..(16): Xaa can be any naturally occurring amino acid
INLIQHRGRNLYYRFXLSNKITLL

SEQ ID NO: 27505 - protein, 90 aa, Diabrotica virgifera
  misc_feature: Coding regions on vcDNA: vcDNA=SeqID_7202; Strand=+; Position=2-274
  misc_feature (1)..(11): Xaa can be any naturally occurring amino acid
  misc_feature (13)..(37): Xaa can be any naturally occurring amino acid
  misc_feature (47)..(60): Xaa can be any naturally occurring amino acid
  misc_feature (66)..(79): Xaa can be any naturally occurring amino acid
  misc_feature (82)..(89): Xaa can be any naturally occurring amino acid
XXXXXXXXXXXVXXXXXXXXXXXXXXXXXXXXXXXXXLRINYLRDNXXXXXXXXXXXXXXRPRCWXXXXXXXXXXXXXXVRXXXXXXXXV

SEQ ID NO: 27506 - protein, 166 aa, Diabrotica virgifera
  misc_feature: Coding regions on vcDNA: vcDNA=SeqID_7203; Strand=-; Position=1-498
  misc_feature (5)..(12): Xaa can be any naturally occurring amino acid
  misc_feature (60)..(143): Xaa can be any naturally occurring amino acid
  misc_feature (145)..(166): Xaa can be any naturally occurring amino acid
NSNIXXXXXXXXRTKPLINLSCFPPIFKLLIHTLEVANLYYDLDLSKKNSAVIPKGNFFXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXXXXXX

SEQ ID NO: 27507 - protein, 134 aa, Diabrotica virgifera
  misc_feature: Coding regions on vcDNA: vcDNA=SeqID_7204; Strand=+; Position=2-406
  misc_feature: Homolog annotation: Hit_ID=XP_321835.1; Match level="QueryCoverage =99%, HitCoverage=39%, E-value=9e-63, Identity=88%"; Hit description =ENSANGP00000020396 [Anopheles gambiae]
  misc_feature: Gene Ontology Annotation: Molecular function=succinate-CoA ligase (ADP-forming) activity; Cellular component=mitochondrion; Biological process=succinyl-CoA metabolism
  misc_feature: Pfam annotation: Pfam_ID=Ligase_CoA; Match level="Score=129.4, E -value=8.3e-36, Copies=1"; Pfam description=CoA-ligase
TTQVGLGQTHCVGIGGDPFNGTDFIDCLEVFLKDPETKGIILIGEIGGVAEEQAADYLIKHNSGSNAKPVVSFIAGLSAPPGRRMGHAGAIISGGKGGAQDKINALEKAGVIVTKSPAQMGNELLKEMRRLGLA

SEQ ID NO: 27508 - protein, 41 aa, Diabrotica virgifera
  misc_feature: Coding regions on vcDNA: vcDNA=SeqID_7205; Strand=-; Position=1-123
VTRDTKYRQSAKIALFGGGLPLKKIHWASVECRTGLRLQSY

SEQ ID NO: 27509 - protein, 37 aa, Diabrotica virgifera
  misc_feature: Coding regions on vcDNA: vcDNA=SeqID_7206; Strand=-; Position=84-197
LILFVRLHFSRWSTPSSSTMSYILSSILINSYIWNCI

SEQ ID NO: 27510 - protein, 287 aa, Diabrotica virgifera
  misc_feature: Coding regions on vcDNA: vcDNA=SeqID_7207; Strand=-; Position=2-862
  misc_feature (12)..(269): Xaa can be any naturally occurring amino acid
LFVGVGVLESKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKSSYLIFSGYKIAPPRR

SEQ ID NO: 27511 - protein, 138 aa, Diabrotica virgifera
  misc_feature: Coding regions on vcDNA: vcDNA=SeqID_7208; Strand=+; Position=277-693
RSTRNYLLYPLQKYASLYLPVIHKCVQNYFSALHLYISFPVTPNSSIWHPPSFSIGLYLWPYLLPLPRSFSYLCNQLQLFFSRTMRIGLAFFISATVHYTAFFDMRHSILPYLYTIFLVICVNLFSIFTILLYILIDF

SEQ ID NO: 27512 - protein, 108 aa, Diabrotica virgifera
  misc_feature: Coding regions on vcDNA: vcDNA=SeqID_7209; Strand=+; Position=772-1098
  misc_feature (64)..(71): Xaa can be any naturally occurring amino acid
  misc_feature (79)..(100): Xaa can be any naturally occurring amino acid
ETQLFYFVLNLFALFYIDPGVNLSETILLHFILFTTLAKSIKLPLFYVYLVWYLGQTLGRAPNXXXXXXXXPQPIQPSXXXXXXXXXXXXXXXXXXXXXXIPPREKNL

SEQ ID NO: 27513 - protein, 109 aa, Diabrotica virgifera
  misc_feature: Coding regions on vcDNA: vcDNA=SeqID_7210; Strand=-; Position=451-780
CVREKPKNCDALKNAHEKNHTTDLLNVSVRPIMTYASETRPDTATTQRLLETAEMRVLRRITGNTLRDRKRGEDIRRQCNVQYINEWTLNRKREWNNHITRMGGHVWSK

SEQ ID NO: 27514 - protein, 73 aa, Diabrotica virgifera
  misc_feature: Coding regions on vcDNA: vcDNA=SeqID_7211; Strand=+; Position=6-227
GGAYQLLPPRDFCCTDPVAPLLNVWLSPTGEACRFTHLPDVRILFSKYLNISYHRVFFENITFLNQGYASLVE

SEQ ID NO: 27515 - protein, 66 aa, Diabrotica virgifera
  misc_feature: Coding regions on vcDNA: vcDNA=SeqID_7212; Strand=-; Position=1-198
FFFGRHCSITYKPGFIVSSPFLYLLQGPHSLGSLSTLIGGFCYPRQINSFYYLFTTSPYANNNIIL

SEQ ID NO: 27516 - protein, 80 aa, Diabrotica virgifera
  misc_feature: Coding regions on vcDNA: vcDNA=SeqID_7213; Strand=+; Position=125-367
DRFFTKMTSIKTVGTIVLKLLKIGDPFDIVLILYRTEISKLLLGSKRNLQSNPRKKSRSHKYVGFRGYIGRIYDVHLSSR

SEQ ID NO: 27517 - protein, 89 aa, Diabrotica virgifera
  misc_feature: Coding regions on vcDNA: vcDNA=SeqID_7214; Strand=-; Position=311-580
  misc_feature (46)..(51): Xaa can be any naturally occurring amino acid
ETCTPLKMTFGCYYALERGVLIRVRTGITPPRSNVPDHPFPSIALXXXXXXQYQPNSLHVEVPGTRTPTWFPNRSMQSSVRRFIPAIFL

SEQ ID NO: 27518 - protein, 76 aa, Diabrotica virgifera
  misc_feature: Coding regions on vcDNA: vcDNA=SeqID_7215; Strand=-; Position=2-229
  misc_feature (1)..(10): Xaa can be any naturally occurring amino acid
  misc_feature (13)..(23): Xaa can be any naturally occurring amino acid
  misc_feature (33)..(40): Xaa can be any naturally occurring amino acid
  misc_feature (43)..(56): Xaa can be any naturally occurring amino acid
  misc_feature (62)..(75): Xaa can be any naturally occurring amino acid
XXXXXXXXXXPFXXXXXXXXXXXTNLAHTGLNXXXXXXXXSNXXXXXXXXXXXXXXPTSRSXXXXXXXXXXXXXXV

SEQ ID NO: 27519 - protein, 346 aa, Diabrotica virgifera
  misc_feature: Coding regions on vcDNA: vcDNA=SeqID_7216; Strand=-; Position=62-1103
  misc_feature: Homolog annotation: Hit_ID=AAK61383.1; Match level="QueryCoverage =96%, HitCoverage=94%, E-value=1e-76, Identity=47%"; Hit description =basic proline-rich protein [Sus scrofa]
  misc_feature: Gene Ontology Annotation: Molecular function=general RNA polymerase II transcription factor activity; Cellular component=extracellular space; Biological process=actin filament-based movement
  misc_feature (118)..(118): Xaa can be any naturally occurring amino acid
  misc_feature (277)..(277): Xaa can be any naturally occurring amino acid
  misc_feature (311)..(311): Xaa can be any naturally occurring amino acid
PPPPGPARRRGAGRGPPAAGRRRGAPAAPPAAAGGRWRGTPSAPAGPGPRPPPPAPLGPAPRGGPRGPARGGGAGPPPAPPAPPRRAGAPPVGAPPPRIGAPPGAGGRPPPRPPPAGXPAGPPPPGPPRGAAGAPPPAGPARRGGRAPVPRSPPRPCPRRRRARGRPGPPPGPAGPRAGRPRRRRPPPPPGDGVHPGGPAARPPAAPPPGPGPPPPGPGRPAGPARPGRRPALPPPRFGAAPASGRARPPPPPPPPAPPPPPGAPPPPRPPCAAPPXPAPRAPSAPPRPPPPPRPPPPAPPPRAAGSGCGXPPPPPPDRNHKKPNRTTNKPTPPTTTKKKTKENAI

SEQ ID NO: 27520 - protein, 273 aa, Diabrotica virgifera
  misc_feature: Coding regions on vcDNA: vcDNA=SeqID_7217; Strand=+; Position=121-938
  misc_feature: Homolog annotation: Hit_ID=XP_312370.1; Match level="QueryCoverage =86%, HitCoverage=27%, E-value=8e-61, Identity=45%"; Hit description =ENSANGP00000012172 [Anopheles gambiae]
  misc_feature: Gene Ontology Annotation: Biological process=diacylglycerol catabolism
  misc_feature: Pfam annotation: Pfam_ID=HSL_N; Match level="Score=-25.3, E-value =4.5e-06, Copies=1"; Pfam description=Hormone-sensitive lipase (HSL) N-term
  misc_feature (254)..(254): Xaa can be any naturally occurring amino acid
MIDSNKENQDDINTVENPTKNVADTENIPVTERALKINNLVEMCKSNATFFARDNTENGQRLYLSFLAMVDVVDRIQPKLISIESQVHFFDFDESVPGNGYRSFLIVIDGAIQMAVECSEKVLQKRDSTFFRKSTLTKDVESCSHLLTSLDSCLTHLGTIMSWSERGSLFVNEDCPLGDLFSKYGEINQHCFYGRNLGFQYCDSIRNVLQFIALSMTLFSEVYYSQGSLISKATSSVVSTTKFITDPGQRARRXVNIAQNAEVDFCKAFWFLS

SEQ ID NO: 27521 - protein, 268 aa, Diabrotica virgifera
  misc_feature: Coding regions on vcDNA: vcDNA=SeqID_7218; Strand=+; Position=4-898
  misc_feature: Homolog annotation: Hit_ID=NP_005871.1; Match level="QueryCoverage =100%, HitCoverage=66%, E-value=7e-97, Identity=62%"; Hit description= DnaJ subfamily A member 2 [Homo sapiens] gb|AAH15809.1| DnaJ subfamily A member 2 [Homo sapiens]
  misc_feature: Gene Ontology Annotation: Molecular function=heat shock protein activity; Cellular component=cytosol; Biological process=G1 phase of mitotic cell cycle
  misc_feature: Pfam annotation: Pfam_ID=DnaJ; Match level="Score=128.1, E-value=2.2e- 35, Copies=1"; Pfam description=DnaJ domain
  misc_feature (223)..(223): Xaa can be any naturally occurring amino acid
  misc_feature (249)..(249): Xaa can be any naturally occurring amino acid
MADNTLYDILGVPRNAPANDIKKQYRKLAKEFHPDKNPAAGDKFKEISYAYEVLSDPKKRSLYDRVGLKGMQEGAHDGFGGDDLLSHLFGGGLFGGFGGGGPRRRLRGEDTVHPLKVSLEDMYNGKTLKLQLSKNVICNTCSGKGSKSGNTEKCSTCNGCGLKVTYRQVVPGMAQQTQTRCPDCHGEGEIIKEKDRCSSCKGKKVCNETKILEVHVDKGMNLXGEGDQQPDVEPGDVVIILQQKPHEKXFQRNGDDLHGKHNISFTEA

SEQ ID NO: 27522 - protein, 122 aa, Diabrotica virgifera
  misc_feature: Coding regions on vcDNA: vcDNA=SeqID_7219; Strand=-; Position=1-366
  misc_feature (9)..(20): Xaa can be any naturally occurring amino acid
  misc_feature (78)..(87): Xaa can be any naturally occurring amino acid
QHPPLLNKXXXXXXXXXXXXYLQHPQSLFCGENWVMGGRTRRFFFLPRGAKIRGKKSPPHTISARTFKRWVPPCGKTXXXXXXXXXXGFFPAFWRIPGWKVNPPWGPPNLILQAFFFLFTQG

SEQ ID NO: 27523 - protein, 263 aa, Diabrotica virgifera
  misc_feature: Coding regions on vcDNA: vcDNA=SeqID_7220; Strand=-; Position=67-858
KSIGEALPYLLRKFSLWNEKRTNSSFKTLYPFIAFSKEEFETWPFGKMLNAEWNRAKEIKKILSARFPSLRKWSTRAIFMYARSHKYSPVLSSAAFFKHSSEDLRLINDCFSEVEAGAINIKSLDIDVKVDIESEGDNSSPSTSRRTDASLPTTYIDISDSSLKNHCDFVRETALDCGIILRSEEISDGVIMNGAARMMLEAVKCLAEGLIRRSNHHLVCRKDYREGFSEVTANEVKIALQERSEIMSINQFAAKKREIEFYS

SEQ ID NO: 27524 - protein, 131 aa, Diabrotica virgifera
  misc_feature: Coding regions on vcDNA: vcDNA=SeqID_7221; Strand=+; Position=542-937
  misc_feature (31)..(47): Xaa can be any naturally occurring amino acid
  misc_feature (49)..(76): Xaa can be any naturally occurring amino acid
  misc_feature (79)..(79): Xaa can be any naturally occurring amino acid
  misc_feature (81)..(101): Xaa can be any naturally occurring amino acid
  misc_feature (104)..(131): Xaa can be any naturally occurring amino acid
SVGRRDFIFNTKRHVFNKQVKKMLPNSFIKXXXXXXXXXXXXXXXXXLXXXXXXXXXXXXXXXXXXXXXXXXXXXXYFXIXXXXXXXXXXXXXXXXXXXXXHPXXXXXXXXXXXXXXXXXXXXXXXXXXXX

SEQ ID NO: 27525 - protein, 79 aa, Diabrotica virgifera
  misc_feature: Coding regions on vcDNA: vcDNA=SeqID_7222; Strand=+; Position=2-241
  misc_feature: Homolog annotation: Hit_ID=XP_311434.1; Match level="QueryCoverage =64%, HitCoverage=14%, E-value=1e-18, Identity=88%"; Hit description =ENSANGP00000000580 [Anopheles gambiae]
  misc_feature: Gene Ontology Annotation: Molecular function=DNA helicase activity; Cellular component=mitochondrion; Biological process=DNA unwinding
KASQEADNILIIQDKRLTALRGKKYLQVVKNRYSGDLGIMPLDFDKDSLSFQQKKPKEKKVDLIQPLTHPETDVSIPKI

SEQ ID NO: 27526 - protein, 96 aa, Diabrotica virgifera
  misc_feature: Coding regions on vcDNA: vcDNA=SeqID_7223; Strand=+; Position=2-292
  misc_feature: Homolog annotation: Hit_ID=AAH88711.1; Match level="QueryCoverage =98%, HitCoverage=19%, E-value=1e-12, Identity=39%"; Hit description =Unknown (protein for IMAGE:7201876) [Xenopus laevis]
  misc_feature: Gene Ontology Annotation: Cellular component=26S proteasome
SFPTEIKLAGLGIIQIMASQQWGQEEIKNSPGLIEYLLDRNIEVIKECKEVKYEIIKLLSSSTIFDEFTLKRLQKYVKEGPFHVEAITEVAFESNE

SEQ ID NO: 27527 - protein, 255 aa, Diabrotica virgifera
  misc_feature: Coding regions on vcDNA: vcDNA=SeqID_7224; Strand=+; Position=6-774
  misc_feature: Homolog annotation: Hit_ID=AAT38514.1; Match level="QueryCoverage =96%, HitCoverage=48%, E-value=5e-51, Identity=42%"; Hit description =antennae-rich cytochrome P450 [Phyllopertha diversa]
  misc_feature (93)..(99): Xaa can be any naturally occurring amino acid
  misc_feature (219)..(219): Xaa can be any naturally occurring amino acid
MLLTSSWIVDVLAFSVTLSTLLYIYFTRHFSYWKKRNVFYRKPTPFFGNFKDVASMKTTIGEWLRDEYNKAAKQPYFGIFVFDEPKLVIKSPXXXXXXXIKDFNNFCDRTFASPEHNEVESNFLFMMHNPKWKKHRTQLSPAFTSGKLKAMLPIIHEVGQSLQKYLSDNQTVLEAKEVMAKYSTDVIGKCFLGINPHCFDNDDALFRVLGRAMFDFSIXNALKQNCVFFLHPELLSSLKINFFRANGAQIIFLTL

SEQ ID NO: 27528 - protein, 244 aa, Diabrotica virgifera
  misc_feature: Coding regions on vcDNA: vcDNA=SeqID_7225; Strand=+; Position=1-735
  misc_feature (230)..(230): Xaa can be any naturally occurring amino acid
ELPKMICETCLYKLELFTDFRERSARTEKLLIELYKELSNCIQNGQTCLVPIHTNELIMVQQHLQNVSDISLPSLSQNQDIIMTSDMNSHSLENIVTSSLSNTDFSNQAFDTQQEPVVDSSSGSKFEDNLSLIQQHQLLTEQFRLQQDLQLDNANIPLLNDLKDSSNHSTHRFDFQVKLEEQNICRLQFESHKLSLNQITSKSDLETYKQEDSSSNSNSLSSSHLEKRLXRDRSRKSIEPKRHV

SEQ ID NO: 27529 - protein, 91 aa, Diabrotica virgifera
  misc_feature: Coding regions on vcDNA: vcDNA=SeqID_7226; Strand=+; Position=1-276
  misc_feature (75)..(81): Xaa can be any naturally occurring amino acid
TSLWMSLNRENILQALFFSVFPPLAAVLSYQYAPVCELFYYFNICVVYCENDFPNIVPIFVSFWGSIPLAEVQCXXXXXXXCNSLYIYVEL

SEQ ID NO: 27530 - protein, 195 aa, Diabrotica virgifera
  misc_feature: Coding regions on vcDNA: vcDNA=SeqID_7227; Strand=-; Position=87-674
  misc_feature (4)..(18): Xaa can be any naturally occurring amino acid
  misc_feature (39)..(62): Xaa can be any naturally occurring amino acid
  misc_feature (68)..(79): Xaa can be any naturally occurring amino acid
  misc_feature (90)..(100): Xaa can be any naturally occurring amino acid
  misc_feature (105)..(150): Xaa can be any naturally occurring amino acid
  misc_feature (177)..(184): Xaa can be any naturally occurring amino acid
LGGXXXXXXXXXXXXXXXGVFLAFFKMGKNPGGGEFPAXXXXXXXXXXXXXXXXXXXXXXXXKRGGKXXXXXXXXXXXXGPFWKINPQGXXXXXXXXXXXPNHPXXXXXXXXXXXXXXXXXXXXXXXXXXXXXXXXXXXXXXXXXXXXXXLLLNLFKCLINSGSKAQRISFDQNNYXXXXXXXXQNIGIYFSCFT

SEQ ID NO: 27531 - protein, 88 aa, Diabrotica virgifera
  misc_feature: Coding regions on vcDNA: vcDNA=SeqID_7228; Strand=-; Position=1-264
  misc_feature: Homolog annotation: Hit_ID=NP_884770.1; Match level="QueryCoverage =100%, HitCoverage=19%, E-value=3e-43, Identity=96%"; Hit description= argininosuccinate synthase [Bordetella parapertussis 12822] ref|NP _888531.1|
KLGRLLYQGRWFDPQAIMLRETAQRWVARAVTGEVTIELRRGNDYSLLNTESPNLTYAPERLSMEKVENAPFTPADRIGQLTMRNLDI

SEQ ID NO: 27532 - protein, 142 aa, Diabrotica virgifera
  misc_feature: Coding regions on vcDNA: vcDNA=SeqID_7229; Strand=-; Position=231-659
  misc_feature: Homolog annotation: Hit_ID=XP_396801.1; Match level="QueryCoverage =100%, HitCoverage=19%, E-value=2e-34, Identity=50%"; Hit description= similar to ENSANGP00000002547 [Apis mellifera]
  misc_feature: Gene Ontology Annotation: Molecular function=electron transporter activity; Biological process=UDP-glucose metabolism
  misc_feature: Pfam annotation: Pfam_ID=UDPG_MGDP_dh_C; Match level="Score=68.9, E -value=1.4e-17, Copies=1"; Pfam description=UDP-glucose/GDP-mannose dehydrogenase
  misc_feature (110)..(115): Xaa can be any naturally occurring amino acid
QIIQFNFNSLSGKKICMLGFAFKKNTPDSRENPAIFVGKTLLGEGASLRIYDPKVSQGQIIKELCQPGICDGPELYKNPIFLFKDAYEGANECPPILVCSEWGEFFAFGXXXXXXDMMKPAYLFDGRKILGPQELIEIGFHV

SEQ ID NO: 27533 - protein, 233 aa, Diabrotica virgifera
  misc_feature: Coding regions on vcDNA: vcDNA=SeqID_7230; Strand=-; Position=1-699
  misc_feature: Homolog annotation: Hit_ID=EAA14002.2; Match level="QueryCoverage =93%, HitCoverage=72%, E-value=3e-25, Identity=33%"; Hit description =ENSANGP00000012351 [Anopheles gambiae str. PEST] ref|XP_554045.1| ENSANGP00000012351 [Anopheles gambiae st
SRSRTRGSIASPSEYVRYYQRFNKIFRIHTLQANQTIYLPGDNDIGGENEDVTPQKLNRFDKYFGLKPDVVFFENVKFSKVNFMLKTSPKYEPSESDINLSIIISHMSLLGASSFFTEKVIRELKPSLIISAHDHKAVHFVGDIETGERTHIESMLETPASNINWRWRFQTSKFHTNEIVVPTCSYRMGTRQTGYGVLLIDSEGDNVCYSVLWLPDRLLHLKIYFFLIFPSLT

SEQ ID NO: 27534 - protein, 195 aa, Diabrotica virgifera
  misc_feature: Coding regions on vcDNA: vcDNA=SeqID_7231; Strand=+; Position=3-592
  misc_feature: Homolog annotation: Hit_ID=XP_393332.1; Match level="QueryCoverage =80%, HitCoverage=24%, E-value=1e-72, Identity=77%"; Hit description =similar to GH03617p [Apis mellifera]
  misc_feature: Gene Ontology Annotation: Molecular function=structural molecule activity; Cellular component=nuclear pore; Biological process=cell cycle
  misc_feature: Pfam annotation: Pfam_ID=zf-NPL4; Match level="Score=330.4, E-value =2.6e-96, Copies=1"; Pfam description=NPL4 family, putative zinc binding reg
  misc_feature (161)..(161): Xaa can be any naturally occurring amino acid
  misc_feature (163)..(163): Xaa can be any naturally occurring amino acid
SKNRIRSGSANIKEDEVDLQLMKIDGKVQRNRDDKLCRHNANSRCVHCSPLEPYDEAYLKEHNIKHLSFHSYLRKMMSGVDRGKFLALEDISCRIKEGCKDHPPWPRGICSKCQPNAITLNMQAYRHVDNVAFENTNLVERLLNYWRVTGHQRIAFLYGNXEXHPDVPLGIYSLPFEYILNSTLTYDRLDPFPSP

SEQ ID NO: 27535 - protein, 97 aa, Diabrotica virgifera
  misc_feature: Coding regions on vcDNA: vcDNA=SeqID_7232; Strand=+; Position=2-292
  misc_feature: Homolog annotation: Hit_ID=XP_313674.1; Match level="QueryCoverage =91%, HitCoverage=12%, E-value=2e-15, Identity=46%"; Hit description =ENSANGP00000012684 [Anopheles gambiae]
PPFFVRKNSASDTEKCPLVWLWLQDKKKGKQATANAKKAIFEFFGFDFLRRVLLTTDEPVDCPPSVYQTEALSIISVLCNEKELSTRQEMLESRHMR

SEQ ID NO: 27536 - protein, 52 aa, Diabrotica virgifera
  misc_feature: Coding regions on vcDNA: vcDNA=SeqID_7233; Strand=+; Position=99-257
PWFSCRCGRRELKRRRAWAGPVDFVPILFYFLYHKCVLCHVDVLCILLTASG

SEQ ID NO: 27537 - protein, 158 aa, Diabrotica virgifera
  misc_feature: Coding regions on vcDNA: vcDNA=SeqID_7234; Strand=-; Position=10-486
  misc_feature (7)..(23): Xaa can be any naturally occurring amino acid
  misc_feature (37)..(43): Xaa can be any naturally occurring amino acid
  misc_feature (102)..(156): Xaa can be any naturally occurring amino acid
  misc_feature (158)..(158): Xaa can be any naturally occurring amino acid
VGSPFCXXXXXXXXXXXXXXXXXPGPPPPVFKLQNQXXXXXXXGNPALNKLKLGSPQFIKLLISNHRGSPILYLSNLDLFQIKNYGCYSPKGNFILINQKKXXXXXXXXXXXXXXXXXXXXXXXXXXXXXXXXXXXXXXXXXXXXXXXXXXXXXXXKX

SEQ ID NO: 27538 - protein, 21 aa, Diabrotica virgifera
  misc_feature: Coding regions on vcDNA: vcDNA=SeqID_7235; Strand=+; Position=1-63
KGFSGPPAPGEGNPGPRESPR

SEQ ID NO: 27539 - protein, 107 aa, Diabrotica virgifera
  misc_feature: Coding regions on vcDNA: vcDNA=SeqID_7236; Strand=-; Position=356-679
  misc_feature (13)..(19): Xaa can be any naturally occurring amino acid
  misc_feature (50)..(56): Xaa can be any naturally occurring amino acid
  misc_feature (78)..(84): Xaa can be any naturally occurring amino acid
AKTNFRLISLTTXXXXXXXFCPGKRYISLKSPYKATNIETKRFRSVTRAXXXXXXXTYIIYTYYMFSISNKQNVEVQXXXXXXXRSLVYLLFKGPLFTLLLKYLIED

SEQ ID NO: 27540 - protein, 176 aa, Diabrotica virgifera
  misc_feature: Coding regions on vcDNA: vcDNA=SeqID_7237; Strand=-; Position=83-612
  misc_feature: Homolog annotation: Hit_ID=NP_777225.1; Match level="QueryCoverage =81%, HitCoverage=21%, E-value=1e-19, Identity=41%"; Hit description =p97 protein [Bos taurus] dbj|BAA20065.1| bucentaur [Bos taurus]
  misc_feature (34)..(34): Xaa can be any naturally occurring amino acid
  misc_feature (60)..(60): Xaa can be any naturally occurring amino acid
SRSASNCEKWVPKSHKIYPESYGLGERKERGQRXIQSCQEEKCIIASTLFQQPKRRLYTXKSPADQEGKIVKNEIDYIIINRRFRNSITSAKTYPSADAATNHNLLCAGFKLKLKRIKAPSTQKKPNSRLLRNAVIADEVENKINREIKKQLERSEQENIGQNLDIMNSAMVTIAN

SEQ ID NO: 27541 - protein, 61 aa, Diabrotica virgifera
  misc_feature: Coding regions on vcDNA: vcDNA=SeqID_7238; Strand=-; Position=66-249
  misc_feature: Homolog annotation: Hit_ID=NP_572568.1; Match level="QueryCoverage =91%, HitCoverage=84%, E-value=3e-16, Identity=80%"; Hit description =CG2998-PA [Drosophila melanogaster] gb|EAL32719.1| GA15566-PA [Drosophila
  misc_feature: Pfam annotation: Pfam_ID=Ribosomal_S28e; Match level="Score=84.6, E -value=2.5e-22, Copies=1"; Pfam description=Ribosomal protein S28e
  misc_feature (24)..(24): Xaa can be any naturally occurring amino acid
FSSAYLQVLGRAGFRGQCTPVKVXEFRGEHTRQIIRNVKGPVREGDILPLLESEREARRLR

SEQ ID NO: 27542 - protein, 278 aa, Diabrotica virgifera
  misc_feature: Coding regions on vcDNA: vcDNA=SeqID_7239; Strand=+; Position=57-890
  misc_feature: Homolog annotation: Hit_ID=NP_861421.1; Match level="QueryCoverage =87%, HitCoverage=64%, E-value=2e-64, Identity=42%"; Hit description =zinc finger protein 233 [Homo sapiens]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=180.3, E-value =4.1e-51, Copies=6"; Pfam description=Zinc finger, C2H2 type
  misc_feature (158)..(158): Xaa can be any naturally occurring amino acid
  misc_feature (229)..(229): Xaa can be any naturally occurring amino acid
  misc_feature (261)..(262): Xaa can be any naturally occurring amino acid
MEVKQETCKIEIDNKEFDGDGTLDDFKIEIKEEPKREPAYNAFNYLDFPENAKLEQDEHKFNVCEETQTTKEESLRLNEIKTKSHTGQKPYKCKICFKQFGGAGSLKEHLRIHTGGKPYKCEICSKHFSRDGHLKIHLRVHNGEKPYKCKFCSKQFSXAEHLKTHFRIHTGQKPYKCEICSKQFNEAGNLRKHFRLHTGEKPYKCEICSKQFSEAGTLKKHIRIHTGEXLFKCEICLKQFSEAGTLKRHLRIHTGEKPYKXXICSKQFTEAGTLKSHL

SEQ ID NO: 27543 - protein, 290 aa, Diabrotica virgifera
  misc_feature: Coding regions on vcDNA: vcDNA=SeqID_7240; Strand=+; Position=3-871
  misc_feature: Homolog annotation: Hit_ID=AAD01425.1; Match level="QueryCoverage =100%, HitCoverage=55%, E-value=1e-122, Identity=73%"; Hit description=ryanodine receptor [Heliothis virescens]
  misc_feature: Gene Ontology Annotation: Molecular function=ryanodine-sensitive calcium-release channel activity; Cellular component=integral to membrane; Biological process=calcium ion transport
  misc_feature: Pfam annotation: Pfam_ID=RR_TM4-6; Match level="Score=50.8, E-value =2.9e-13, Copies=1"; Pfam description=Ryanodine Receptor TM 4-6
  misc_feature (57)..(63): Xaa can be any naturally occurring amino acid
  misc_feature (268)..(268): Xaa can be any naturally occurring amino acid
  misc_feature (272)..(272): Xaa can be any naturally occurring amino acid
SAMSQINFASYGHRAVSFLARNFYSLKYVALVLAFCINFMLLFYKVSSLNEDSGSGXXXXXXXDIIEGSGIEAGSGLDSGEDDDDLPELVHVDEDFYYMAHVMRLAAMLHSIVSLAMLIAYYHLKVPLAIFKREKEIARRLEFEGLYIAEQPEDDDLKSHWDKLVISAKSFPVNYWDKFIKKKVRQKYSETYDFDSISSLLGMEKTSFHQQESEEKKSLLSLIINIDWRYQIWKSGVTITDNSFLYSLWYFTFSILGKFHNFFFAAHXCLTXPVGFKTLRTILQSVTHNG

SEQ ID NO: 27544 - protein, 215 aa, Diabrotica virgifera
  misc_feature: Coding regions on vcDNA: vcDNA=SeqID_7241; Strand=+; Position=102-749
  misc_feature: Homolog annotation: Hit_ID=XP_392742.1; Match level="QueryCoverage =65%, HitCoverage=29%, E-value=1e-35, Identity=49%"; Hit description =similar to Wiskott-Aldrich syndrome protein (WASp) [Apis mellifera]
  misc_feature: Gene Ontology Annotation: Molecular function=actin polymerizing activity; Cellular component=vesicle membrane; Biological process =endosome transport
  misc_feature: Pfam annotation: Pfam_ID=WH1; Match level="Score=133.9, E-value=3.9e -37, Copies=1"; Pfam description=WH1 domain
MPPAIENHYCDILTDEENVQIFKLLGNRCQSLCTTVVQLYLTTPPDHSKWIKKTTGVLCFVKDNTKKNFFFRLFSIDRNIKLWEHEMYNHMDYIEATPFFHMFEGENCHVAFNFASIQDARDLRIVVNQKVNARKKREDKKNKVISQSQTLPPPTTQLNFNNYRKTLDPESHKRREEGTSLKSILEFLEILNISRMLYGTQTSCILMDNNSKTKA

SEQ ID NO: 27545 - protein, 132 aa, Diabrotica virgifera
  misc_feature: Coding regions on vcDNA: vcDNA=SeqID_7242; Strand=+; Position=210-608
  misc_feature (92)..(97): Xaa can be any naturally occurring amino acid
LAHFLTPGSNRQIFEIYTVLHVLNLPYINLMISSFSKGGFFFSPPLTNSPVLRVHMVEVHLHIQYRFWRGKTEGVTKGLEQQKISISIIMYXXXXXXGKEITLTEKFVHIFSGIPQDKRAVKGISILIGQKP

SEQ ID NO: 27546 - protein, 183 aa, Diabrotica virgifera
  misc_feature: Coding regions on vcDNA: vcDNA=SeqID_7243; Strand=-; Position=43-594
  misc_feature (60)..(67): Xaa can be any naturally occurring amino acid
  misc_feature (79)..(89): Xaa can be any naturally occurring amino acid
  misc_feature (92)..(92): Xaa can be any naturally occurring amino acid
  misc_feature (112)..(112): Xaa can be any naturally occurring amino acid
  misc_feature (118)..(118): Xaa can be any naturally occurring amino acid
  misc_feature (142)..(150): Xaa can be any naturally occurring amino acid
  misc_feature (153)..(153): Xaa can be any naturally occurring amino acid
  misc_feature (155)..(155): Xaa can be any naturally occurring amino acid
  misc_feature (181)..(181): Xaa can be any naturally occurring amino acid
LCLLVVDESSYCCSQRLFVRGAFGASSLHACWVSRSRIGRGGCDLICSILFSCVKNVSCXXXXXXXXNSFSSHLYLHTXXXXXXXXXXXSYXPSSYHTSSPSPLFPLTSIPXFSCSLXPPFLSSSLLLLSPSFVISFLSFPXXXXXXXXXSPXSXPSLEGNLVVFLVFHVWVAGVLLFCYXGL

SEQ ID NO: 27547 - protein, 127 aa, Diabrotica virgifera
  misc_feature: Coding regions on vcDNA: vcDNA=SeqID_7244; Strand=+; Position=26-409
  misc_feature: Homolog annotation: Hit_ID=XP_341743.1; Match level="QueryCoverage =83%, HitCoverage=62%, E-value=7e-23, Identity=49%"; Hit description =similar to histidine triad protein 4 [Rattus norvegicus]
  misc_feature: Pfam annotation: Pfam_ID=HIT; Match level="Score=56.4, E-value=8.1e -14, Copies=1"; Pfam description=HIT domain
MADCVFCEIISGQEEATLFFENDDFIIFKDIKPASKYHLQVVPKKHIRNIHYLKPQDKDFVEEMLVLSRYILELNGGDCNDARIGFHCPPYTSVNHLHLHVISPESEMRAYQRSRFESPKFKLVITI

SEQ ID NO: 27548 - protein, 72 aa, Diabrotica virgifera
  misc_feature: Coding regions on vcDNA: vcDNA=SeqID_7245; Strand=+; Position=3-221
  misc_feature: Homolog annotation: Hit_ID=BAC65417.1; Match level="QueryCoverage =84%, HitCoverage=18%, E-value=2e-10, Identity=42%"; Hit description =crustapain [Pandalus borealis]
EFDNYKKKFNKSYDTPEEEQKRFKIFQDNLRFIEDHNQKYQRGEVSSTVGVNQFADQSKDEWANRNHGLKID

SEQ ID NO: 27549 - protein, 281 aa, Diabrotica virgifera
  misc_feature: Coding regions on vcDNA: vcDNA=SeqID_7246; Strand=+; Position=25-870
  misc_feature: Homolog annotation: Hit_ID=XP_321065.1; Match level="QueryCoverage =95%, HitCoverage=42%, E-value=1e-40, Identity=39%"; Hit description =ENSANGP00000007859 [Anopheles gambiae]
  misc_feature: Gene Ontology Annotation: Molecular function=actin binding; Cellular component=chromatin remodeling complex; Biological process=chromatin modeling
  misc_feature (217)..(222): Xaa can be any naturally occurring amino acid
DQVLKRQVQSLTMHQKKLEAELQQIEEKFEAKKRKFIESSEQFQEELKKHCKPAVDEDTFQKMVERQYDIIKRDKSKQIQDDVKPKTEENGHATSPTTQENGTNQSEPMEQDQSDKMDQSQGPPAPSVTNGPSPPQAEKTTMDHPQQSPHPVGQPHYAHPSAAHPEHHQPPPPTQPMHSAHEPSPPHSSGNMHPHAPPPHQAGAPHHPPQQPSPGGXXXXXXPQGPHGPMPPHMQQNPAHPPSAQGPPPHQNPMMPPSQVPQQYAQQYPPQGQIRSRCPCT

SEQ ID NO: 27550 - protein, 167 aa, Diabrotica virgifera
  misc_feature: Coding regions on vcDNA: vcDNA=SeqID_7247; Strand=+; Position=2-502
  misc_feature: Homolog annotation: Hit_ID=AAF87760.1; Match level="QueryCoverage =100%, HitCoverage=37%, E-value=8e-56, Identity=69%"; Hit description= cytochrome oxidase subunit I [Diabrotica virgifera zeae]
  misc_feature (31)..(37): Xaa can be any naturally occurring amino acid
  misc_feature (51)..(51): Xaa can be any naturally occurring amino acid
  misc_feature (59)..(75): Xaa can be any naturally occurring amino acid
  misc_feature (105)..(105): Xaa can be any naturally occurring amino acid
  misc_feature (121)..(128): Xaa can be any naturally occurring amino acid
  misc_feature (149)..(149): Xaa can be any naturally occurring amino acid
FYLSVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFSFQRKRLRPLRITSSIEXLQFNLPAEHRYSELPILS

SEQ ID NO: 27551 - protein, 295 aa, Diabrotica virgifera
  misc_feature: Coding regions on vcDNA: vcDNA=SeqID_7248; Strand=+; Position=3-888
  misc_feature: Homolog annotation: Hit_ID=XP_315432.1; Match level="QueryCoverage =100%, HitCoverage=36%, E-value=2e-91, Identity=57%"; Hit description= ENSANGP00000007026 [Anopheles gambiae]
  misc_feature (240)..(246): Xaa can be any naturally occurring amino acid
  misc_feature (276)..(276): Xaa can be any naturally occurring amino acid
GPTENGEILNGTGEVTNGNCTDTDMSIKDYDRHSTSGASELQFSMRSRTPSLNGSLYSPTSMSRKMFGYRSPSPGLILRDHNKSAHLADDISRIYTYSYLTEEPTQGYLRKPIDPYDRAPTSPHFHRPTSQNSLRSSSGSGRRSTSRTAMKVLVDSMHTDVPRPKSPHMNNEEPIELAHFPGAKPPQPGEPTKIERDDFPAPPYPYTDPERRKRWSDSYKGVPSDEDEVDDATAREIQDXXXXXXXNELSKIASGIGKVFLKEVQEREKYKQWESXNLDPRNASRTPSAKKEPNY

SEQ ID NO: 27552 - protein, 160 aa, Diabrotica virgifera
  misc_feature: Coding regions on vcDNA: vcDNA=SeqID_7249; Strand=+; Position=24-506
  misc_feature: Homolog annotation: Hit_ID=BAD86655.1; Match level="QueryCoverage =79%, HitCoverage=9%, E-value=3e-21, Identity=42%"; Hit description =reverse transcriptase [Bombyx mori]
FTYKFSDQKRIFQRRDLTTVGYKMSKTGVSTSADKETAIANAPIPTNRTQVRSFCGLINYYRRFLKDTSTILQPLNNLLNKNVNFKWSNTCQTAFDKAKKLICSRNVLCHDPNLPLVLLTDASPYGRGAVLSHIFSTWHRETPHSSLLKLLLLLPQGIHK

SEQ ID NO: 27553 - protein, 64 aa, Diabrotica virgifera
  misc_feature: Coding regions on vcDNA: vcDNA=SeqID_7250; Strand=+; Position=3-197
CDQYGLIKREGWGGYAETKNGNICAETIYDQRSIAQLGLRFLHDESPNYPRQDLNRRAHFTAPI

SEQ ID NO: 27554 - protein, 105 aa, Diabrotica virgifera
  misc_feature: Coding regions on vcDNA: vcDNA=SeqID_7251; Strand=-; Position=185-502
RVLRTSVNFPEVTSRECGAHLKLALRIRLLRCYVFSVLLYGESWSYCMVLDSWTVNKIDLNRLKALEMWCNRRILRVHWMEKIRNSTILECFGKTTAIIKSIKKK

SEQ ID NO: 27555 - protein, 192 aa, Diabrotica virgifera
  misc_feature: Coding regions on vcDNA: vcDNA=SeqID_7252; Strand=+; Position=17-595
  misc_feature: Homolog annotation: Hit_ID=S08405; Match level="QueryCoverage=78%, HitCoverage=13%, E-value=3e-24, Identity=40%"; Hit description =hypothetical protein 2 - silkworm transposon mag
  misc_feature (3)..(3): Xaa can be any naturally occurring amino acid
NLXWDIQHDIAFKNLKDILASRPVLQFFNPNKNIVISVDASQSGVGGCLLQNGLPCAYASKAFTETQTRYAQIEKELYAICFGLNKFYQYIYGQKVTVETDHQPLISIFKKRLQRMMLQLQKFDIDLKYKPGKDLIIADALSRAHLTQSNNNDILGTLDDDIESQVCMVRLELNATDEKNRISRHNYKRYCF

SEQ ID NO: 27556 - protein, 104 aa, Diabrotica virgifera
  misc_feature: Coding regions on vcDNA: vcDNA=SeqID_7253; Strand=+; Position=889-1203
  misc_feature (43)..(56): Xaa can be any naturally occurring amino acid
LGFQNLYFPDLFLTKGGQLNRFLPLLISGWAPFWIIIPNLINXXXXXXXXXXXXXXLGLHTFLGRERGVWVILPPFRAPLFFPFLVGGGGDKMGTLGNLFWGYI

SEQ ID NO: 27557 - protein, 256 aa, Diabrotica virgifera
  misc_feature: Coding regions on vcDNA: vcDNA=SeqID_7254; Strand=+; Position=126-893
MQQNGNVNNENRNNHPGRRGNGNWRNRDGGPAPNFSRNQNWRERNRGSDAIPEHGRGGGRGRGFDPRPERGRGGGRGRGHYYVPGNDDDTGNDRGFIPVKTEYNESNRTRKPRQMGFRALEELINNDNIEDIILDLNDSKKGFKTLLGSQLSTDMIVLVVKMLAKICDSAFDASKTKVLQYAIESDFANQVTSFITLLAVQNSRDKMYNKYFWKDTDDFWNNIIKISEHYYDLLPFTSCDFTVKLLKSVKLSIPFD

SEQ ID NO: 27558 - protein, 82 aa, Diabrotica virgifera
  misc_feature: Coding regions on vcDNA: vcDNA=SeqID_7255; Strand=+; Position=48-296
CYTTQGLITHDIKPSSVNVGADLSVGLPTHPPPFTEDRGSDYNPPEFACCSQHTPGNCRGCKRLFVGYHQPPMRPQPMRQPL

SEQ ID NO: 27559 - protein, 171 aa, Diabrotica virgifera
  misc_feature: Coding regions on vcDNA: vcDNA=SeqID_7256; Strand=-; Position=1-513
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(171): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27560 - protein, 306 aa, Diabrotica virgifera
  misc_feature: Coding regions on vcDNA: vcDNA=SeqID_7257; Strand=-; Position=2-922
  misc_feature (1)..(6): Xaa can be any naturally occurring amino acid
  misc_feature (8)..(27): Xaa can be any naturally occurring amino acid
  misc_feature (29)..(49): Xaa can be any naturally occurring amino acid
  misc_feature (51)..(60): Xaa can be any naturally occurring amino acid
  misc_feature (75)..(88): Xaa can be any naturally occurring amino acid
  misc_feature (98)..(120): Xaa can be any naturally occurring amino acid
  misc_feature (138)..(163): Xaa can be any naturally occurring amino acid
  misc_feature (173)..(187): Xaa can be any naturally occurring amino acid
  misc_feature (193)..(201): Xaa can be any naturally occurring amino acid
  misc_feature (206)..(260): Xaa can be any naturally occurring amino acid
  misc_feature (264)..(271): Xaa can be any naturally occurring amino acid
  misc_feature (281)..(306): Xaa can be any naturally occurring amino acid
XXXXXXAXXXXXXXXXXXXXXXXXXXXPXXXXXXXXXXXXXXXXXXXXXSXXXXXXXXXXIRKKKKQRREKREEXXXXXXXXXXXXXXLRRAGPPGGXXXXXXXXXXXXXXXXXXXXXXXAPRPPPEKKKEEGKIPPXXXXXXXXXXXXXXXXXXXXXXXXXXCSFFSFLSLXXXXXXXXXXXXXXXRPPPHXXXXXXXXXGGLFXXXXXXXXXXXXXXXXXXXXXXXXXXXXXXXXXXXXXXXXXXXXXXXXXXXXXXXAGGXXXXXXXXLRGRRGEEGXXXXXXXXXXXXXXXXXXXXXXXXXX

SEQ ID NO: 27561 - protein, 36 aa, Diabrotica virgifera
  misc_feature: Coding regions on vcDNA: vcDNA=SeqID_7258; Strand=-; Position=1-108
  misc_feature (2)..(34): Xaa can be any naturally occurring amino acid
SXXXXXXXXXXXXXXXXXXXXXXXXXXXXXXXXXIL

SEQ ID NO: 27562 - protein, 88 aa, Diabrotica virgifera
  misc_feature: Coding regions on vcDNA: vcDNA=SeqID_7259; Strand=+; Position=543-809
  misc_feature (24)..(31): Xaa can be any naturally occurring amino acid
  misc_feature (33)..(38): Xaa can be any naturally occurring amino acid
SSTWHLDSGVMVSERRSGTMIPAXXXXXXXXQXXXXXXLSKCIYILKYADVTCIKKTSSNILLVKKLVKVRSGTANFAMTPLHLDHYY

SEQ ID NO: 27563 - protein, 200 aa, Diabrotica virgifera
  misc_feature: Coding regions on vcDNA: vcDNA=SeqID_7260; Strand=+; Position=298-897
  misc_feature (98)..(98): Xaa can be any naturally occurring amino acid
PPVFASSFRVTQGVRVVFHYGRELALHPKLAGRILNIQFENTTLAYNKTPKYLGVTLDRTLSFKEHLTKTAEKLKSRNNIIQKLCDTTWGASAFTLRXSALGLVFSTAEYCSSAWLNSPHIHKVDAQLNNTMRMTAGVIKSTSTQWLPVLSYIPLPKLRRINAPTSEYRKIVDNDNLPIPSDIDAAHGNYLCSRRPPIKT

SEQ ID NO: 27564 - protein, 76 aa, Diabrotica virgifera
  misc_feature: Coding regions on vcDNA: vcDNA=SeqID_7261; Strand=+; Position=14-244
  misc_feature (2)..(9): Xaa can be any naturally occurring amino acid
  misc_feature (45)..(54): Xaa can be any naturally occurring amino acid
IXXXXXXXXPCKGCLSEMCKENLGGQNTCSVLVVSHDRFVDLQLXXXXXXXXXXVPITLLCFNSFYAAFLENFSGN

SEQ ID NO: 27565 - protein, 86 aa, Diabrotica virgifera
  misc_feature: Coding regions on vcDNA: vcDNA=SeqID_7262; Strand=+; Position=117-374
  misc_feature: Homolog annotation: Hit_ID=AAD39969.1; Match level="QueryCoverage =97%, HitCoverage=29%, E-value=3e-20, Identity=59%"; Hit description =elongation factor 1 alpha [Tuberolachnus salignus]
MKVEIERGIAIDIAVWFFKPAKYYVAIIDAAGQRDFLKNIITGASQNECGVFIGGGVTGEFASGISKNAPTRVLVSLLSPLGAKST

SEQ ID NO: 27566 - protein, 71 aa, Diabrotica virgifera
  misc_feature: Coding regions on vcDNA: vcDNA=SeqID_7263; Strand=+; Position=623-838
KISNKPNQKFNCQFCHLLFVNCKPTFRINTYFIFSWKHLKTPSKTALSLAKEKNLNPNFLLLNYLLRKKQN

SEQ ID NO: 27567 - protein, 338 aa, Diabrotica virgifera
  misc_feature: Coding regions on vcDNA: vcDNA=SeqID_7264; Strand=-; Position=2-1015
  misc_feature (1)..(50): Xaa can be any naturally occurring amino acid
  misc_feature (54)..(336): Xaa can be any naturally occurring amino acid
XXXXXXXXXXXXXXXXXXXXXXXXXXXXXXXXXXXXXXXXXXXXXXXXXXIGVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRG

SEQ ID NO: 27568 - protein, 216 aa, Diabrotica virgifera
  misc_feature: Coding regions on vcDNA: vcDNA=SeqID_7265; Strand=+; Position=31-678
  misc_feature: Homolog annotation: Hit_ID=AAR89978.1; Match level="QueryCoverage =81%, HitCoverage=38%, E-value=6e-63, Identity=71%"; Hit description =putative elongation factor 1-alpha [Homalodisca coagulata] gb|AAS60203.1| putative elongation factor 1-alp
  misc_feature: Pfam annotation: Pfam_ID=GTP_EFTU; Match level="Score=11.0, E-value =1.5e-07, Copies=1"; Pfam description=Elongation factor Tu GTP binding domai
  misc_feature (9)..(21): Xaa can be any naturally occurring amino acid
  misc_feature (23)..(40): Xaa can be any naturally occurring amino acid
  misc_feature (60)..(67): Xaa can be any naturally occurring amino acid
  misc_feature (88)..(98): Xaa can be any naturally occurring amino acid
  misc_feature (139)..(151): Xaa can be any naturally occurring amino acid
  misc_feature (171)..(182): Xaa can be any naturally occurring amino acid
  misc_feature (204)..(204): Xaa can be any naturally occurring amino acid
FRPPTRPGXXXXXXXXXXXXXIXXXXXXXXXXXXXXXXXXQEMGKGSFKYAWVLDKLKAXXXXXXXXDIALWKFETAKYYVTIIDAPXXXXXXXXXXXGTSQADCAVLIVAAGTGEFEAGISKNGQTREHALLAFTLGXXXXXXXXXXXXXTEPAYSESRFEEIKKEVSSXXXXXXXXXXXXAFVPISGWHGDNMLEGSDQMPXFKGWQIERKERK

SEQ ID NO: 27569 - protein, 198 aa, Diabrotica virgifera
  misc_feature: Coding regions on vcDNA: vcDNA=SeqID_7266; Strand=+; Position=22-619
  misc_feature: Homolog annotation: Hit_ID=BAD08317.1; Match level="QueryCoverage =84%, HitCoverage=89%, E-value=3e-54, Identity=57%"; Hit description =peptidoglycan recognition protein-2 [Holotrichia diomphalia]
  misc_feature: Gene Ontology Annotation: Molecular function=peptidoglycan recognition activity; Biological process=anti-Gram-positive bacterial polypeptide induction
  misc_feature: Pfam annotation: Pfam_ID=Amidase_2; Match level="Score=200.3, E-value= 3.9e-57, Copies=1"; Pfam description=N-acetylmuramoyl-L-alanine amidase
  misc_feature (151)..(151): Xaa can be any naturally occurring amino acid
MYIMRSLLHVVLLLCFCKNLTWAMQSDWPAICPEIVSKARWGGRTAIAVEYAIMPVKYVIIHHTVTPQCTTEESCSKIMQSIQNFHMENLEFHDIGYNFLVGEDGRIYEATGWHKVGAHTRTYNSKSLGLAFIGNFSEKRPNSKALRAAKXFIKCAVELGEVDKNYILIGARQVSQTASPGLYLYNDIKDWPHFKRNP

SEQ ID NO: 27570 - protein, 65 aa, Diabrotica virgifera
  misc_feature: Coding regions on vcDNA: vcDNA=SeqID_7267; Strand=+; Position=3-197
QISSLKDRPRCKRSGKFSTDMHISGQLGTATQRTIISIFSLVNDSPAMTVVSLTQLFGSHGHSLS

SEQ ID NO: 27571 - protein, 206 aa, Diabrotica virgifera
  misc_feature: Coding regions on vcDNA: vcDNA=SeqID_7268; Strand=-; Position=298-918
  misc_feature (55)..(59): Xaa can be any naturally occurring amino acid
  misc_feature (145)..(201): Xaa can be any naturally occurring amino acid
EGRPPCFGPGAPGGFWGLLGPREKGGGCPRVRAAPESHRAFPLVRNQTGGCGPRXXXXXAVFEVFGGEPPLASTAVPPGMQPASAPGNRSTRTMGRSRRPPPSGLSRVRGVLESCRRIIEFRPTAKTKEFFPKPARAPARRAMNXXXXXXXXXXXXXXXXXXXXXXXXXXXXXXXXXXXXXXXXXXXXXXXXXXXXXXXXXKRTRF

SEQ ID NO: 27572 - protein, 113 aa, Diabrotica virgifera
  misc_feature: Coding regions on vcDNA: vcDNA=SeqID_7269; Strand=+; Position=241-582
  misc_feature: Homolog annotation: Hit_ID=EAL39774.1; Match level="QueryCoverage =87%, HitCoverage=28%, E-value=1e-13, Identity=37%"; Hit description =ENSANGP00000025957 [Anopheles gambiae str. PEST] ref|XP_555916.1| ENSANGP00000025957 [Anopheles gambiae st
  misc_feature (49)..(49): Xaa can be any naturally occurring amino acid
  misc_feature (98)..(98): Xaa can be any naturally occurring amino acid
GSFISGQLEFPIKNSVTYLGTILDRKLLWKDHIQYTIKKSENAINILRXFVKQVGVLILLFYRSMVRPILDYSCHLYGSASNTHLNKIEAQKNKCLRXLLRIPKFYSNKHHGM

SEQ ID NO: 27573 - protein, 101 aa, Diabrotica virgifera
  misc_feature: Coding regions on vcDNA: vcDNA=SeqID_7270; Strand=+; Position=128-433
TRSQKESLRPPNTRAHKSHYNRKEHQIIPKNSARIRQYLPIAPLRCDRHTTGTKGAQRTWCNYCTSNETTPNEQVLWNQRIRARTHRVRKERDHRKIAEEM

SEQ ID NO: 27574 - protein, 253 aa, Diabrotica virgifera
  misc_feature: Coding regions on vcDNA: vcDNA=SeqID_7271; Strand=+; Position=2-760
  misc_feature: Homolog annotation: Hit_ID=CAA81224.1; Match level="QueryCoverage =96%, HitCoverage=43%, E-value=2e-09, Identity=22%"; Hit description =STARP antigen [Plasmodium falciparum]
TTSSDVYTDFHQVGSQVSSNKNVLRNTNVTDKNSLKNTSKNFIEVEQQDSINKQMDSSQYQKTSVSETIQNITAKDLGKNASTTTTTTYYDSKGNIIKTVSDVDNHNIPGSSFTDIDKSQTLNLNETYVKTDHVPASSTPKKTKSPERKPTSRSPAGTVTEEIHSQDSTVRYVDENYVDMQKIRNSHLGTDSKKFYGHTVDSKNTIVGNVYDTKAVQNTIGTTGHVIMDQNIDTTDLVYSNDKNYGKNGWNGS

SEQ ID NO: 27575 - protein, 66 aa, Diabrotica virgifera; identical to SEQ ID NO: 26808
  misc_feature: Coding regions on vcDNA: vcDNA=SeqID_7272; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 27576 - protein, 22 aa, Diabrotica virgifera
  misc_feature: Coding regions on vcDNA: vcDNA=SeqID_7273; Strand=-; Position=0-65
  misc_feature (1)..(14): Xaa can be any naturally occurring amino acid
XXXXXXXXXXXXXXVIPKVIYS

SEQ ID NO: 27577 - protein, 85 aa, Diabrotica virgifera
  misc_feature: Coding regions on vcDNA: vcDNA=SeqID_7274; Strand=+; Position=1-258
  misc_feature: Homolog annotation: Hit_ID=ZP_00266090.1; Match level="QueryCoverage =78%, HitCoverage=6%, E-value=8e-21, Identity=67%"; Hit description =COG0841: Cation/multidrug efflux pump [Pseudomonas fluorescens PfO-1]
AVSLHSVIEPNKLKQFNQQNSATFQGIPAPGVSLGQAVAFLQAHSQQLPASFSHDWQADSRQFIHEGNALMLTFLFSSRIWPGAL

SEQ ID NO: 27578 - protein, 148 aa, Diabrotica virgifera
  misc_feature: Coding regions on vcDNA: vcDNA=SeqID_7275; Strand=-; Position=130-576
AGNPNIPSLCLSMQLVNLSGISASIVAGGKSELLDNGFTSYGSTYINETGSMALLSNECLFSVAVIKSSSICSRKLTPTSCRVCDRYFSIGSTKVVNFAGRDHVDRELDSPCLLLEMLTSELPLPGIELRFMNAQLKTPFVAFTQKLC

SEQ ID NO: 27579 - protein, 79 aa, Diabrotica virgifera
  misc_feature: Coding regions on vcDNA: vcDNA=SeqID_7276; Strand=+; Position=1-237
  misc_feature (51)..(56): Xaa can be any naturally occurring amino acid
GGTKGFSSNGNSHRGKNPWKFSPPKKDFPRERNLLKFLYWGRGIIPHFSPXXXXXXWRPPHPYFSQKYLWWVTPPPPPH

SEQ ID NO: 27580 - protein, 116 aa, Diabrotica virgifera
  misc_feature: Coding regions on vcDNA: vcDNA=SeqID_7277; Strand=+; Position=117-467
HSIMPHVSLIDNFGRQMSVKKTWQKCQKLHVVNPLTKTTESVCQMFCYKGKDGKVHIERICSYAPTNGEAHSFSSINNSCCNCPKYAHPGKLIIAVQNNTISISLKEFTEGFYLPS

SEQ ID NO: 27581 - protein, 92 aa, Diabrotica virgifera
  misc_feature: Coding regions on vcDNA: vcDNA=SeqID_7278; Strand=+; Position=8-286
  misc_feature (21)..(26): Xaa can be any naturally occurring amino acid
  misc_feature (50)..(56): Xaa can be any naturally occurring amino acid
FTYTMFKINTNIIIYKTTLNXXXXXXCSRFFKMYRLFVINFMSYQRQNNXXXXXXXYCLEYLRQCWENIWNIYLVYEQVIDIFLIPLQLFIS

SEQ ID NO: 27582 - protein, 144 aa, Diabrotica virgifera
  misc_feature: Coding regions on vcDNA: vcDNA=SeqID_7279; Strand=+; Position=3-437
  misc_feature (59)..(70): Xaa can be any naturally occurring amino acid
PSHHDSTDSLDQKTGGDVMTASTDSIEFQAQKSAKDNIMTDSIEIKPEDKSYMVSSDSXXXXXXXXXXXXLLMTDSIDEDGSRIGGVGDHSSSSTGKDFSSSGKEDDIIQDKDDMTGSISVTSSTATHATYQYDTDSVYSRELD

SEQ ID NO: 27583 - protein, 171 aa, Diabrotica virgifera
  misc_feature: Coding regions on vcDNA: vcDNA=SeqID_7280; Strand=-; Position=4-519
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(166): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRAKVA

SEQ ID NO: 27584 - protein, 77 aa, Diabrotica virgifera
  misc_feature: Coding regions on vcDNA: vcDNA=SeqID_7281; Strand=-; Position=220-453
NILINIPIGIAQLLWDCKRVIIKTWGLKRRADTNRCNICMNIVVCEPISSLRRDSKMFCSITKDAVRVEKPYRDKPT

SEQ ID NO: 27585 - protein, 157 aa, Diabrotica virgifera
  misc_feature: Coding regions on vcDNA: vcDNA=SeqID_7282; Strand=+; Position=10-485
  misc_feature: Homolog annotation: Hit_ID=S31935; Match level="QueryCoverage=91%, HitCoverage=46%, E-value=2e-29, Identity=56%"; Hit description =ADP,ATP carrier protein - African malaria mosquito
  misc_feature: Gene Ontology Annotation: Molecular function=transporter activity; Cellular component=integral to plasma membrane; Biological process =transport
  misc_feature: Pfam annotation: Pfam_ID=Mito_carr; Match level="Score=23.4, E-value =4.5e-05, Copies=1"; Pfam description=Mitochondrial carrier protein
  misc_feature (47)..(47): Xaa can be any naturally occurring amino acid
  misc_feature (67)..(67): Xaa can be any naturally occurring amino acid
  misc_feature (81)..(81): Xaa can be any naturally occurring amino acid
  misc_feature (93)..(93): Xaa can be any naturally occurring amino acid
  misc_feature (109)..(109): Xaa can be any naturally occurring amino acid
  misc_feature (120)..(120): Xaa can be any naturally occurring amino acid
MTSMKGYSLARGISAAISKTCVPPIERVKLLLPVPLISQQIAEDHCXKGMGDSFVRIPKKQGALVNXGGNTANDFRYFPNXALIIAFKDTYKXQTFLKRRSTKKNQLCXYFLGNLNSWGXTELPPLWFGYPNEFPPRTRLRRDFEKGAGEKEILRIE

SEQ ID NO: 27586 - protein, 104 aa, Diabrotica virgifera
  misc_feature: Coding regions on vcDNA: vcDNA=SeqID_7283; Strand=-; Position=487-801
RYGERHHVGQKSPITLFSKCNRFAKKPKYILICKLKSDNYVYKNLNRQSQFKNSCSILAISIHIKPCLHPKQTNKQILVLLDFQTWGGTIILQVYLSDLHLWCQ

SEQ ID NO: 27587 - protein, 124 aa, Diabrotica virgifera
  misc_feature: Coding regions on vcDNA: vcDNA=SeqID_7284; Strand=-; Position=2-373
  misc_feature (21)..(27): Xaa can be any naturally occurring amino acid
  misc_feature (35)..(41): Xaa can be any naturally occurring amino acid
  misc_feature (79)..(85): Xaa can be any naturally occurring amino acid
GQQKRGERKITPAAHNKNAKXXXXXXXITFPREKXXXXXXXRENLLQGVFFTPPLGEYHCLRRKPPPSGRPPPRIFSNXXXXXXXPNAFLGGRQKTRGRAKNSPKKRGNKGGPPGKMVKYPKFF

SEQ ID NO: 27588 - protein, 257 aa, Diabrotica virgifera
  misc_feature: Coding regions on vcDNA: vcDNA=SeqID_7285; Strand=+; Position=15-788
  misc_feature: Homolog annotation: Hit_ID=AAH83767.1; Match level="QueryCoverage =98%, HitCoverage=98%, E-value=8e-18, Identity=28%"; Hit description =Similar to RIKEN cDNA 0610027F08 [Rattus norvegicus] ref|NP _001006969.1| similar to RIKEN cDNA 0610027F08
  misc_feature: Gene Ontology Annotation: Cellular component=spliceosome complex; Biological process=mRNA processing
  misc_feature: Pfam annotation: Pfam_ID=tRNA_int_endo; Match level="Score=25.0, E -value=2.8e-07, Copies=1"; Pfam description=tRNA intron endonuclease, catalytic C-
MINLYLSNGEILLYNINDWLVLRKDYRIVGETVGNAVNVPSLPIKIIPEEACLLVSRNVVTISESPKEIVKTEEDQCKIEKYESTLLESQIINYKETRKQQIEQIVDQVIVKHNDKRSREEIINEKLAQSPPITKSNMIWPIQLSASTSIDENVKLLKAENILMLTTLLKRSVYADLWNRGYYVTQGHKFGGDFLVYLGDPVCHHAIFIVKCINNMKDLFPLELISLGRLGTSVKKRAVLASMENDKISYITMSLDR

SEQ ID NO: 27589 - protein, 75 aa, Diabrotica virgifera
  misc_feature: Coding regions on vcDNA: vcDNA=SeqID_7286; Strand=-; Position=0-224
  misc_feature (41)..(48): Xaa can be any naturally occurring amino acid
RDICGFPLMFVGTKKQEGPKSRKKREKGVGGKVVECSLLLXXXXXXXXAIFQGFFLKERGPCFVEMFFGENNKIG

SEQ ID NO: 27590 - protein, 151 aa, Diabrotica virgifera
  misc_feature: Coding regions on vcDNA: vcDNA=SeqID_7287; Strand=-; Position=2-457
  misc_feature (42)..(150): Xaa can be any naturally occurring amino acid
GGFYDFKENVKGSNHEIEEMVSSRGGVYHTPADGEVLIMGFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXS

SEQ ID NO: 27591 - protein, 160 aa, Diabrotica virgifera
  misc_feature: Coding regions on vcDNA: vcDNA=SeqID_7288; Strand=+; Position=1-483
  misc_feature (2)..(143): Xaa can be any naturally occurring amino acid
FXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXINYLRDKSVILLESSNR

SEQ ID NO: 27592 - protein, 31 aa, Diabrotica virgifera
  misc_feature: Coding regions on vcDNA: vcDNA=SeqID_7289; Strand=-; Position=2-94
  misc_feature (20)..(31): Xaa can be any naturally occurring amino acid
FLKGFSRCGGIHFDVTPLGXXXXXXXXXXXX

SEQ ID NO: 27593 - protein, 40 aa, Diabrotica virgifera
  misc_feature: Coding regions on vcDNA: vcDNA=SeqID_7290; Strand=-; Position=2-124
  misc_feature (32)..(39): Xaa can be any naturally occurring amino acid
SNLHSLSIKNYDMLPSTSKYRAHQNNQWQGRXXXXXXXXV

SEQ ID NO: 27594 - protein, 19 aa, Diabrotica virgifera
  misc_feature: Coding regions on vcDNA: vcDNA=SeqID_7291; Strand=-; Position=0-56
  misc_feature (5)..(10): Xaa can be any naturally occurring amino acid
QMSSXXXXXXDIVLRVRGR

SEQ ID NO: 27595 - protein, 188 aa, Diabrotica virgifera
  misc_feature: Coding regions on vcDNA: vcDNA=SeqID_7292; Strand=-; Position=2-565
  misc_feature (29)..(185): Xaa can be any naturally occurring amino acid
LLIQLGVGILYYQFDLFNKIYAVIPKGNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTK

SEQ ID NO: 27596 - protein, 66 aa, Diabrotica virgifera; identical to SEQ ID NO: 26808
  misc_feature: Coding regions on vcDNA: vcDNA=SeqID_7293; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 27597 - protein, 78 aa, Diabrotica virgifera
  misc_feature: Coding regions on vcDNA: vcDNA=SeqID_7294; Strand=-; Position=47-283
  misc_feature (22)..(32): Xaa can be any naturally occurring amino acid
LFVSSQILEERVHKYPSQRYVXXXXXXXXXXXFPDTIHSHYNIQVLEYKFQIIITIGRIFIIHILFLYSTGSDTFFHN

SEQ ID NO: 27598 - protein, 48 aa, Diabrotica virgifera
  misc_feature: Coding regions on vcDNA: vcDNA=SeqID_7295; Strand=-; Position=168-314
ESPYLIGLAVCSAHTPMSLGPLYLKVFLWYQQGRVEHQQHGMRSSIVF

SEQ ID NO: 27599 - protein, 49 aa, Diabrotica virgifera
  misc_feature: Coding regions on vcDNA: vcDNA=SeqID_7296; Strand=-; Position=1-147
  misc_feature (1)..(1): Xaa can be any naturally occurring amino acid
  misc_feature (3)..(3): Xaa can be any naturally occurring amino acid
  misc_feature (6)..(7): Xaa can be any naturally occurring amino acid
  misc_feature (10)..(10): Xaa can be any naturally occurring amino acid
  misc_feature (18)..(19): Xaa can be any naturally occurring amino acid
  misc_feature (23)..(23): Xaa can be any naturally occurring amino acid
  misc_feature (28)..(32): Xaa can be any naturally occurring amino acid
  misc_feature (38)..(38): Xaa can be any naturally occurring amino acid
  misc_feature (41)..(41): Xaa can be any naturally occurring amino acid
  misc_feature (45)..(45): Xaa can be any naturally occurring amino acid
XIXNTXXYSXNITFLITXXPFKXYFSIXXXXXITPSIXYKXQFQXISQF

SEQ ID NO: 27600 - protein, 112 aa, Diabrotica virgifera
  misc_feature: Coding regions on vcDNA: vcDNA=SeqID_7297; Strand=+; Position=2-335
  misc_feature: Homolog annotation: Hit_ID=CAG03075.1; Match level="QueryCoverage =99%, HitCoverage=10%, E-value=1e-25, Identity=54%"; Hit description =unnamed protein product [Tetraodon nigroviridis]
  misc_feature: Gene Ontology Annotation: Molecular function=heat shock protein activity; Cellular component=cytosol; Biological process=G1 phase of mitotic cell cycle
  misc_feature: Pfam annotation: Pfam_ID=DnaJ; Match level="Score=42.9, E-value=9.4e -10, Copies=1"; Pfam description=DnaJ domain
  misc_feature (33)..(33): Xaa can be any naturally occurring amino acid
  misc_feature (74)..(74): Xaa can be any naturally occurring amino acid
  misc_feature (96)..(96): Xaa can be any naturally occurring amino acid
FVGASISAPANDINKAYRMIGKEFHQDKNPACXGTKFKEINYAFEVLSDPKKRALYDRVGLQGMLEGAHDGFGXNDLFSHLFLGGLFEGFRGGRAXRWRLKGEDTGHPLSVS

SEQ ID NO: 27601 - protein, 301 aa, Diabrotica virgifera
  misc_feature: Coding regions on vcDNA: vcDNA=SeqID_7298; Strand=+; Position=1-903
  misc_feature: Homolog annotation: Hit_ID=XP_393420.1; Match level="QueryCoverage =88%, HitCoverage=17%, E-value=5e-81, Identity=57%"; Hit description =similar to ENSANGP00000008413 [Apis mellifera]
  misc_feature: Gene Ontology Annotation: Molecular function=transcription factor activity; Cellular component=nucleus; Biological process=negative regulation of transcription
  misc_feature (145)..(156): Xaa can be any naturally occurring amino acid
  misc_feature (203)..(208): Xaa can be any naturally occurring amino acid
NLDDNSSEEPEKKKPKTELKEEYTSQFDVELGDAGDWPLEWFCDQLSQDLFSCSWETRHGAATALREVLSVHGSGAGKATYLSSNQMDLCHQIWLEDMAIRLLCVLALDRFGDFVSDAVIAPVRETCAQSLCAVMKLMTSQSCYXXXXXXXXXXXXAEWEARHGGLLGLKYLLAVREDMIDSFLPESFPFILLGLSDPVDDVXXXXXXALIPVAEKLTDLVPERIPEVVTKLWDLLSEQDELAAACNSFMGLLAAVLNLPKMQALLPAQPLNESVPRLWPFLSHGTSSVRKATLQTLSTLT

SEQ ID NO: 27602 - protein, 76 aa, Diabrotica virgifera
  misc_feature: Coding regions on vcDNA: vcDNA=SeqID_7299; Strand=+; Position=851-1081
  misc_feature (11)..(26): Xaa can be any naturally occurring amino acid
  misc_feature (39)..(48): Xaa can be any naturally occurring amino acid
  misc_feature (56)..(61): Xaa can be any naturally occurring amino acid
LMIPNTQRYYXXXXXXXXXXXXXXXXNTRVLRSFPNMGXXXXXXXXXXSKKLVIQXXXXXXGAKPLGRDSFGWKTH

SEQ ID NO: 27603 - protein, 34 aa, Diabrotica virgifera
  misc_feature: Coding regions on vcDNA: vcDNA=SeqID_7300; Strand=-; Position=80-184
FYWRVQIDNKDCDLDVGLKFIIGVAAILLSLFDF

SEQ ID NO: 27604 - protein, 94 aa, Diabrotica virgifera
  misc_feature: Coding regions on vcDNA: vcDNA=SeqID_7301; Strand=+; Position=208-492
  misc_feature: Homolog annotation: Hit_ID=XP_315597.1; Match level="QueryCoverage =77%, HitCoverage=27%, E-value=1e-17, Identity=60%"; Hit description =ENSANGP00000024376 [Anopheles gambiae] ref|XP_315596.1| ENSANGP00000024259 [Anopheles gambiae]
MSDSEPAIAFKDLPLTFKVKYLGRHPAKGLWGMKHTRKPVDYLVSQAKNLPPDVILPIIDFKVTQDGVSYVESANKKVESEPVKFAVHLLSGIL

SEQ ID NO: 27605 - protein, 54 aa, Diabrotica virgifera
  misc_feature: Coding regions on vcDNA: vcDNA=SeqID_7302; Strand=+; Position=1-165
  misc_feature (1)..(20): Xaa can be any naturally occurring amino acid
  misc_feature (24)..(31): Xaa can be any naturally occurring amino acid
XXXXXXXXXXXXXXXXXXXXAFRXXXXXXXXDRNQPGSHRFKLRSCKILKVEQT

SEQ ID NO: 27606 - protein, 136 aa, Diabrotica virgifera
  misc_feature: Coding regions on vcDNA: vcDNA=SeqID_7303; Strand=+; Position=204-611
  misc_feature: Homolog annotation: Hit_ID=NP_731461.1; Match level="QueryCoverage =84%, HitCoverage=53%, E-value=1e-18, Identity=38%"; Hit description =CG6281-PB, isoform B [Drosophila melanogaster] ref|NP_524301.2| CG6281-PA, isoform A [Drosophila
  misc_feature: Pfam annotation: Pfam_ID=TIMP; Match level="Score=-46.1, E-value=5.5e- 07, Copies=1"; Pfam description=Tissue inhibitor of metalloproteinase
MNSNVLFVTLAFFCGVFVCSDACSCMPQHPQEHFCNSDFVILARVKRERILGDTKVYKVRVRKEYKVSDKGVLALKSGRLLTPKYGAMCGVDLEVGKLYVISGNILTLKAQINMCGMRTQWNHLTKRTRERSKGIV

SEQ ID NO: 27607 - protein, 156 aa, Diabrotica virgifera
  misc_feature: Coding regions on vcDNA: vcDNA=SeqID_7304; Strand=+; Position=47-517
MNAFTVVFALGALACVNAGVVSLAHGYAAPGVIAQYALPYAAVLPSGHGLEGQYIPDNLEKLYDDGSYRPQLSALTLSPSPYGLTPSGSGLEGAYVHDNLDKLHDDGSYKPELQALPLSVSPFGLTPSGSGLEGTYVHDHSEKLYDDGSYRPGLYH

SEQ ID NO: 27608 - protein, 89 aa, Diabrotica virgifera
  misc_feature: Coding regions on vcDNA: vcDNA=SeqID_7305; Strand=-; Position=457-726
  misc_feature (18)..(28): Xaa can be any naturally occurring amino acid
RSRSDYLRGKLNLSQCSXXXXXXXXXXXILSTIYYFAPPYLQDFPVDLATPRSNQTRIHFEYRNIDDVLFVYVLRLPLIFANLEHNFNI

SEQ ID NO: 27609 - protein, 138 aa, Diabrotica virgifera
  misc_feature: Coding regions on vcDNA: vcDNA=SeqID_7306; Strand=-; Position=99-515
ATLVFVPPSRQAWSNFYPLREFELVYGFVSLMVFIVMESCSENLSTFECRSSSLKVSSFTRTSLSTSSFACGPPLSSPDPPPPPSLMSMVAFMARSLSLPSISCCIREIFSHSSCFVINSGSFVFIICGFVTLSHRKL

SEQ ID NO: 27610 - protein, 88 aa, Diabrotica virgifera
  misc_feature: Coding regions on vcDNA: vcDNA=SeqID_7307; Strand=-; Position=2-265
  misc_feature (7)..(22): Xaa can be any naturally occurring amino acid
  misc_feature (25)..(35): Xaa can be any naturally occurring amino acid
  misc_feature (45)..(52): Xaa can be any naturally occurring amino acid
  misc_feature (55)..(68): Xaa can be any naturally occurring amino acid
  misc_feature (74)..(87): Xaa can be any naturally occurring amino acid
FACSFFXXXXXXXXXXXXXXXXPFXXXXXXXXXXXTNLAHTGLNXXXXXXXXSNXXXXXXXXXXXXXXPTSRSXXXXXXXXXXXXXXV

SEQ ID NO: 27611 - protein, 210 aa, Diabrotica virgifera
  misc_feature: Coding regions on vcDNA: vcDNA=SeqID_7308; Strand=+; Position=2-634
  misc_feature: Homolog annotation: Hit_ID=XP_143000.4; Match level="QueryCoverage =100%, HitCoverage=89%, E-value=1e-47, Identity=41%"; Hit description= similar to zinc finger protein 347; zinc finger 1111 [Mus musculus]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=89.1, E-value =1.1e-23, Copies=3"; Pfam description=Zinc finger, C2H2 type
  misc_feature (14)..(21): Xaa can be any naturally occurring amino acid
  misc_feature (42)..(49): Xaa can be any naturally occurring amino acid
  misc_feature (72)..(79): Xaa can be any naturally occurring amino acid
  misc_feature (92)..(98): Xaa can be any naturally occurring amino acid
  misc_feature (127)..(133): Xaa can be any naturally occurring amino acid
NLKSHLRIHTGVKXXXXXXXXKQFTVADSLKKHLRVHTGEKXXXXXXXXKQFSQDGDLKRHLRIHSDEKPYXXXXXXXXFSQTSHLNTHLRXXXXXXXHECEICLKQFNEAGNLKGHLRIHTGLKPXXXXXXXKQFSQAAHWKSHLRIHTGEKPYQCEICLKRFGEPGHLKRHLRVHTGEKPYKCELCFTQFTQSSSLKTHLRSHTEEKP

SEQ ID NO: 27612 - protein, 112 aa, Diabrotica virgifera
  misc_feature: Coding regions on vcDNA: vcDNA=SeqID_7309; Strand=+; Position=397-737
  misc_feature: Homolog annotation: Hit_ID=AAN73309.1; Match level="QueryCoverage =97%, HitCoverage=25%, E-value=1e-13, Identity=43%"; Hit description =calreticulin [Cotesia rubecula]
  misc_feature: Gene Ontology Annotation: Molecular function=calcium ion binding; Cellular component=extracellular space; Biological process=central nervous system development
  misc_feature (20)..(20): Xaa can be any naturally occurring amino acid
  misc_feature (87)..(87): Xaa can be any naturally occurring amino acid
  misc_feature (99)..(99): Xaa can be any naturally occurring amino acid
GPQICVPLVLKEHMMIRNYXTNCTLLPKPIESEDDIYTAAYTHIVLPDNTYEAHIDGEISKIELNVEELYLRSMYSAHQKLKNPNPXTTKSGKDRGTYXDPHDFKSEDWAQA

SEQ ID NO: 27613 - protein, 186 aa, Diabrotica virgifera
  misc_feature: Coding regions on vcDNA: vcDNA=SeqID_7310; Strand=+; Position=24-583
  misc_feature: Homolog annotation: Hit_ID=XP_314026.1; Match level="QueryCoverage =96%, HitCoverage=30%, E-value=2e-28, Identity=41%"; Hit description =ENSANGP00000009960 [Anopheles gambiae]
  misc_feature (94)..(94): Xaa can be any naturally occurring amino acid
  misc_feature (165)..(165): Xaa can be any naturally occurring amino acid
WIETLGRALTLIAESRPVGIYKGDYIQELYARYDDVSDAPPPPSLPDWCTESDDGQGNGLDDFDDFTEDARKRVASTSSNNDDTSPKAKKGRFXEVAFMEGVPNVTHFVEEQATRDCKRMVPRMCRCTPKWCSRKSCPCPMDMTNITLLKDHPYRVSCKADGHEXIMKLINGEHNVYLFDRDDEAY

SEQ ID NO: 27614 - protein, 193 aa, Diabrotica virgifera
  misc_feature: Coding regions on vcDNA: vcDNA=SeqID_7311; Strand=+; Position=142-722
  misc_feature: Homolog annotation: Hit_ID=XP_317949.1; Match level="QueryCoverage =95%, HitCoverage=39%, E-value=3e-31, Identity=39%"; Hit description =ENSANGP00000020548 [Anopheles gambiae]
  misc_feature (23)..(23): Xaa can be any naturally occurring amino acid
  misc_feature (78)..(84): Xaa can be any naturally occurring amino acid
  misc_feature (158)..(158): Xaa can be any naturally occurring amino acid
NYTFQRVEQFKYLGVIVNGQNKXSEELTERILAINKTYWRYHRLIKDKNLSRNTKLRIYRVAIRPVVTYAAETMCLAXXXXXXXRIFERKIFRRIMGPIRMINGEMRRRMNHELRDIMKEEDIVRFIKAQRLRWLGHIERRKNDRLIKKITKWKPESXKTKGRPRERWKDQVMRDIEMLEVRNWRELCTNRNE

SEQ ID NO: 27615 - protein, 28 aa, Diabrotica virgifera
  misc_feature: Coding regions on vcDNA: vcDNA=SeqID_7312; Strand=-; Position=1-84
SSPRRFWGGDKKKEREKSQKRGNRGPRE

SEQ ID NO: 27616 - protein, 225 aa, Diabrotica virgifera
  misc_feature: Coding regions on vcDNA: vcDNA=SeqID_7313; Strand=+; Position=51-726
  misc_feature: Homolog annotation: Hit_ID=XP_393173.1; Match level="QueryCoverage =58%, HitCoverage=2%, E-value=4e-35, Identity=55%"; Hit description =similar to Hypothetical protein CBG09037 [Apis mellifera]
  misc_feature (191)..(191): Xaa can be any naturally occurring amino acid
MRHTVETSAPPASYATTYTRINYLTVWTTGINVSCCLCCYRGEANSAVLGRVPAHCNSLPDYLPPTSCCTHYSSCSTYKHKPKRYACMPYYSSPTMDVIRQTRTAQHKAVGWQDYQKPGIAAKTARPKAPPKPQQLHYSDVCKINCADPQTYTEHLEGQKHEKREAATKMAVSAAVTTQNRAANSLRCQLXDVTCTGNDAYAAHIREEKHRKVLLLHCTIGQAPT

SEQ ID NO: 27617 - protein, 46 aa, Diabrotica virgifera
  misc_feature: Coding regions on vcDNA: vcDNA=SeqID_7314; Strand=-; Position=2-139
  misc_feature (34)..(45): Xaa can be any naturally occurring amino acid
SGSWNLLNIYIKLLSPHLVGHCSGLPFLLYYTGXXXXXXXXXXXXK

SEQ ID NO: 27618 - protein, 98 aa, Diabrotica virgifera
  misc_feature: Coding regions on vcDNA: vcDNA=SeqID_7315; Strand=-; Position=312-608
  misc_feature (86)..(92): Xaa can be any naturally occurring amino acid
KARIKIAEAVWYKIPSDDPTNLLCREINNVLRPWISLPVLYKNHLPVKKETKSNLADMCAYIPNREYREFLGKTKNQFFIFVNNVXXXXXXXVGIGAP

SEQ ID NO: 27619 - protein, 209 aa, Diabrotica virgifera
  misc_feature: Coding regions on vcDNA: vcDNA=SeqID_7316; Strand=+; Position=1-630
  misc_feature: Homolog annotation: Hit_ID=XP_319037.1; Match level="QueryCoverage =98%, HitCoverage=33%, E-value=6e-62, Identity=55%"; Hit description =ENSANGP00000013187 [Anopheles gambiae]
  misc_feature: Gene Ontology Annotation: Molecular function=molecular_function unknown; Cellular component=integral to plasma membrane; Biological process=transport
  misc_feature: Pfam annotation: Pfam_ID=EMP70; Match level="Score=-324.5, E-value =0.00015, Copies=1"; Pfam description=Endomembrane protein 70
EFMKNETCTVVCTKQYSGDKPEDNLKLGRLRKGISLNYQHHWIVDNMPVTTCYDVDDCRTGFHMGCYSRNGRHNCVKEDVGRDDAYYIYNHVNLTITYHSGAKEEWGSQFHENGGRIISVKVVPRSIDYKGKGCSSGDLEPLMIPMKNLKTGEKFQIIYTYSIHFVKDNDVKWSFRWDYILESMPHTNIPWVSILNSLSIVLFLSGNGC

SEQ ID NO: 27620 - protein, 91 aa, Diabrotica virgifera
  misc_feature: Coding regions on vcDNA: vcDNA=SeqID_7317; Strand=+; Position=149-424
RRPALTREITKRQHGGPQERISLARGVPNEITFPFEAITVKLKEGSKFDIVGPQITSALRDIPTQRYSRVREIGQDPYPKTHITPLGWPKS

SEQ ID NO: 27621 - protein, 34 aa, Diabrotica virgifera
  misc_feature: Coding regions on vcDNA: vcDNA=SeqID_7318; Strand=+; Position=42-143
GHPCPRGLKNKKANAALLTSQIKSYDLYWYTLGS

SEQ ID NO: 27622 - protein, 314 aa, Diabrotica virgifera
  misc_feature: Coding regions on vcDNA: vcDNA=SeqID_7319; Strand=+; Position=3-947
  misc_feature (3)..(250): Xaa can be any naturally occurring amino acid
  misc_feature (252)..(264): Xaa can be any naturally occurring amino acid
  misc_feature (287)..(293): Xaa can be any naturally occurring amino acid
LSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXCDLDVGIKFIIGEPAIINKSGSXXXXXXXLRLKPVGSHGGFLSFNLINNF

SEQ ID NO: 27623 - protein, 161 aa, Diabrotica virgifera
  misc_feature: Coding regions on vcDNA: vcDNA=SeqID_7320; Strand=+; Position=2-488
  misc_feature: Homolog annotation: Hit_ID=XP_319941.1; Match level="QueryCoverage =88%, HitCoverage=5%, E-value=1e-44, Identity=56%"; Hit description =ENSANGP00000016695 [Anopheles gambiae]
  misc_feature: Gene Ontology Annotation: Cellular component=mitochondrion; Biological process=polar body extrusion after meiotic divisions
  misc_feature (78)..(78): Xaa can be any naturally occurring amino acid
PLINSMIPWDHSIEWSVANFASKGNRSGELVVDIDLTKEEDQYLEGHTIDGRVLFPATGYLTLVWKTFAKLRNEYYEXSPVILEDVQFHRATLMPKEGSVKFLINIFEGTGEFELCEGGSGAVSGKISAPEDVRTEVITPTKACSLKRDRCLTLWNLLESH

SEQ ID NO: 27624 - protein, 33 aa, Diabrotica virgifera
  misc_feature: Coding regions on vcDNA: vcDNA=SeqID_7321; Strand=-; Position=99-200
NELNSALLSLAIFSFYNLPVRVTLQKSIKHCVL

SEQ ID NO: 27625 - protein, 184 aa, Diabrotica virgifera
  misc_feature: Coding regions on vcDNA: vcDNA=SeqID_7322; Strand=-; Position=110-664
  misc_feature: Homolog annotation: Hit_ID=AAC46945.1; Match level="QueryCoverage =96%, HitCoverage=52%, E-value=8e-35, Identity=44%"; Hit description =mariner transposase pir||S35520 transposase - lacewing
  misc_feature: Gene Ontology Annotation: Molecular function=transposase activity; Cellular component=cellular_component unknown; Biological process =DNA transposition
  misc_feature: Pfam annotation: Pfam_ID=Transposase_1; Match level="Score=-7.4, E -value=0.002, Copies=1"; Pfam description=Transposase
  misc_feature (25)..(25): Xaa can be any naturally occurring amino acid
  misc_feature (61)..(61): Xaa can be any naturally occurring amino acid
FHWYTPESKEQSLQWNVLRGGRRLXSAGKMTIIFWDSQCMIYIHFLEMNKTITRLYYAALXKPDSTPSFRKHSKIGKEKILYHHGNTPAHPSAIAMAKFVELGYKLLFRPTYSPDLYQYDFFLYPMKKSLTGQKFKSNKEFITATADYFADLEKRYFSGGLKKLEHRWVKCIELKGDYSTWPNY

SEQ ID NO: 27626 - protein, 63 aa, Diabrotica virgifera
  misc_feature: Coding regions on vcDNA: vcDNA=SeqID_7323; Strand=+; Position=1-193
  misc_feature: Homolog annotation: Hit_ID=BAB28242.1; Match level="QueryCoverage =100%, HitCoverage=95%, E-value=5e-15, Identity=65%"; Hit description= unnamed protein product [Mus musculus]
  misc_feature: Pfam annotation: Pfam_ID=ubiquitin; Match level="Score=18.5, E-value =0.0019, Copies=1"; Pfam description=Ubiquitin family
  misc_feature (3)..(3): Xaa can be any naturally occurring amino acid
  misc_feature (5)..(5): Xaa can be any naturally occurring amino acid
  misc_feature (14)..(14): Xaa can be any naturally occurring amino acid
  misc_feature (17)..(17): Xaa can be any naturally occurring amino acid
  misc_feature (26)..(26): Xaa can be any naturally occurring amino acid
  misc_feature (32)..(32): Xaa can be any naturally occurring amino acid
  misc_feature (35)..(35): Xaa can be any naturally occurring amino acid
  misc_feature (48)..(48): Xaa can be any naturally occurring amino acid
  misc_feature (51)..(51): Xaa can be any naturally occurring amino acid
LEXEXFDSIENVKXKMXDKEGIVLDXERLIFXGKXLEDGRKLCDYKIXIEXSLYLVFRLRGGM

SEQ ID NO: 27627 - protein, 39 aa, Diabrotica virgifera
  misc_feature: Coding regions on vcDNA: vcDNA=SeqID_7324; Strand=+; Position=144-260
HSSNPLWHAKVLSYTLDRALHIIPPKLPFILLFPLSSSS

SEQ ID NO: 27628 - protein, 132 aa, Diabrotica virgifera
  misc_feature: Coding regions on vcDNA: vcDNA=SeqID_7325; Strand=+; Position=3-401
  misc_feature: Pfam annotation: Pfam_ID=THAP; Match level="Score=3.4, E-value =0.0029, Copies=1"; Pfam description=THAP domain
  misc_feature (79)..(86): Xaa can be any naturally occurring amino acid
  misc_feature (110)..(115): Xaa can be any naturally occurring amino acid
  misc_feature (118)..(126): Xaa can be any naturally occurring amino acid
DKLERNFIKKRTHILDKMASVTHKCVYAGCFERNDGTNNNISFFKFPLKDVERTKIWQKNCGNIDILLMDITDLIQRVXXXXXXXXEHIYQSGQRKLLRKNAVPLKFTQXXXXXXEYXXXXXXXXXPNALCQ

SEQ ID NO: 27629 - protein, 75 aa, Diabrotica virgifera
  misc_feature: Coding regions on vcDNA: vcDNA=SeqID_7326; Strand=+; Position=26-253
TRTRTYLQKSVLLTILEKIESLTDIKLNDNLNKLHLPLVKSEAPLLRCVATSQRNNADAMQMQMIDATQRNGLMG

SEQ ID NO: 27630 - protein, 60 aa, Diabrotica virgifera
  misc_feature: Coding regions on vcDNA: vcDNA=SeqID_7327; Strand=+; Position=383-565
KTFCTKPPTTPDDMENIIREPLNNIYLQMLEIWLGRLNIGYKLAYSLEAEILNIYFRLIL

SEQ ID NO: 27631 - protein, 173 aa, Diabrotica virgifera
  misc_feature: Coding regions on vcDNA: vcDNA=SeqID_7328; Strand=+; Position=11-532
  misc_feature: Homolog annotation: Hit_ID=XP_395426.1; Match level="QueryCoverage =97%, HitCoverage=5%, E-value=4e-27, Identity=38%"; Hit description =similar to p270 [Apis mellifera]
MDSDTSEFAPILRLDTAEPTGCALFTETSLIVGADKFFEIDLETFQAEEFLDASDAKLKQAQSCYKMGSFPLAIIQVCKNPKEYLLSFNEFSVFVDEYGRSTRQNELKSDHLPLSFHFSKSYLYVCQFSAVGILKISEETCNNDEKPDIVRVELDKFKYLGSNKQGIFIRCQQ

SEQ ID NO: 27632 - protein, 272 aa, Diabrotica virgifera
  misc_feature: Coding regions on vcDNA: vcDNA=SeqID_7329; Strand=+; Position=2-820
  misc_feature (2)..(8): Xaa can be any naturally occurring amino acid
  misc_feature (139)..(148): Xaa can be any naturally occurring amino acid
KXXXXXXXQEEEKSDKSSSNKPKQQFKGGKVRQRPKKLNEDPTFSTSLSTPIEDIIEETINEEVAVNKKKGKSSKKQTEELPVKKEKPTKDLDDDIGYSFFKVKTVSKGNPEAKPKKQVSVDLNEDNTADDIGFSFLPXXXXXXXXXXKSNPENKDQELTLNAVVDQTLRKAKYDTSKPSIIEHYKKRTTDKAFSKKAATKFESPSVSTIVEKRLLYESKLKSETKESKKVTSSISFASIVSNATDAPSGSDIEQNPQLLNGPKPDIQQHIL

SEQ ID NO: 27633 - protein, 177 aa, Diabrotica virgifera
  misc_feature: Coding regions on vcDNA: vcDNA=SeqID_7330; Strand=+; Position=402-931
  misc_feature: Homolog annotation: Hit_ID=XP_395882.1; Match level="QueryCoverage =88%, HitCoverage=22%, E-value=3e-14, Identity=32%"; Hit description =similar to CG1102-PA [Apis mellifera]
  misc_feature (46)..(63): Xaa can be any naturally occurring amino acid
  misc_feature (133)..(133): Xaa can be any naturally occurring amino acid
  misc_feature (163)..(163): Xaa can be any naturally occurring amino acid
  misc_feature (168)..(168): Xaa can be any naturally occurring amino acid
MVLAHFIFLFVFFLIHNHSNGQDVCTTPGGTEGSCIPALSCEPLRXXXXXXXXXXXXXXXXXXEAYICKETHKVCCPKEPIIITELSVRTSDNDESPTETITDITKHKNYGLLPTDCGFVKDSSYVFDIRVVXGEDAGLYEYPWMSLLSFRVPGNIRKFRCGXSIINXRYILTAAHC

SEQ ID NO: 27634 - protein, 70 aa, Diabrotica virgifera
  misc_feature: Coding regions on vcDNA: vcDNA=SeqID_7331; Strand=+; Position=445-657
YAIISICNYMQYPIFFNDSGYEIHVSLTISIDSMNYLRNMLRKLQDFSATRALSFLVSPPSTCTQRITIK

SEQ ID NO: 27635 - protein, 70 aa, Diabrotica virgifera
  misc_feature: Coding regions on vcDNA: vcDNA=SeqID_7332; Strand=+; Position=331-543
IIMLVQRSFGKTIYKLPSSLNIRNCLLFYVFMTLLGDNWMTFILPSLLERLFIYSHIFDLEHRTPEDTFY

SEQ ID NO: 27636 - protein, 58 aa, Diabrotica virgifera
  misc_feature: Coding regions on vcDNA: vcDNA=SeqID_7333; Strand=+; Position=704-880
  misc_feature (11)..(18): Xaa can be any naturally occurring amino acid
  misc_feature (49)..(49): Xaa can be any naturally occurring amino acid
LQLCRVQNSYXXXXXXXXVIKTNLFFMIIYKTILHNVCTVQYSTFYTIXWCLALQFVP

SEQ ID NO: 27637 - protein, 281 aa, Diabrotica virgifera
  misc_feature: Coding regions on vcDNA: vcDNA=SeqID_7334; Strand=+; Position=69-914
  misc_feature: Homolog annotation: Hit_ID=NP_996412.1; Match level="QueryCoverage =96%, HitCoverage=42%, E-value=8e-17, Identity=25%"; Hit description =CG1561-PB, isoform B [Drosophila melanogaster] gb|AAS65318.1| CG1561- PB, isoform B [Drosophila
  misc_feature: Gene Ontology Annotation: Molecular function=molecular_function unknown
  misc_feature: Pfam annotation: Pfam_ID=DUF227; Match level="Score=48.3, E-value =2.2e-11, Copies=1"; Pfam description=Domain of unknown function (DUF227)
  misc_feature (210)..(219): Xaa can be any naturally occurring amino acid
  misc_feature (240)..(240): Xaa can be any naturally occurring amino acid
  misc_feature (256)..(256): Xaa can be any naturally occurring amino acid
  misc_feature (267)..(267): Xaa can be any naturally occurring amino acid
MTVLSEDICELIQQCFNEKIENFDIKINEGNKKGEGYIGEIIFASLENKVTGKEEHLVIKKVFGSEIEKTREFLSSSYLNEILFYKNVWPELRKFQDTFPEIKPVDVVPKCYGTSSVKGSEKVILENLKFKGYEIHPKRTPLSKELYEDIFALYGKYHATSFAYKHYHPEEFQKLTVDLKNNWCGFQETELCITAIKHSFVGVKMILEYXXXXXXXXXXAPYIENARKIFSDSLNYEGPXSVLIHGDCWSNNMMFXYNDKKELEDIXLLDFPMSRASTPCI

SEQ ID NO: 27638 - protein, 49 aa, Diabrotica virgifera
  misc_feature: Coding regions on vcDNA: vcDNA=SeqID_7335; Strand=+; Position=40-186
RLVLTTFTCNKYSTSNTKVLNSACHSYTKLLYGRYDKRFAYSNWAVTSF

SEQ ID NO: 27639 - protein, 79 aa, Diabrotica virgifera; identical to SEQ ID NO: 27306
  misc_feature: Coding regions on vcDNA: vcDNA=SeqID_7336; Strand=-; Position=2-238
  misc_feature (1)..(13): Xaa can be any naturally occurring amino acid
  misc_feature (16)..(26): Xaa can be any naturally occurring amino acid
  misc_feature (36)..(43): Xaa can be any naturally occurring amino acid
  misc_feature (46)..(59): Xaa can be any naturally occurring amino acid
  misc_feature (65)..(78): Xaa can be any naturally occurring amino acid

SEQ ID NO: 27640 - protein, 102 aa, Diabrotica virgifera
  misc_feature: Coding regions on vcDNA: vcDNA=SeqID_7337; Strand=-; Position=282-590
RRMMFYEDMMERTNRDEDFIKIISLSDESSFSLTGHHNSSVTIGYSTENGHISVPYKTQYRQKVNVWAGFLGDNVIGPFFIEGTLCRRKYLDLLRNHIILVV

SEQ ID NO: 27641 - protein, 95 aa, Diabrotica virgifera
  misc_feature: Coding regions on vcDNA: vcDNA=SeqID_7338; Strand=+; Position=242-529
MVNKADISPMELMETLVNGRFQSPDWYTMISGFSTENLLREQNKMQAFKLWMDLQSFQQMERVEAMLATNLAMDVKSDSAAQLEVARSAAAKAGQ

SEQ ID NO: 27642 - protein, 61 aa, Diabrotica virgifera
  misc_feature: Coding regions on vcDNA: vcDNA=SeqID_7339; Strand=-; Position=666-851
  misc_feature (33)..(33): Xaa can be any naturally occurring amino acid
NSIKSNPKYGGLQKYLSIGEAFSHWVKEITITXRNDIFLQLNTSEKADVSAKHLKNISCGY

SEQ ID NO: 27643 - protein, 64 aa, Diabrotica virgifera
  misc_feature: Coding regions on vcDNA: vcDNA=SeqID_7340; Strand=+; Position=65-256
  misc_feature (39)..(39): Xaa can be any naturally occurring amino acid
PAIAIYDKYFESIFDKISYCDLNMVIMDGLVSTLRQDVXVELQLLDICRAFSIEGQNDIVRSTA

SEQ ID NO: 27644 - protein, 51 aa, Diabrotica virgifera
  misc_feature: Coding regions on vcDNA: vcDNA=SeqID_7341; Strand=-; Position=2-154
DKCLILGLTIPKFPISSVLSSSSTSRFKSSIQSIQSAENDTLMFVTVACSS

SEQ ID NO: 27645 - protein, 112 aa, Diabrotica virgifera
  misc_feature: Coding regions on vcDNA: vcDNA=SeqID_7342; Strand=-; Position=56-394
  misc_feature (44)..(50): Xaa can be any naturally occurring amino acid
NHKMMTVLWSLHYRHSRQAVQTHPRCSKTINNPLTRCISTLFNXXXXXXXLHLFLIDSVNTHHRNTFDTNVVYISTLFFYNARYCWGGEILPSPRWIRRGASGLFRNQRFSC

SEQ ID NO: 27646 - protein, 62 aa, Diabrotica virgifera
  misc_feature: Coding regions on vcDNA: vcDNA=SeqID_7343; Strand=-; Position=683-871
SLYQIQGESKRKYIIFSAILNGTPLYFISLLKSTTTALPFLDNIPYVQIHQFSRYFHFSMDQ

SEQ ID NO: 27647 - protein, 201 aa, Diabrotica virgifera
  misc_feature: Coding regions on vcDNA: vcDNA=SeqID_7344; Strand=-; Position=59-664
  misc_feature (26)..(177): Xaa can be any naturally occurring amino acid
VISPNISFPPSIVRCRNGIFYIESNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLLHLQKLHGFLQDPPLLDSLIEF

SEQ ID NO: 27648 - protein, 289 aa, Diabrotica virgifera
  misc_feature: Coding regions on vcDNA: vcDNA=SeqID_7345; Strand=-; Position=28-897
  misc_feature: Homolog annotation: Hit_ID=NP_503166.1; Match level="QueryCoverage =96%, HitCoverage=37%, E-value=1e-34, Identity=31%"; Hit description =predicted CDS, reverse transcriptase family member (5A739) [Caenorhabditis elegans]
  misc_feature: Gene Ontology Annotation: Molecular function=molecular_function unknown; Cellular component=cellular_component unknown; Biological process=biological_process unknown
  misc_feature: Pfam annotation: Pfam_ID=RVT_1; Match level="Score=167.8, E-value =2.4e-47, Copies=1"; Pfam description=Reverse transcriptase (RNA -dependent
  misc_feature (171)..(171): Xaa can be any naturally occurring amino acid
RKPSNRSKNGNSPGPDQIPSDWLKLLDDDNVSQLTNIYNHIYETGMMPQIWLESTFIPLPKKPNTSSCKDFRLISLMSHSLKLLLKIILNRIKQKCEETMGNKQFGFREGLGTREALFSMLTLLQRSWEVQKPIYVCFIDFEKAFDRVQHNRLFEYLEMIGIDDKDLRLLXHLYWNQEASILVDGKETDKICIQRGVRQGCVLSPTLFNVYSEIIFNEALEGQCGVRIGGETINNIRYADDTAIMAENIEDLQFLIDRVTSECSNNGLNINATKTKLLVVSKQDVGPNN

SEQ ID NO: 27649 - protein, 80 aa, Diabrotica virgifera
  misc_feature: Coding regions on vcDNA: vcDNA=SeqID_7346; Strand=+; Position=30-272
YEYYEYETTFSVTETSKLDRFDGPPRTTILALSPSGGQKEEDKKYVGTNHGKADLVVERVHVDKLNDGTAEVSGPARADH

SEQ ID NO: 27650 - protein, 92 aa, Diabrotica virgifera
  misc_feature: Coding regions on vcDNA: vcDNA=SeqID_7347; Strand=-; Position=229-507
  misc_feature (45)..(86): Xaa can be any naturally occurring amino acid
MGFSQGFPLKKGVKRRAFGVQFGGAFKGVLRGNKRGFKMGAPKWXXXXXXXXXXXXXXXXXXXXXXXXXXXXXXXXXXXXXXXXXXNGLFIT

SEQ ID NO: 27651 - protein, 328 aa, Diabrotica virgifera
  misc_feature: Coding regions on vcDNA: vcDNA=SeqID_7348; Strand=+; Position=1-984
  misc_feature (19)..(320): Xaa can be any naturally occurring amino acid
VWVVRFYIQKISNSCSSKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQHGPNHCC

SEQ ID NO: 27652 - protein, 169 aa, Diabrotica virgifera
  misc_feature: Coding regions on vcDNA: vcDNA=SeqID_7349; Strand=+; Position=287-794
  misc_feature: Homolog annotation: Hit_ID=XP_314071.1; Match level="QueryCoverage =94%, HitCoverage=6%, E-value=3e-21, Identity=36%"; Hit description =ENSANGP00000015662 [Anopheles gambiae]
  misc_feature: Gene Ontology Annotation: Molecular function=acetyl-CoA carboxylase activity; Cellular component=cellular_component unknown; Biological process=biological_process unknown
  misc_feature (85)..(85): Xaa can be any naturally occurring amino acid
  misc_feature (97)..(97): Xaa can be any naturally occurring amino acid
  misc_feature (117)..(117): Xaa can be any naturally occurring amino acid
  misc_feature (146)..(146): Xaa can be any naturally occurring amino acid
MLTCVLHTWNRSQPTIEDIRTYTMHPWVLETINEPRSTLTNLSAYIVTCTRYYILDRFGHYYLMQLNPSVQVNHTWTDMGTEAKXTPLQLRIDSDIXLHYINDIRVMEKESLAQNEXIDFDLPRHNSQTCGDVIAEKVTSKNHDEXYHTSCGNRQELNFRSSRKFSAYF

SEQ ID NO: 27653 - protein, 93 aa, Diabrotica virgifera
  misc_feature: Coding regions on vcDNA: vcDNA=SeqID_7350; Strand=+; Position=32-313
  misc_feature: Homolog annotation: Hit_ID=NP_652413.1; Match level="QueryCoverage =69%, HitCoverage=72%, E-value=1e-09, Identity=46%"; Hit description =CG7630-PA [Drosophila melanogaster] gb|AAF49346.2| CG7630-PA [Drosophila melanogaster]
MQLRRLLTSPVIRGCTRRNAHHGDHAVQSSYNDLPQPQGSWKTNFDANQRKYNAHLALGVGVLTGTIVFGKATGLLEFYNEFPERPADIASYK

SEQ ID NO: 27654 - protein, 120 aa, Diabrotica virgifera
  misc_feature: Coding regions on vcDNA: vcDNA=SeqID_7351; Strand=+; Position=2-364
  misc_feature: Homolog annotation: Hit_ID=XP_320456.1; Match level="QueryCoverage =100%, HitCoverage=15%, E-value=4e-36, Identity=55%"; Hit description= ENSANGP00000016570 [Anopheles gambiae]
  misc_feature: Gene Ontology Annotation: Molecular function=calpain activity; Cellular component=intracellular; Biological process=muscle development
  misc_feature: Pfam annotation: Pfam_ID=efhand; Match level="Score=23.3, E-value =0.00075, Copies=2"; Pfam description=EF hand
AMLDADRSGKLCFQEFKELWGAIRQWKNVWLMYDTDKSGTFSGFELRDALNSAGFRLNNKVLNILMHRYGNKNGELEFEDFMMCAIKLKSMMDHFKKKQQSGSNNATFSIDEWLESTLYS

SEQ ID NO: 27655 - protein, 146 aa, Diabrotica virgifera
  misc_feature: Coding regions on vcDNA: vcDNA=SeqID_7352; Strand=-; Position=239-678
  misc_feature: Homolog annotation: Hit_ID=AAA29365.1; Match level="QueryCoverage =80%, HitCoverage=11%, E-value=1e-10, Identity=28%"; Hit description =has homology with reverse transcriptase; 5' end of coding region for ORF2 undetermined; putative
  misc_feature (65)..(65): Xaa can be any naturally occurring amino acid
  misc_feature (118)..(118): Xaa can be any naturally occurring amino acid
WRKVASDSQCGFKSAVEAINRIKREISICRSRWTVAFLRDIRNVFNIVSWKIIIRVLGDLGISPXLQTLVRNYFTDRYFNIARSSSMRSTTGVGPLLWTVLYNEILEADLGIGVQAVXHADDLVEHNKNWLTCIEGMESKTSGREI

SEQ ID NO: 27656 - protein, 65 aa, Diabrotica virgifera
  misc_feature: Coding regions on vcDNA: vcDNA=SeqID_7353; Strand=+; Position=135-332
  misc_feature (21)..(27): Xaa can be any naturally occurring amino acid
KFCPNGLNFSYRPQTRKKNGXXXXXXXLLTLSQWNTQYIFLSVERKVIHLSSDIKFFKIGCQITE

SEQ ID NO: 27657 - protein, 315 aa, Diabrotica virgifera
  misc_feature: Coding regions on vcDNA: vcDNA=SeqID_7354; Strand=+; Position=2-941
  misc_feature: Homolog annotation: Hit_ID=XP_314071.1; Match level="QueryCoverage =100%, HitCoverage=13%, E-value=1e-150, Identity=84%"; Hit description=ENSANGP00000015662 [Anopheles gambiae]
  misc_feature: Gene Ontology Annotation: Molecular function=acetyl-CoA carboxylase activity; Cellular component=endoplasmic reticulum membrane; Biological process=nuclear membrane organization and biogenesis
  misc_feature: Pfam annotation: Pfam_ID=CPSase_L_D2; Match level="Score=347.9, E -value=1.4e-101, Copies=1"; Pfam description=Carbamoyl-phosphate synthase L chain,
  misc_feature (252)..(252): Xaa can be any naturally occurring amino acid
  misc_feature (272)..(272): Xaa can be any naturally occurring amino acid
  misc_feature (281)..(281): Xaa can be any naturally occurring amino acid
  misc_feature (288)..(288): Xaa can be any naturally occurring amino acid
LFARGCVSTAEEGLAAAHKIGFPVMIKASEGGGGKGIRKVEHADDFAAAFRQVQTEIPGSPIFVMKLAKCARHLEVQLIADMYGNAISLFGRDCSIQRRHQKIIEEAPAVIAEPSVFEAMEKAAVRLAKMVGYVSAGTVEYLYDPSGQYYFLELNPRLQVEHPCTEMVSDVNLPAAQLQIAMGLPLHYIKDIRLMYGESPWGMSEIDFDQPRHKPQPWGHVIAARITSENPDEGFKPSSGTVQELNFRSSKXNVWGYFSVAASGGLHEFADXSQFGHCFSXGENREQXREKLVIAPQELSIRGDFRTTGEYLITL

SEQ ID NO: 27658 - protein, 92 aa, Diabrotica virgifera
  misc_feature: Coding regions on vcDNA: vcDNA=SeqID_7355; Strand=+; Position=413-691
ANFLMSRSCNNKTFSYNLITHLQLHQYNQQLNQKRELLIIFLIITYTYLQKVSSLYSSGLPHSARSFLVPLLEKRSCNHRYHGVLVKNLANT

SEQ ID NO: 27659 - protein, 100 aa, Diabrotica virgifera
  misc_feature: Coding regions on vcDNA: vcDNA=SeqID_7356; Strand=-; Position=604-906
  misc_feature (24)..(30): Xaa can be any naturally occurring amino acid
  misc_feature (57)..(63): Xaa can be any naturally occurring amino acid
DCVYRYAKRLLPERYPKKIQLHCXXXXXXXHIMLLNIQCNGQSRMLKSFQERLIGSXXXXXXXCFLHIILVVVRSSVFNMVYGFLFFHRYSICSTNFLLI

SEQ ID NO: 27660 - protein, 73 aa, Diabrotica virgifera
  misc_feature: Coding regions on vcDNA: vcDNA=SeqID_7357; Strand=+; Position=195-416
CIWQYAAYCPNDKFPAKGGFCLSMIQKTKLPHRQMFLQVLLKNYEDIVEAYDLHQFAERTHYLIRARDGNRLY

SEQ ID NO: 27661 - protein, 69 aa, Diabrotica virgifera
  misc_feature: Coding regions on vcDNA: vcDNA=SeqID_7358; Strand=-; Position=19-228
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(61): Xaa can be any naturally occurring amino acid
FXXXXXXXXXXXNQPGSHRFKXXXXXXXXXDXXXXXXXXXXXXXXSNIEVAXXXXXXXXXXKFRCYPSR

SEQ ID NO: 27662 - protein, 74 aa, Diabrotica virgifera
  misc_feature: Coding regions on vcDNA: vcDNA=SeqID_7359; Strand=+; Position=483-707
CVSPMTLRDNSVSYFIALHLLMDLIMRSISATFYTSSTTASPLMHETVFDAMTYSPMKFIDIYTADRVAQYIVQ

SEQ ID NO: 27663 - protein, 81 aa, Diabrotica virgifera
  misc_feature: Coding regions on vcDNA: vcDNA=SeqID_7360; Strand=-; Position=2-244
  misc_feature (3)..(15): Xaa can be any naturally occurring amino acid
  misc_feature (18)..(28): Xaa can be any naturally occurring amino acid
  misc_feature (38)..(45): Xaa can be any naturally occurring amino acid
  misc_feature (48)..(61): Xaa can be any naturally occurring amino acid
  misc_feature (67)..(80): Xaa can be any naturally occurring amino acid
LIXXXXXXXXXXXXXPFXXXXXXXXXXXTSLAHTGLNXXXXXXXXSNXXXXXXXXXXXXXXPTSRSXXXXXXXXXXXXXXV

SEQ ID NO: 27664 - protein, 130 aa, Diabrotica virgifera
  misc_feature: Coding regions on vcDNA: vcDNA=SeqID_7361; Strand=+; Position=292-684
LSMNEDADYSDNDCEPPVVDVPSPIADDPPVPSWGDKDEVQTPSSSHDNLDLNVESDMPWAYLLIPSPDTATGETTVPLERGLPTDPLDFFPLYHTTTNESPPDDLKTNASLYGPDLKIQKTSTPRNFIK

SEQ ID NO: 27665 - protein, 245 aa, Diabrotica virgifera
  misc_feature: Coding regions on vcDNA: vcDNA=SeqID_7362; Strand=+; Position=25-759
  misc_feature: Homolog annotation: Hit_ID=AAF87760.1; Match level="QueryCoverage =100%, HitCoverage=55%, E-value=6e-94, Identity=74%"; Hit description= cytochrome oxidase subunit I [Diabrotica virgifera zeae]
  misc_feature: Pfam annotation: Pfam_ID=COX1; Match level="Score=-129.8, E-value =7.9e-07, Copies=1"; Pfam description=Cytochrome C and Quinol oxidase polyp
  misc_feature (21)..(21): Xaa can be any naturally occurring amino acid
  misc_feature (56)..(56): Xaa can be any naturally occurring amino acid
  misc_feature (73)..(73): Xaa can be any naturally occurring amino acid
  misc_feature (76)..(82): Xaa can be any naturally occurring amino acid
  misc_feature (109)..(115): Xaa can be any naturally occurring amino acid
  misc_feature (129)..(129): Xaa can be any naturally occurring amino acid
  misc_feature (137)..(153): Xaa can be any naturally occurring amino acid
  misc_feature (183)..(183): Xaa can be any naturally occurring amino acid
  misc_feature (199)..(206): Xaa can be any naturally occurring amino acid
  misc_feature (227)..(227): Xaa can be any naturally occurring amino acid
FGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFSFQRKRLRPLRITSSIEXLQFNPPAEHRYSELPILS

SEQ ID NO: 27666 - protein, 74 aa, Diabrotica virgifera
  misc_feature: Coding regions on vcDNA: vcDNA=SeqID_7363; Strand=+; Position=188-412
YVRKGTYHLICTNFFFVIRFFVIRSVLKHTSRYAVNFCSKNRSQVTILNLELILCQQYLINIYFNRKCFLSKYF

SEQ ID NO: 27667 - protein, 287 aa, Diabrotica virgifera
  misc_feature: Coding regions on vcDNA: vcDNA=SeqID_7364; Strand=+; Position=3-866
  misc_feature (1)..(272): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFRDNSVILLESYNR

SEQ ID NO: 27668 - protein, 234 aa, Diabrotica virgifera
  misc_feature: Coding regions on vcDNA: vcDNA=SeqID_7365; Strand=-; Position=3-704
  misc_feature: Homolog annotation: Hit_ID=NP_501121.1; Match level="QueryCoverage =81%, HitCoverage=30%, E-value=2e-18, Identity=29%"; Hit description =predicted CDS, reverse transcriptase family member (4H911) [Caenorhabditis elegans]
  misc_feature: Gene Ontology Annotation: Molecular function=molecular_function unknown; Cellular component=cellular_component unknown; Biological process=biological_process unknown
MSNRGCKNSVDSFCYICGEFVIKIYQRNIRSSTSVDSQTGDVGPEISKSEVSQAINSMKTNKSAGPDELPSELIKLVNEKNLDIIVELFNAIYTTGIIPREMLTSAFVCLPKKVNAKECSDYRTISLMSHTLKILLKIIHARVHSKLELDISDTQYGFRNGMGTREALFSFNVLTQRCLDVNRSLYVCFIDYNKAFDKIKHDRLMEILKTKNLDERDLRLITPLLFNAYSEEVM

SEQ ID NO: 27669 - protein, 43 aa, Diabrotica virgifera
  misc_feature: Coding regions on vcDNA: vcDNA=SeqID_7366; Strand=-; Position=76-207
PPKKQELLKKDFPPFENTFFLGGRITFSKEYFNRVVGDPKLGS

SEQ ID NO: 27670 - protein, 93 aa, Diabrotica virgifera
  misc_feature: Coding regions on vcDNA: vcDNA=SeqID_7367; Strand=-; Position=93-374
  misc_feature (29)..(35): Xaa can be any naturally occurring amino acid
  misc_feature (67)..(79): Xaa can be any naturally occurring amino acid
RLRSGRLSLIYSENVLAFNKDLVCFKKRXXXXXXXYTGFVSVWVSTYLFATIGRYNFKNSIYLHMHXXXXXXXXXXXXXNLLNCRLYYYYCTY

SEQ ID NO: 27671 - protein, 212 aa, Diabrotica virgifera
  misc_feature: Coding regions on vcDNA: vcDNA=SeqID_7368; Strand=+; Position=167-805
  misc_feature: Homolog annotation: Hit_ID=XP_392193.1; Match level="QueryCoverage =99%, HitCoverage=66%, E-value=2e-51, Identity=51%"; Hit description =similar to ENSANGP00000010075 [Apis mellifera]
  misc_feature: Gene Ontology Annotation: Molecular function=pyruvate dehydrogenase (lipoamide) activity; Cellular component=mitochondrion; Biological process=coenzymes and prosthetic group metabolism
  misc_feature: Pfam annotation: Pfam_ID=Transket_pyr; Match level="Score=19.9, E -value=1.2e-06, Copies=1"; Pfam description=Transketolase, pyridine binding domai
  misc_feature (35)..(35): Xaa can be any naturally occurring amino acid
  misc_feature (42)..(42): Xaa can be any naturally occurring amino acid
  misc_feature (70)..(70): Xaa can be any naturally occurring amino acid
  misc_feature (93)..(93): Xaa can be any naturally occurring amino acid
  misc_feature (163)..(163): Xaa can be any naturally occurring amino acid
  misc_feature (184)..(184): Xaa can be any naturally occurring amino acid
ADRTQRLYISGGDLAQNDGDYKVTRGLWQMNGDKXFIDTPMXEMCILSELLTVSCYGMVMRPINEFTRFXNLRMQSIDYIIYSDGNTLLHVSXRVNGPFEFRGPNGAASVAAAQHSQSFGAWHAHCSGLTVISPYHSEDSKGLLKAIIADPDPAEFLQNALLXGVPYPMAADPLSQDVVLPIGXANTEKAVNLITFVALSKAVELCLVAAKQ

SEQ ID NO: 27672 - protein, 301 aa, Diabrotica virgifera
  misc_feature: Coding regions on vcDNA: vcDNA=SeqID_7369; Strand=+; Position=2-904
  misc_feature: Homolog annotation: Hit_ID=AAL40415.1; Match level="QueryCoverage =90%, HitCoverage=25%, E-value=1e-36, Identity=33%"; Hit description =endonuclease/reverse transcriptase [Branchiostoma floridae]
  misc_feature: Pfam annotation: Pfam_ID=RVT_1; Match level="Score=85.6, E-value=1.3e- 22, Copies=1"; Pfam description=Reverse transcriptase (RNA-dependent
GDKTKLENYRPISLLPTFSKIFEIAMCTRLIAFFNDDHLIAESQHGYLKGRSVETATYEFVDKILNGWENGEISLGMFLDLSKAFDSIDHHILINKLERYGIRGPARDWIRDYLTDRRQKVIITREGQQFSSEEGNLQLGIAQGSVMGPLLFVFYINNLGSEILSSESHLVNFADDANLLTLASTFEDLLSISSDHLKTAQNWFLKNKLVLNTEKTNCVCFHTKQNNEIIPEEIELDDQTVELSTNTKFLGIYIDQHLNWSEHLCVVRKRINMACYSLRVMSKYFEFTTPLRQVYFCKTSY

SEQ ID NO: 27673 - protein, 103 aa, Diabrotica virgifera
  misc_feature: Coding regions on vcDNA: vcDNA=SeqID_7370; Strand=-; Position=163-474
LSNYRSIAPYVDDKRRGRGSYASPFGHSRSATHRFCNVGYFYPDCSTFSYRTHICKNKDSRNKNVTRLFHYFLINSTQKQFLSILTFENANPSSMCNKTNIIL

SEQ ID NO: 27674 - protein, 66 aa, Diabrotica virgifera
  misc_feature: Coding regions on vcDNA: vcDNA=SeqID_7371; Strand=+; Position=1-198
  misc_feature (3)..(11): Xaa can be any naturally occurring amino acid
  misc_feature (13)..(13): Xaa can be any naturally occurring amino acid
  misc_feature (19)..(64): Xaa can be any naturally occurring amino acid
YLXXXXXXXXXAXIFLKTXXXXXXXXXXXXXXXXXXXXXXXXXXXXXXXXXXXXXXXXXXXXXXFF

SEQ ID NO: 27675 - protein, 124 aa, Diabrotica virgifera
  misc_feature: Coding regions on vcDNA: vcDNA=SeqID_7372; Strand=-; Position=2-373
  misc_feature (6)..(12): Xaa can be any naturally occurring amino acid
  misc_feature (45)..(51): Xaa can be any naturally occurring amino acid
  misc_feature (57)..(113): Xaa can be any naturally occurring amino acid
  misc_feature (116)..(122): Xaa can be any naturally occurring amino acid
SPRAPXXXXXXXGDPGFKKLSVPPPNFKLLIPPSGVAIFYFGFGXXXXXXXRLSPKXXXXXXXXXXXXXXXXXXXXXXXXXXXXXXXXXXXXXXXXXXXXXXXXXXXXXXXXXFLXXXXXXXFL

SEQ ID NO: 27676 - protein, 94 aa, Diabrotica virgifera
  misc_feature: Coding regions on vcDNA: vcDNA=SeqID_7373; Strand=-; Position=31-315
TALVDTHSLVYRASTLGTFIVTSTQSVSALLLGNTRVFFLVISARFATSLSPHFYYLLKFLNYLKTFFFPQAGHVVVLPYIRIHHLLHLNKLRR

SEQ ID NO: 27677 - protein, 25 aa, Diabrotica virgifera
  misc_feature: Coding regions on vcDNA: vcDNA=SeqID_7374; Strand=-; Position=0-74
VCNKTIKKKQRHIYLFSLSGPKKRT

SEQ ID NO: 27678 - protein, 280 aa, Diabrotica virgifera
  misc_feature: Coding regions on vcDNA: vcDNA=SeqID_7375; Strand=+; Position=115-953
  misc_feature: Homolog annotation: Hit_ID=XP_393107.1; Match level="QueryCoverage =92%, HitCoverage=45%, E-value=7e-68, Identity=52%"; Hit description =similar to ENSANGP00000016831 [Apis mellifera]
  misc_feature: Gene Ontology Annotation: Molecular function=actin binding; Cellular component=membrane fraction; Biological process=regulation of cytoskeleton
  misc_feature: Pfam annotation: Pfam_ID=FCH; Match level="Score=39.2, E-value=1.2e -08, Copies=1"; Pfam description=Fes/CIP4 homology domain
  misc_feature (151)..(151): Xaa can be any naturally occurring amino acid
  misc_feature (243)..(243): Xaa can be any naturally occurring amino acid
  misc_feature (247)..(247): Xaa can be any naturally occurring amino acid
  misc_feature (265)..(265): Xaa can be any naturally occurring amino acid
SKSFGIFFRQKSGQNGFEDLRRYVKQGGDFCKELSQILHERAEAETQYAKSLSKLSTKLSRACREGVGGLNESWKAVALELETKAEAHRLLGVALLEETAKPLKNLTESQHRIRKQSESSVDKASKLLSDWRASEAKGKKHSHSCARENEXLQDAAVLDTTKYGKQTISKSSSLIHLAQMKQHSTDKENAKLEGKKRKAEDAVKKSDIEYYSLCVRAERARLEWESAVLRGASTFQALEEERXNNLXSVLSSYLHHIRNLGPRLXEASEGLKVLLIKLIL

SEQ ID NO: 27679 - protein, 86 aa, Diabrotica virgifera
  misc_feature: Coding regions on vcDNA: vcDNA=SeqID_7376; Strand=-; Position=84-344
  misc_feature (15)..(24): Xaa can be any naturally occurring amino acid
LARYMMRAEIRTAVXXXXXXXXXXSNYYKSMEQSSGENKRESRYISIIWSLYDKVASRMITLYDTLCMMCAFPVVEYPAYGALRKL

SEQ ID NO: 27680 - protein, 128 aa, Diabrotica virgifera
  misc_feature: Coding regions on vcDNA: vcDNA=SeqID_7377; Strand=+; Position=543-926
  misc_feature: Homolog annotation: Hit_ID=XP_232510.2; Match level="QueryCoverage =96%, HitCoverage=19%, E-value=4e-36, Identity=58%"; Hit description =similar to RecQ protein-like [Rattus norvegicus]
  misc_feature: Gene Ontology Annotation: Molecular function=ATP dependent DNA helicase activity; Cellular component=nucleus; Biological process =DNA repair
  misc_feature: Pfam annotation: Pfam_ID=DEAD; Match level="Score=0.8, E-value=1.7e -05, Copies=1"; Pfam description=DEAD/DEAH box helicase
  misc_feature (62)..(70): Xaa can be any naturally occurring amino acid
ISYLITVIMPTGGGKSLVYHLPALVNNNVTLVVSPLISLIEDQLMALQQLGINANTLNSGSXXXXXXXXXTDMDSNNPKLRLLYVTPEWVAKSKTFMTHLQKCYGKGHLVRIVIDEVHCCSTWGHDFR

SEQ ID NO: 27681 - protein, 75 aa, Diabrotica virgifera
  misc_feature: Coding regions on vcDNA: vcDNA=SeqID_7378; Strand=-; Position=405-632
EHVCDVQDKSTDSVPSSVAATRTTCPAVPLSTGIIFSSPGFRGLALESHTWKESASSLVNTFKAYCFHYYASYSM

SEQ ID NO: 27682 - protein, 136 aa, Diabrotica virgifera
  misc_feature: Coding regions on vcDNA: vcDNA=SeqID_7379; Strand=+; Position=15-425
  misc_feature: Homolog annotation: Hit_ID=Q27017; Match level="QueryCoverage=83%, HitCoverage=90%, E-value=8e-10, Identity=31%"; Hit description=B1 protein precursor gb|AAC41571.1| B1 protein
  misc_feature: Pfam annotation: Pfam_ID=PBP_GOBP; Match level="Score=32.7, E-value =1.1e-06, Copies=1"; Pfam description=PBP/GOBP family
MWIFQYILCVFFFVYLPISVKASERVETHRQCQANTKTKLSDDIVHKLHTGEEVNDPILGKHMLCMFTKMLIMNADGDINAEVLRTKANRALKDENKLNALVKRCSIKEPGSAEDAAIKLLKCVEIDVPVIKHQYT

SEQ ID NO: 27683 - protein, 72 aa, Diabrotica virgifera
  misc_feature: Coding regions on vcDNA: vcDNA=SeqID_7380; Strand=+; Position=109-327
SDRRRICVSCLLCQTSPNDNWEEDSTNYPSTVFHKLTLLHGAEILKSMDTAKSTSITQDQLVCIIHLRIPYF

SEQ ID NO: 27684 - protein, 233 aa, Diabrotica virgifera
  misc_feature: Coding regions on vcDNA: vcDNA=SeqID_7381; Strand=+; Position=2-700
  misc_feature: Homolog annotation: Hit_ID=XP_397448.1; Match level="QueryCoverage =97%, HitCoverage=35%, E-value=3e-96, Identity=74%"; Hit description =similar to SR protein kinase 1 [Apis mellifera]
  misc_feature: Gene Ontology Annotation: Molecular function=ATP binding; Cellular component=cellular_component unknown; Biological process=protein amino acid phosphorylation
  misc_feature: Pfam annotation: Pfam_ID=Pkinase; Match level="Score=-84.1, E-value =0.0012, Copies=1"; Pfam description=Protein kinase domain
  misc_feature (103)..(108): Xaa can be any naturally occurring amino acid
  misc_feature (150)..(157): Xaa can be any naturally occurring amino acid
HGGENRHNSKTEPSHSSSNETIGDEDPYTSEEEEQEDSSDYRKGGYHPVRIGDLFLSRYHVTRKLGWGHFSTVWLCWDLEEKRFVALKIVKSADHFTETALDXXXXXXSVRESDPTDPKRNKTVQLLNDFKISGINGVHVCMVFEVLGHXXXXXXXXSNYRGIPLANVRTIMKQVLEGLDYLHSKCRIIHTDIKPENVLLCISEDAIRTLACKAAELSQLGIKLPTSLISTAP

SEQ ID NO: 27685 - protein, 66 aa, Diabrotica virgifera
  misc_feature: Coding regions on vcDNA: vcDNA=SeqID_7382; Strand=-; Position=2-199
  misc_feature (3)..(9): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PFXXXXXXXLKIETNLAHTGLNXXXXXXXXSNXXXXXXXXXXXXXXPTSRSXXXXXXXXXXXXXXV

SEQ ID NO: 27686 - protein, 172 aa, Diabrotica virgifera
  misc_feature: Coding regions on vcDNA: vcDNA=SeqID_7383; Strand=+; Position=158-678
  misc_feature: Homolog annotation: Hit_ID=NP_727489.1; Match level="QueryCoverage =90%, HitCoverage=27%, E-value=2e-31, Identity=48%"; Hit description =CG12101-PB, isoform B [Drosophila melanogaster] ref|NP_511115.2| CG12101-PA, isoform A [Drosophila
  misc_feature: Gene Ontology Annotation: Molecular function=heat shock protein activity; Cellular component=mitochondrial inner membrane; Biological process=cell organization and biogenesis
  misc_feature (50)..(50): Xaa can be any naturally occurring amino acid
  misc_feature (101)..(101): Xaa can be any naturally occurring amino acid
IIEIKEDTPKDVRIGSEDRALMLQGAEVLGDGEEDTQEAKGRDENIEQYXGLHNITEEGGTQPRGLELKEKFQNIKAILVQDVAHKTNENAGDGITTLRSXARTIDKERFDNLRRSANPVRMRKGIISGDEESSKSRKSLSKPVPSPAEIRPAATICCKSGRLIWSFNCRMP

SEQ ID NO: 27687 - protein, 182 aa, Diabrotica virgifera
  misc_feature: Coding regions on vcDNA: vcDNA=SeqID_7384; Strand=+; Position=38-586
  misc_feature: Homolog annotation: Hit_ID=XP_395544.1; Match level="QueryCoverage =100%, HitCoverage=100%, E-value=2e-84, Identity=80%"; Hit description=similar to ENSANGP00000014512 [Apis mellifera]
  misc_feature: Gene Ontology Annotation: Molecular function=RNA binding; Cellular component=cellular_component unknown; Biological process=regulation of cell cycle
  misc_feature: Pfam annotation: Pfam_ID=PUA; Match level="Score=65.6, E-value=1.4e -16, Copies=1"; Pfam description=PUA domain
MFKKFDEKESISGVLQLKSSVQKAIRAKLIESYPHLENYIDAILPKKDSLRIVKCHDHIEIVVNSSGDLLFFRQRESQWMPTLKLLHKYPFFLPMQQVDKGAIRFVLSGANIMCPGLTSPGAKMTEVSKDTIVAIMAEGKEHALAIGRTSLSTEDIAKVNKGVGVENCHYLNDGLWQMKPVK

SEQ ID NO: 27688 - protein, 135 aa, Diabrotica virgifera
  misc_feature: Coding regions on vcDNA: vcDNA=SeqID_7385; Strand=-; Position=62-469
  misc_feature (117)..(123): Xaa can be any naturally occurring amino acid
ALSIKNSLKAKEMYSNNLFIIFFLFFIFIDFVSILSIQQILLSIPFSSYLARSLHLIWLWFPSFQPSLRFPYGLPLPLLDTGAYSPSAFASFLVRLVASGASLRPFWFGTSLSGIWXXXXXXXLKGTLQILDCLG

SEQ ID NO: 27689 - protein, 82 aa, Diabrotica virgifera
  misc_feature: Coding regions on vcDNA: vcDNA=SeqID_7386; Strand=+; Position=70-318
  misc_feature (5)..(12): Xaa can be any naturally occurring amino acid
  misc_feature (69)..(77): Xaa can be any naturally occurring amino acid
IGNLXXXXXXXXTVSITTEHNLEPVSKIKKFCLSFVWPLKTTKNSNQPYTSHPKTRRDVTGLYVYILHXXXXXXXXXHYKRQ

SEQ ID NO: 27690 - protein, 93 aa, Diabrotica virgifera
  misc_feature: Coding regions on vcDNA: vcDNA=SeqID_7387; Strand=-; Position=267-548
YERVSLCPECFVIQRLSFVDLVVSVLLSEYSPGTSSIVFDRVGLSGRVVFPDQVLHKDFAFRPIRRSMLMESRFFLSAVLSESRALFHTLSST

SEQ ID NO: 27691 - protein, 137 aa, Diabrotica virgifera
  misc_feature: Coding regions on vcDNA: vcDNA=SeqID_7388; Strand=+; Position=314-727
  misc_feature (7)..(13): Xaa can be any naturally occurring amino acid
  misc_feature (55)..(61): Xaa can be any naturally occurring amino acid
  misc_feature (121)..(128): Xaa can be any naturally occurring amino acid
HMVRLFXXXXXXXNMFLKSFGHGSSILLFKFKMKYEWARPNPTRYCIAPYSLSNXXXXXXXLISALEFKKEVDFFYTYSKYIMGYLKTGRLAYQTYVPQILTGDEYSRFVSGQIRARRTVXXXXXXXXLSILVVTYG

SEQ ID NO: 27692 - protein, 17 aa, Diabrotica virgifera
  misc_feature: Coding regions on vcDNA: vcDNA=SeqID_7389; Strand=-; Position=2-52
ERQKFRQKKGEIKGRRR

SEQ ID NO: 27693 - protein, 33 aa, Diabrotica virgifera
  misc_feature: Coding regions on vcDNA: vcDNA=SeqID_7390; Strand=+; Position=1-99
RFYSPTSVYGFSSYKNVTCLSLSTKSQHNSSLP

SEQ ID NO: 27694 - protein, 265 aa, Diabrotica virgifera
  misc_feature: Coding regions on vcDNA: vcDNA=SeqID_7391; Strand=+; Position=3-797
  misc_feature: Homolog annotation: Hit_ID=EAL41130.1; Match level="QueryCoverage =97%, HitCoverage=57%, E-value=3e-37, Identity=38%"; Hit description =ENSANGP00000029194 [Anopheles gambiae str. PEST] ref|XP_559391.1| ENSANGP00000029194 [Anopheles gambiae st
  misc_feature: Gene Ontology Annotation: Cellular component=extracellular space
  misc_feature: Pfam annotation: Pfam_ID=Chitin_bind_4; Match level="Score=18.1, E -value=0.00023, Copies=1"; Pfam description=Insect cuticle protein
  misc_feature (60)..(66): Xaa can be any naturally occurring amino acid
NKVNDDGSFTFVYEAADGSFKEETRGTDCVVRGKYGYVDPDGNKREFTYVSGNPCDPNAXXXXXXXENEADNENIPANYPSRPIQPQYRRPPVTAAPKPAVTLFQNNYAQEEEEPEPEQLLRVTPQPQPVRRPTYISRPQYVPQTTPTAEERPNYRQQVLSSTTPSSVIYRTSAHPISITPRPVTTTTKRPQLPATTYRPQLLQVSVTPRPNSLLYSKQLQSTLQPTAFPEKNDTPTPFTVKPTTPKPKPAGNPGQVYSTALIYD

SEQ ID NO: 27695 - protein, 122 aa, Diabrotica virgifera
  misc_feature: Coding regions on vcDNA: vcDNA=SeqID_7392; Strand=+; Position=2-370
  misc_feature (2)..(37): Xaa can be any naturally occurring amino acid
  misc_feature (73)..(83): Xaa can be any naturally occurring amino acid
PXXXXXXXXXXXXXXXXXXXXXXXXXXXXXXXXXXXXNAPKKGAGGNTRGGKKVLGPLKKRGGCLRVPIGDQXXXXXXXXXXXEEGGHPGGEGINGGGFRGGGGSTGPLFYLWLDSGKKPSH

SEQ ID NO: 27696 - protein, 33 aa, Diabrotica virgifera
  misc_feature: Coding regions on vcDNA: vcDNA=SeqID_7393; Strand=+; Position=1-99
  misc_feature (1)..(32): Xaa can be any naturally occurring amino acid
XXXXXXXXXXXXXXXXXXXXXXXXXXXXXXXXG

SEQ ID NO: 27697 - protein, 78 aa, Diabrotica virgifera
  misc_feature: Coding regions on vcDNA: vcDNA=SeqID_7394; Strand=-; Position=309-545
VEKQEAMKSSLMGHLKVRDSVPVPSLSFFSGCIVASRHSYSGVFYSLELKFSVAELLSVMSVFVGLLELLVLIVQIQL

SEQ ID NO: 27698 - protein, 70 aa, Diabrotica virgifera
  misc_feature: Coding regions on vcDNA: vcDNA=SeqID_7395; Strand=-; Position=181-393
VSLYSLVLLVLYVSIFSECIVGTLMNVTIWTLIDVLSSISIRVSTSLPSSMCVSSFFTTRVTFFFLFNIA

SEQ ID NO: 27699 - protein, 116 aa, Diabrotica virgifera
  misc_feature: Coding regions on vcDNA: vcDNA=SeqID_7396; Strand=+; Position=2-349
  misc_feature (11)..(22): Xaa can be any naturally occurring amino acid
PHTMARNLTDXXXXXXXXXXXXTTGSSPACKVQNTSYMYLELDYVQSEPTAPEDERSGTSTTDVPHRTIDLWRRKCHVYLCLQATTHLREERDYLALDPILTLDASRTGLQGLLLF

SEQ ID NO: 27700 - protein, 292 aa, Diabrotica virgifera
  misc_feature: Coding regions on vcDNA: vcDNA=SeqID_7397; Strand=+; Position=2-880
  misc_feature: Homolog annotation: Hit_ID=XP_311417.1; Match level="QueryCoverage =85%, HitCoverage=25%, E-value=3e-87, Identity=64%"; Hit description =ENSANGP00000016886 [Anopheles gambiae]
  misc_feature: Gene Ontology Annotation: Molecular function=helicase activity; Cellular component=nucleus; Biological process=chromatin modeling
  misc_feature (12)..(26): Xaa can be any naturally occurring amino acid
  misc_feature (218)..(228): Xaa can be any naturally occurring amino acid
EKQRKIDESEPXXXXXXXXXXXXXXXGFTNWNKHDFNQFIKVNEKYGRDDIENIAKYVKGKTPEEVMEYSAVFWERCHELQDIDNIMAQIERGETEIQRRLSIKKALDAKMARYREPFHQLRISYGTNKNKNYKEDEDRFLVCMLHKLGFDKENVYEELRAAVQASEQFRDSLLKWRTATELQRRCNTLITLIERENAELEEREKINKKKEVSKSSNXXXXXXXXXXXSSQKRKKDTSAGGIQKIEKIDKEKKVSKSSNLGGIPAQISSKSSQKLKEDTSILYIALKNIKRK

SEQ ID NO: 27701 - protein, 289 aa, Diabrotica virgifera
  misc_feature: Coding regions on vcDNA: vcDNA=SeqID_7398; Strand=+; Position=5-871
  misc_feature: Homolog annotation: Hit_ID=XP_397206.1; Match level="QueryCoverage =63%, HitCoverage=22%, E-value=6e-49, Identity=51%"; Hit description =similar to ENSANGP00000019500 [Apis mellifera]
  misc_feature: Pfam annotation: Pfam_ID=FYVE; Match level="Score=72.2, E-value=1.4e -18, Copies=1"; Pfam description=FYVE zinc finger
  misc_feature (264)..(264): Xaa can be any naturally occurring amino acid
  misc_feature (270)..(270): Xaa can be any naturally occurring amino acid
MLSIFSPFEQDQLLCLLYEPLSIIEILIMNTKLDKLASVLNIVKLEISQSEFDTAVISIKEIDELLRTYGEKTLDFRIITQPNPRLLRTPEFKLMQSLDSLNLGPYNKNFVMPDEVPIKDDWIPNNEVLECMCCQKIVFSMFNRRHHCRRCGRVICYNCSLHRMLVPTYDDILVRVCLDCYRQTVGESETSELNDSLSLKSAVYDFWILTDDDAHNTIVREEFSYEHAPNVSLCLSLMKYHSKTTEYPKFLLDQCSIMVKLLQXSQEPIXEIDYLLGIKMIKSLAMAAK

SEQ ID NO: 27702 - protein, 85 aa, Diabrotica virgifera
  misc_feature: Coding regions on vcDNA: vcDNA=SeqID_7399; Strand=+; Position=473-730
  misc_feature (25)..(31): Xaa can be any naturally occurring amino acid
LDLLLEHLYTNDTNLKLIYLEHIAXXXXXXXTVLMMRANGKDEPPDENSVDKLVKDDDSINLKIHLAHPYSRYRFTIPEFQHIAS

SEQ ID NO: 27703 - protein, 139 aa, Diabrotica virgifera
  misc_feature: Coding regions on vcDNA: vcDNA=SeqID_7400; Strand=+; Position=270-689
  misc_feature: Homolog annotation: Hit_ID=CAA51721.1; Match level="QueryCoverage =77%, HitCoverage=32%, E-value=3e-09, Identity=34%"; Hit description =glyceraldehyde-3-phosphate dehydrogenase [Claviceps purpurea] pir||S40610 glyceraldehyde-3-phosphate dehyd
  misc_feature (57)..(57): Xaa can be any naturally occurring amino acid
  misc_feature (62)..(62): Xaa can be any naturally occurring amino acid
HQQRNPLAIPWKLAAGKHDAKSTGQCPRSKRTKPLSVCVDKKEMICLPSADAPMDAXKLTSXAYDRCDLILPSDICTIFWLAPLNNVIFNNFYCAEGNMCPSNIYLDTPFFDIECSLTIVLSQIYRPQLGQSPLQPVVA

SEQ ID NO: 27704 - protein, 65 aa, Diabrotica virgifera
  misc_feature: Coding regions on vcDNA: vcDNA=SeqID_7401; Strand=+; Position=1-198
  misc_feature (28)..(33): Xaa can be any naturally occurring amino acid
QQLGQGRPVPLNQYQDIDTNQILNLIYXXXXXXGSAYPLNQYLVSQRQVNSSNRPNVQPDGRHSS

SEQ ID NO: 27705 - protein, 233 aa, Diabrotica virgifera
  misc_feature: Coding regions on vcDNA: vcDNA=SeqID_7402; Strand=+; Position=1-700
  misc_feature: Homolog annotation: Hit_ID=NP_608540.1; Match level="QueryCoverage =98%, HitCoverage=61%, E-value=4e-26, Identity=27%"; Hit description =CG2839-PA [Drosophila melanogaster] gb|AAF51469.2| CG2839-PA [Drosophila melanogaster]
  misc_feature: Gene Ontology Annotation: Molecular function=pre-mRNA splicing factor activity; Cellular component=nucleus; Biological process=mRNA splicing
  misc_feature (16)..(16): Xaa can be any naturally occurring amino acid
  misc_feature (41)..(41): Xaa can be any naturally occurring amino acid
  misc_feature (118)..(118): Xaa can be any naturally occurring amino acid
  misc_feature (133)..(133): Xaa can be any naturally occurring amino acid
FVAERRGREERQGNSXERRRPNEPPRSTERERKKTKRDKPXQRRTEPREKHPKARETQQRDPTKKETRDDERTEKKHRTAEEQHSQTPDRHEHRKQSTRRRQSRRNRGPTRKSTEGPXKPPPKTTGHRRRKHXERKRRQKTERTRGKRRQHRRRRGRENRDNGAEQRTRDPTKEDEQARDSEDRHRQTEGESETPERKDPQTRKPAANERRSATEDDAHNTKGREEQTHEHAP

SEQ ID NO: 27706 - protein, 79 aa, Diabrotica virgifera
  misc_feature: Coding regions on vcDNA: vcDNA=SeqID_7403; Strand=+; Position=492-731
LVKTNCLHDRRVREKLLLKMTSDLCLVSTPVYNECMYVGEFCCEERVIAYKILNLDLSTSEQVRLPAEFKHITNRRKRN

SEQ ID NO: 27707 - protein, 55 aa, Diabrotica virgifera
  misc_feature: Coding regions on vcDNA: vcDNA=SeqID_7404; Strand=+; Position=410-577
  misc_feature: Homolog annotation: Hit_ID=CAG31614.1; Match level="QueryCoverage =89%, HitCoverage=23%, E-value=2e-09, Identity=57%"; Hit description =hypothetical protein [Gallus gallus] ref|NP_001006173.1| similar to otoancorin [Gallus gallus]
  misc_feature (28)..(28): Xaa can be any naturally occurring amino acid
IVNWRYRYASEALDYFICVVCGVVKIIXYCDFFYLYITKVVKGKKVLSPVYPPLI

SEQ ID NO: 27708 - protein, 92 aa, Diabrotica virgifera
  misc_feature: Coding regions on vcDNA: vcDNA=SeqID_7405; Strand=-; Position=55-333
HLSQVEIGNFMLNVSQGIYSLQLDQNKIRLKKGYTTTTRAKSQQIHTRGYTTTTGTKRRHTKIKENINFLSRLRELKNNTGGTGNRGSGLRG

SEQ ID NO: 27709 - protein, 100 aa, Diabrotica virgifera
  misc_feature: Coding regions on vcDNA: vcDNA=SeqID_7406; Strand=+; Position=89-391
LTGWETITRRMRSRRSMTPTLLCPMTRTWRILILEGTLWRTGREIRPKWICSSWLTTPTWLFPSNGSCRPATRQDYGCQESHDQGGELHGQEGGPRGPRG

SEQ ID NO: 27710 - protein, 286 aa, Diabrotica virgifera
  misc_feature: Coding regions on vcDNA: vcDNA=SeqID_7407; Strand=-; Position=136-996
  misc_feature (1)..(5): Xaa can be any naturally occurring amino acid
  misc_feature (7)..(43): Xaa can be any naturally occurring amino acid
  misc_feature (47)..(54): Xaa can be any naturally occurring amino acid
  misc_feature (56)..(74): Xaa can be any naturally occurring amino acid
  misc_feature (88)..(95): Xaa can be any naturally occurring amino acid
  misc_feature (99)..(104): Xaa can be any naturally occurring amino acid
  misc_feature (112)..(128): Xaa can be any naturally occurring amino acid
  misc_feature (164)..(172): Xaa can be any naturally occurring amino acid
  misc_feature (188)..(266): Xaa can be any naturally occurring amino acid
  misc_feature (268)..(279): Xaa can be any naturally occurring amino acid
XXXXXDXXXXXXXXXXXXXXXXXXXXXXXXXXXXXXXXXXXXXKKGXXXXXXXXGXXXXXXXXXXXXXXXXXXXFGRVERVGVSFGFXXXXXXXXLWGXXXXXXSPPLVGAXXXXXXXXXXXXXXXXXGRGGGGRHAKKGGDPRGFSPPRFFKQPPRNIFWGAXXXXXXXXXPLRKGKFFLGPPPLSXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXPTWLTPV

SEQ ID NO: 27711 - protein, 178 aa, Diabrotica virgifera
  misc_feature: Coding regions on vcDNA: vcDNA=SeqID_7408; Strand=+; Position=1-537
  misc_feature: Homolog annotation: Hit_ID=XP_310701.1; Match level="QueryCoverage =98%, HitCoverage=59%, E-value=2e-47, Identity=60%"; Hit description =ENSANGP00000010117 [Anopheles gambiae]
  misc_feature: Gene Ontology Annotation: Molecular function=heterogeneous nuclear ribonucleoprotein; Cellular component=nuclear speck; Biological process=RNA-nucleus export
  misc_feature: Pfam annotation: Pfam_ID=GRP; Match level="Score=-13.9, E-value =0.0016, Copies=1"; Pfam description=Glycine rich protein family
GFCFITFESEQVVNELLKQPKQTIKDKEVDVKKATPKPDQMGGPMMGMRGMRGGGRGGPMRGGRGGRGGYGNQGNWNQAYGGYGYGQGYGYDGYSQGYDYYGSGYGGYGGYDYSNYGGGNYDQGYGYDGGYGGGGGTGRNVNTRGKGGAGGYQSGGAGGGPKQRGAGQRNQRFQPYQK

SEQ ID NO: 27712 - protein, 86 aa, Diabrotica virgifera
  misc_feature: Coding regions on vcDNA: vcDNA=SeqID_7409; Strand=-; Position=71-331
  misc_feature (42)..(49): Xaa can be any naturally occurring amino acid
PSSRKRFPDNRMAFFIIENSVIDKMAKIETCSLNFSNSRSVXXXXXXXXGYFPPNLLPLFLTILVKFVKNDAIMDFHSVDIFCVAL

SEQ ID NO: 27713 - protein, 98 aa, Diabrotica virgifera
  misc_feature: Coding regions on vcDNA: vcDNA=SeqID_7410; Strand=-; Position=6-302
  misc_feature (39)..(98): Xaa can be any naturally occurring amino acid
YTGTPIITFIPTSRVAIFNIRLELSNKNYAGILKGILSXXXXXXXXXXXXXXXXXXXXXXXXXXXXXXXXXXXXXXXXXXXXXXXXXXXXXXXXXXXX

SEQ ID NO: 27714 - protein, 79 aa, Diabrotica virgifera
  misc_feature: Coding regions on vcDNA: vcDNA=SeqID_7411; Strand=+; Position=703-939
  misc_feature (64)..(64): Xaa can be any naturally occurring amino acid
ILRNSHSFMTYSKFLLLNYLKFYSISHLCTVFRAYIKKVSWRRQNGRGETNVYKSTQISETATXRQIENVVTRRCQIIM

SEQ ID NO: 27715 - protein, 213 aa, Diabrotica virgifera
  misc_feature: Coding regions on vcDNA: vcDNA=SeqID_7412; Strand=+; Position=248-886
  misc_feature: Homolog annotation: Hit_ID=XP_317949.1; Match level="QueryCoverage =88%, HitCoverage=39%, E-value=1e-29, Identity=38%"; Hit description =ENSANGP00000020548 [Anopheles gambiae]
  misc_feature (32)..(32): Xaa can be any naturally occurring amino acid
  misc_feature (157)..(157): Xaa can be any naturally occurring amino acid
  misc_feature (163)..(163): Xaa can be any naturally occurring amino acid
YAQEKNPVNIISLNIGEYEFEKVEHFKYLGSXVNETNGRSIEINERIQAGNRTYWKYSNFIKDKKLTQNTKLKIYKAAIRPVITYGAEVMCLTQKEEERLRILERKIIRRIAGPLNLGNNKFRKLMNHEVRELLKGEDIVRFIKAQRLGWMGHIERXESRSRXQKIAKWRPVSGRPRGRPKTRWEDQIVEDLKEDGSQRIGNQKQKQERMEGN

SEQ ID NO: 27716 - protein, 140 aa, Diabrotica virgifera
  misc_feature: Coding regions on vcDNA: vcDNA=SeqID_7413; Strand=+; Position=20-442
  misc_feature: Homolog annotation: Hit_ID=XP_397380.1; Match level="QueryCoverage =91%, HitCoverage=20%, E-value=4e-09, Identity=33%"; Hit description =similar to CG6382-PA [Apis mellifera]
  misc_feature: Pfam annotation: Pfam_ID=PAM2; Match level="Score=28.0, E-value=2.9e -05, Copies=1"; Pfam description=Ataxin-2 C-terminal region
MSNNTAPDSWESQADSTSTNNSPQHTADVTATFSTLNVNAVEFVPSFSFSKGPEKDEGSSPTNSPGSNSSPPHNLINGNVPDESTERGEGEGTPPISPADSDAAPGGEGGTWEGVGDEKKTSVFASPATTPGRLAGKFPL

SEQ ID NO: 27717 - protein, 67 aa, Diabrotica virgifera
  misc_feature: Coding regions on vcDNA: vcDNA=SeqID_7414; Strand=-; Position=1-201
  misc_feature (5)..(14): Xaa can be any naturally occurring amino acid
  misc_feature (24)..(31): Xaa can be any naturally occurring amino acid
  misc_feature (36)..(41): Xaa can be any naturally occurring amino acid
  misc_feature (53)..(65): Xaa can be any naturally occurring amino acid
GPFGXXXXXXXXXXNPPASHRFNXXXXXXXXSNRLXXXXXXPIINLIQHRGRXXXXXXXXXXXXXLL

SEQ ID NO: 27718 - protein, 32 aa, Diabrotica virgifera
  misc_feature: Coding regions on vcDNA: vcDNA=SeqID_7415; Strand=+; Position=3-98
RKISTVVDRQLVISTLHSQTIPVAFQMLVILC

SEQ ID NO: 27719 - protein, 62 aa, Diabrotica virgifera
  misc_feature: Coding regions on vcDNA: vcDNA=SeqID_7416; Strand=+; Position=18-206
  misc_feature (2)..(7): Xaa can be any naturally occurring amino acid
DXXXXXXPPYTKKNQVVSVEIIKGVPEVYSSALIPHGCHRGLREAAHTTKITQIAVCVLAKN

SEQ ID NO: 27720 - protein, 72 aa, Diabrotica virgifera
  misc_feature: Coding regions on vcDNA: vcDNA=SeqID_7417; Strand=+; Position=1-219
LVCKSFQAPPLIPSTSLISNIMQNFWCWSPFYGFFCALFHTSRMYIIFDLSISNILMNFLLMSYSTCVLLLS

SEQ ID NO: 27721 - protein, 169 aa, Diabrotica virgifera
  misc_feature: Coding regions on vcDNA: vcDNA=SeqID_7418; Strand=-; Position=142-650
  misc_feature: Homolog annotation: Hit_ID=AAC46945.1; Match level="QueryCoverage =98%, HitCoverage=47%, E-value=5e-30, Identity=43%"; Hit description =mariner transposase pir||S35520 transposase - lacewing
  misc_feature: Gene Ontology Annotation: Molecular function=transposase activity; Cellular component=cellular_component unknown; Biological process =DNA transposition
  misc_feature: Pfam annotation: Pfam_ID=Transposase_1; Match level="Score=3.1, E -value=0.00018, Copies=1"; Pfam description=Transposase
  misc_feature (42)..(42): Xaa can be any naturally occurring amino acid
  misc_feature (61)..(61): Xaa can be any naturally occurring amino acid
  misc_feature (128)..(128): Xaa can be any naturally occurring amino acid
TSPPRTCSKNAKIVLSVCVSWDQQCVIYINFLEKGKTVTGLXYAAALLGRFDTELQKKQPXIGKKKVLFHHDNAPAHTSTIAMAKLVECGYDLLSHPPYSPDSALYDFLLFPNLKKELDGQKYMSNAXFITAMEASFEDLKKTSFSDGLTKSMQCCVKYIKLKGDYVQN

SEQ ID NO: 27722 - protein, 81 aa, Diabrotica virgifera
  misc_feature: Coding regions on vcDNA: vcDNA=SeqID_7419; Strand=-; Position=487-732
GGRLKRFEILKLTSRLLSENFRLIGVKLPEIQQVNIPTFDSLCGSFATACLSVVRNVQQLFPFCKLLRDAKTYFGVHYFTI

SEQ ID NO: 27723 - protein, 125 aa, Diabrotica virgifera
  misc_feature: Coding regions on vcDNA: vcDNA=SeqID_7420; Strand=-; Position=162-539
EGTIVLIVICTYHLLRVLAESQCGSRCSTSMLPVHYSVLDYFFDFFILPHFMHFVQQTIEDLSIPYLSLINRQDHLAQQSGCLLSSFLLRAFPHPCRFPFLGSSFLTVSVGPCDLCRETATVTGF

SEQ ID NO: 27724 - protein, 286 aa, Diabrotica virgifera
  misc_feature: Coding regions on vcDNA: vcDNA=SeqID_7421; Strand=+; Position=3-860
  misc_feature: Homolog annotation: Hit_ID=XP_310823.1; Match level="QueryCoverage =94%, HitCoverage=11%, E-value=1e-116, Identity=72%"; Hit description= ENSANGP00000014822 [Anopheles gambiae]
  misc_feature: Gene Ontology Annotation: Molecular function=aspartate carbamoyltransferase activity; Cellular component=mitochondrion; Biological process=arginine metabolism
TVVSELAAEAAGLKMYLNETFTTLRLRDLDVWSKHLANWPKRAPLCVHAESQTTAAIILLASLQNRPVHICHVARKEEILLIKAAKEKGLKVTCEVCPHHLFLSTNDIEKIGVTKSQVRPVLVSPEDQQALWDNLSIIDCFATDHAPHTIEEKLSEKAPPGFPGLETILPLLLNAVNEGRITLEDVINKFHKNPKRIFNLPEQHNTYVEVDMEEEWTIPEAMSYSKAKWTPFAGRKIKGAVHRVVLRGEVAYVEGQVLSATKAFGQNVREWDKRLYTTSRDMSRPF

SEQ ID NO: 27725 - protein, 261 aa, Diabrotica virgifera
  misc_feature: Coding regions on vcDNA: vcDNA=SeqID_7422; Strand=+; Position=1-786
  misc_feature (81)..(86): Xaa can be any naturally occurring amino acid
  misc_feature (261)..(261): Xaa can be any naturally occurring amino acid
EWREFIVYVKMLDKENMRNLLTESYEGSLPVFSHKTYAEFLAAKWLSEHFNQNTRFDVKIIYKNLYTEQLVTARWFLDTMXXXXXXHTKNIQLPTIGCCTYLSDNIGRNQIHYTMSYGKTFDIHTQIENPEQTTIIRRSNELLLKVSQSEPTKLNQDEPDINLSANNLLGVSNKSYDINLYVGLNQFHNTTTYFSDEEPVKFVLYFDINNVNSSNISTIYKLLFNECDDLLGKSAVEYAILAGTLINIEKVLGYNIVYTTX

SEQ ID NO: 27726 - protein, 96 aa, Diabrotica virgifera
  misc_feature: Coding regions on vcDNA: vcDNA=SeqID_7423; Strand=+; Position=134-424
LSYGQNILIFIPSPIYFLNFYFRIIFCFFAGIFYLIFWNSLPCLWSPLTDGALVHCILCLMPARAVYLGIYVLANNNLKRSNVNFVLLLTLLITKV

SEQ ID NO: 27727 - protein, 66 aa, Diabrotica virgifera; identical to SEQ ID NO: 26808
  misc_feature: Coding regions on vcDNA: vcDNA=SeqID_7424; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 27728 - protein, 91 aa, Diabrotica virgifera
  misc_feature: Coding regions on vcDNA: vcDNA=SeqID_7425; Strand=+; Position=7-282
  misc_feature (4)..(10): Xaa can be any naturally occurring amino acid
  misc_feature (14)..(33): Xaa can be any naturally occurring amino acid
  misc_feature (40)..(85): Xaa can be any naturally occurring amino acid
REGXXXXXXXSISXXXXXXXXXXXXXXXXXXXXPIEVYNXXXXXXXXXXXXXXXXXXXXXXXXXXXXXXXXXXXXXXXXXXXXXXNKLRNG

SEQ ID NO: 27729 - protein, 302 aa, Diabrotica virgifera
  misc_feature: Coding regions on vcDNA: vcDNA=SeqID_7426; Strand=+; Position=3-908
  misc_feature: Homolog annotation: Hit_ID=AAF87760.1; Match level="QueryCoverage =100%, HitCoverage=68%, E-value=1e-109, Identity=69%"; Hit description=cytochrome oxidase subunit I [Diabrotica virgifera zeae]
  misc_feature: Pfam annotation: Pfam_ID=COX1; Match level="Score=-26.7, E-value=2.5e- 10, Copies=1"; Pfam description=Cytochrome C and Quinol oxidase polyp
  misc_feature (19)..(27): Xaa can be any naturally occurring amino acid
  misc_feature (31)..(37): Xaa can be any naturally occurring amino acid
  misc_feature (48)..(55): Xaa can be any naturally occurring amino acid
  misc_feature (76)..(76): Xaa can be any naturally occurring amino acid
  misc_feature (111)..(111): Xaa can be any naturally occurring amino acid
  misc_feature (128)..(128): Xaa can be any naturally occurring amino acid
  misc_feature (131)..(137): Xaa can be any naturally occurring amino acid
  misc_feature (164)..(170): Xaa can be any naturally occurring amino acid
  misc_feature (184)..(184): Xaa can be any naturally occurring amino acid
  misc_feature (192)..(208): Xaa can be any naturally occurring amino acid
  misc_feature (238)..(238): Xaa can be any naturally occurring amino acid
  misc_feature (254)..(261): Xaa can be any naturally occurring amino acid
  misc_feature (269)..(269): Xaa can be any naturally occurring amino acid
  misc_feature (282)..(282): Xaa can be any naturally occurring amino acid
  misc_feature (301)..(301): Xaa can be any naturally occurring amino acid
RNLNTSFFDPAGGGDPILXXXXXXXXXHPEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFSFQRXRLRPLRITSFIEXLQFNPPAEHRYSELPILSXN

SEQ ID NO: 27730 - protein, 20 aa, Diabrotica virgifera
  misc_feature: Coding regions on vcDNA: vcDNA=SeqID_7427; Strand=-; Position=0-59
  misc_feature (8)..(14): Xaa can be any naturally occurring amino acid
GHPHYFSXXXXXXXGIFVVA

SEQ ID NO: 27731 - protein, 75 aa, Diabrotica virgifera
  misc_feature: Coding regions on vcDNA: vcDNA=SeqID_7428; Strand=-; Position=168-395
VDGGEEKKLILRLRLCLSAAPCSVGVDRLDAYVFLVTGCSPSSVLLADVWGRGRSDPCLLFLTALSSCRDLYTSH

SEQ ID NO: 27732 - protein, 108 aa, Diabrotica virgifera
  misc_feature: Coding regions on vcDNA: vcDNA=SeqID_7429; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid
NYAVIPKVIYSYXXXXXXXXXXXXXXXXXXXXXXXXXPXXXXXXXXXXXXXXXXXXXXXXSIGSSXXXXXXXLFXXXXXXXXXXXXXXXXXXXPSFQXXXXXXXXMLP

SEQ ID NO: 27733 - protein, 98 aa, Diabrotica virgifera
  misc_feature: Coding regions on vcDNA: vcDNA=SeqID_7430; Strand=-; Position=614-909
  misc_feature: Homolog annotation: Hit_ID=AAB04627.1; Match level="QueryCoverage =83%, HitCoverage=10%, E-value=1e-10, Identity=37%"; Hit description =reverse transcriptase [Chironomus tentans]
  misc_feature (44)..(44): Xaa can be any naturally occurring amino acid
RKRCSRYSLVWEESRGVIHQLKDNKTACWDDIRIEQIKNLGPKXVKWLLKMMNCCIRTLHISKTWRKAKVVALLKPGKCPADTKSFRPVSLLCDLFKV

SEQ ID NO: 27734 - protein, 58 aa, Diabrotica virgifera
  misc_feature: Coding regions on vcDNA: vcDNA=SeqID_7431; Strand=+; Position=2-178
GEVSCCGVFLADVEVDTIRRSATLERALDPHTCGYMPTSSDAISGNQRRNHERGWAQE

SEQ ID NO: 27735 - protein, 65 aa, Diabrotica virgifera
  misc_feature: Coding regions on vcDNA: vcDNA=SeqID_7432; Strand=-; Position=267-464
  misc_feature (29)..(35): Xaa can be any naturally occurring amino acid
VPPHCRICTSSIFIIILRADSNTILCLRXXXXXXXSTYLENLQLQIRGGINHQTDIPQKFRHVLK

SEQ ID NO: 27736 - protein, 158 aa, Diabrotica virgifera
  misc_feature: Coding regions on vcDNA: vcDNA=SeqID_7433; Strand=+; Position=255-732
  misc_feature: Homolog annotation: Hit_ID=CAE58911.1; Match level="QueryCoverage =87%, HitCoverage=37%, E-value=1e-18, Identity=38%"; Hit description =Hypothetical protein CBG02167 [Caenorhabditis briggsae]
  misc_feature: Gene Ontology Annotation: Molecular function=structural constituent of cytoskeleton; Cellular component=cytoskeleton; Biological process= actin cytoskeleton organization and biogenesis
  misc_feature (70)..(70): Xaa can be any naturally occurring amino acid
MKSLFTMTTTPLIFLLIFFNMTERTLDDFNYYSLLDAIQMVLAFEASGQTIDNVIKSGDGEYRMVRINDXIALPRALILLHYAGQEWNDMLLGLLTEYGYSITCALDRGLVRDNSPLICYVTLLLQIQMQPSVSTTFIETQTYLPDDIYLHIPFLRIR

SEQ ID NO: 27737 - protein, 221 aa, Diabrotica virgifera
  misc_feature: Coding regions on vcDNA: vcDNA=SeqID_7434; Strand=-; Position=0-662
  misc_feature (4)..(11): Xaa can be any naturally occurring amino acid
  misc_feature (13)..(24): Xaa can be any naturally occurring amino acid
  misc_feature (26)..(45): Xaa can be any naturally occurring amino acid
  misc_feature (51)..(117): Xaa can be any naturally occurring amino acid
  misc_feature (125)..(156): Xaa can be any naturally occurring amino acid
  misc_feature (160)..(168): Xaa can be any naturally occurring amino acid
  misc_feature (172)..(197): Xaa can be any naturally occurring amino acid
  misc_feature (202)..(215): Xaa can be any naturally occurring amino acid
PPHXXXXXXXXGXXXXXXXXXXXXPXXXXXXXXXXXXXXXXXXXXRGEEGXXXXXXXXXXXXXXXXXXXXXXXXXXXXXXXXXXXXXXXXXXXXXXXXXXXXXXXXXXXXXXXXXXXRPTKGGGXXXXXXXXXXXXXXXXXXXXXXXXXXXXXXXXPPIXXXXXXXXXIIVXXXXXXXXXXXXXXXXXXXXXXXXXXGWWGXXXXXXXXXXXXXXGPRGGG

SEQ ID NO: 27738 - protein, 241 aa, Diabrotica virgifera
  misc_feature: Coding regions on vcDNA: vcDNA=SeqID_7435; Strand=+; Position=173-895
  misc_feature: Homolog annotation: Hit_ID=XP_397174.1; Match level="QueryCoverage =87%, HitCoverage=50%, E-value=9e-37, Identity=36%"; Hit description =similar to Gclm-prov protein [Apis mellifera]
  misc_feature: Gene Ontology Annotation: Biological process=cysteine metabolism
MAKNIDFTKLNKIIVNTGNLLSINDIIKKPNQNTSEELVEAINFTLKEFGNNGSLQLQPDQQVVISRPQDNLKISEHELSDLKIGFKVFLNTDDQVLLTEAIEKALSLLKVKAINDVIVTFKQKPSEDKKDDLNTIQSAWKVLEDLIETQQIKQIGIADVEENTFKSLYQWAKVKPSIIQINLATCCVVPPSLQTFCKEHDIKLLTHSDAVDILPAQSIQNIFDKPIAASMGLKVFNTCEM

SEQ ID NO: 27739 - protein, 76 aa, Diabrotica virgifera
  misc_feature: Coding regions on vcDNA: vcDNA=SeqID_7436; Strand=-; Position=1-228
  misc_feature (2)..(8): Xaa can be any naturally occurring amino acid
  misc_feature (10)..(20): Xaa can be any naturally occurring amino acid
  misc_feature (25)..(76): Xaa can be any naturally occurring amino acid
KXXXXXXXVXXXXXXXXXXXVITAXXXXXXXXXXXXXXXXXXXXXXXXXXXXXXXXXXXXXXXXXXXXXXXXXXXX

SEQ ID NO: 27740 - protein, 119 aa, Diabrotica virgifera
  misc_feature: Coding regions on vcDNA: vcDNA=SeqID_7437; Strand=+; Position=2-361
  misc_feature: Homolog annotation: Hit_ID=XP_311468.1; Match level="QueryCoverage =93%, HitCoverage=67%, E-value=1e-25, Identity=56%"; Hit description =ENSANGP00000013695 [Anopheles gambiae]
  misc_feature: Gene Ontology Annotation: Molecular function=receptor binding; Cellular component=cytoplasm; Biological process=response to nutrients
  misc_feature: Pfam annotation: Pfam_ID=Endosulfine; Match level="Score=90.9, E -value=3.3e-24, Copies=1"; Pfam description=cAMP-regulated phosphoprotein/endosulf
EQSPVESTQPNQLTPQELEKQEEAKLKAKFNIPSGGGPGLKASGHSAFLQKRLSKGQKFFDSGDYQMAKQKFGNISNKAGLQLPGPISFVGTGDAIPTPETVPIRKTSIVQPSKFTNIS

SEQ ID NO: 27741 - protein, 92 aa, Diabrotica virgifera
  misc_feature: Coding regions on vcDNA: vcDNA=SeqID_7438; Strand=+; Position=349-627
  misc_feature (6)..(47): Xaa can be any naturally occurring amino acid
QINSFXXXXXXXXXXXXXXXXXXXXXXXXXXXXXXXXXXXXXXXXXXKRTKFYNRGVETQNFFKRAPKINFRARFLKTREGENPGVPQFNPL

SEQ ID NO: 27742 - protein, 54 aa, Diabrotica virgifera
  misc_feature: Coding regions on vcDNA: vcDNA=SeqID_7439; Strand=-; Position=3-164
  misc_feature (11)..(18): Xaa can be any naturally occurring amino acid
  misc_feature (24)..(34): Xaa can be any naturally occurring amino acid
  misc_feature (41)..(53): Xaa can be any naturally occurring amino acid
KPTWSHTGLNXXXXXXXXSNRLNXXXXXXXXXXXSNIEVAXXXXXXXXXXXXXC

SEQ ID NO: 27743 - protein, 270 aa, Diabrotica virgifera
  misc_feature: Coding regions on vcDNA: vcDNA=SeqID_7440; Strand=-; Position=28-840
  misc_feature (15)..(58): Xaa can be any naturally occurring amino acid
  misc_feature (67)..(80): Xaa can be any naturally occurring amino acid
  misc_feature (85)..(111): Xaa can be any naturally occurring amino acid
  misc_feature (123)..(145): Xaa can be any naturally occurring amino acid
  misc_feature (155)..(176): Xaa can be any naturally occurring amino acid
  misc_feature (182)..(199): Xaa can be any naturally occurring amino acid
  misc_feature (202)..(218): Xaa can be any naturally occurring amino acid
  misc_feature (220)..(247): Xaa can be any naturally occurring amino acid
  misc_feature (259)..(270): Xaa can be any naturally occurring amino acid
GGVGGGEETPPPFYXXXXXXXXXXXXXXXXXXXXXXXXXXXXXXXXXXXXXXXXXXXXNNTPPQWVXXXXXXXXXXXXXXEVVVXXXXXXXXXXXXXXXXXXXXXXXXXXXTPPRFFLCGKKXXXXXXXXXXXXXXXXXXXXXXXEQTSFLKKPXXXXXXXXXXXXXXXXXXXXXXKEKGGXXXXXXXXXXXXXXXXXXFKXXXXXXXXXXXXXXXXXRXXXXXXXXXXXXXXXXXXXXXXXXXXXXHMFFFYRRGVFXXXXXXXXXXXX

SEQ ID NO: 27744 - protein, 242 aa, Diabrotica virgifera
  misc_feature: Coding regions on vcDNA: vcDNA=SeqID_7441; Strand=-; Position=190-918
  misc_feature: Homolog annotation: Hit_ID=AAT40504.1; Match level="QueryCoverage =98%, HitCoverage=28%, E-value=2e-66, Identity=51%"; Hit description =putative polyprotein [Solanum demissum]
  misc_feature (12)..(12): Xaa can be any naturally occurring amino acid
  misc_feature (18)..(20): Xaa can be any naturally occurring amino acid
  misc_feature (33)..(33): Xaa can be any naturally occurring amino acid
  misc_feature (44)..(44): Xaa can be any naturally occurring amino acid
  misc_feature (102)..(102): Xaa can be any naturally occurring amino acid
  misc_feature (142)..(142): Xaa can be any naturally occurring amino acid
DLDQKLEQWRQXLEEKGXXXSRTKTEYLECSLXDGVTTNKMVSXDGEMIVKSNSFKYLGSVLQSNGEIDGDACSRIRAGWMKWKEASGVLCDRKIPMKLKGXFYKTAIRPAVMHGTECWAVKKKEEQRMHVAEIRMLTWINXVTKKDKIRNEYIRGSLGVAPIDAKMREHRLRWFGHVQRRVVNHPIRKIAEVQIPGRSRRGRPEKTWEETIRQDMLVKGINIDMTQDRIVWRNAIREADPA

SEQ ID NO: 27745 - protein, 22 aa, Diabrotica virgifera
  misc_feature: Coding regions on vcDNA: vcDNA=SeqID_7442; Strand=-; Position=1-66
LKSSYLIFSGYKIAPPRRLSTG

SEQ ID NO: 27746 - protein, 77 aa, Diabrotica virgifera
  misc_feature: Coding regions on vcDNA: vcDNA=SeqID_7443; Strand=+; Position=52-285
STKTTLLKTKESDRMERNLSPTKYETISITTGSLSNPEWEKLISKGQKGQSKCALLPNHLHLDDQTTVQPSVRYTST

SEQ ID NO: 27747 - protein, 298 aa, Diabrotica virgifera
  misc_feature: Coding regions on vcDNA: vcDNA=SeqID_7444; Strand=+; Position=45-938
  misc_feature: Homolog annotation: Hit_ID=NP_651183.3; Match level="QueryCoverage =91%, HitCoverage=67%, E-value=3e-77, Identity=55%"; Hit description =CG10374-PC, isoform C [Drosophila melanogaster] gb|AAF56182.2| CG10374-PC, isoform C [Drosophila
  misc_feature: Pfam annotation: Pfam_ID=Perilipin; Match level="Score=134.1, E-value= 3.3e-37, Copies=1"; Pfam description=Perilipin family
  misc_feature (278)..(278): Xaa can be any naturally occurring amino acid
  misc_feature (285)..(285): Xaa can be any naturally occurring amino acid
  misc_feature (289)..(290): Xaa can be any naturally occurring amino acid
MPSIHKKKAFDINDLESVARISHIPIVESGWSYAEGVYMKIKRSNSLIHWTLDTAEQSAQSVYEAASPAMILLKGPLSSLDQIVCKSLDIVEQTVPSINLPPEMIYWNTKQYVQEVGTKIAQPVLKRADSVKQIGNSVLSSKYTAIAADTLDGALVVAEKYVDKYLPAQDDQASEEVSVPVTEDGPKGKAISTIHHADRFSRKLRRRLTQRTIAEVKALKHQSAEAVHVLTYVLELIATDPVLAYQKGKELWASLSQDEPENQARPENLEQLIVLLTXESARKSXHLIXXLSTLLSTL

SEQ ID NO: 27748 - protein, 142 aa, Diabrotica virgifera
  misc_feature: Coding regions on vcDNA: vcDNA=SeqID_7445; Strand=-; Position=139-567
  misc_feature (59)..(75): Xaa can be any naturally occurring amino acid
  misc_feature (96)..(113): Xaa can be any naturally occurring amino acid
RNEREYRFYKKLIVNNLISMPANLSYSISYTVACIFALKDSLFYSFMAKIIYILHLTGXXXXXXXXXXXXXXXXXKICIRWKPCRYLLTRVNLSLXXXXXXXXXXXXXXXXXXTYTYIYIILPLLTFQHAWNYSRITNMACS

SEQ ID NO: 27749 - protein, 60 aa, Diabrotica virgifera
  misc_feature: Coding regions on vcDNA: vcDNA=SeqID_7446; Strand=+; Position=213-395
YFFMAFLIFSYLNHFLSVASCYYCYMISEQQTLLLFMIYNSFPIYIGLLQHVFQEKRYNR

SEQ ID NO: 27750 - protein, 277 aa, Diabrotica virgifera
  misc_feature: Coding regions on vcDNA: vcDNA=SeqID_7447; Strand=+; Position=1-834
VAHTTVPGDVEVCVTAPTVVQTQVSRTVDLSSPTIENTDKQISQLCTNIHDALQAATNIDRTIEQTNRMFVTSLTETDRIISSKKHVSYLTDDSDNIEVSIIPSDQGMLRKPKDDQLKPNNESESINRKFVRSWVETEERTSSLPARKLVTSLIIDTPSNEKQQVQYSQIIAPTPFKITKQISQTSEPRSPTTPTRRIARPQVPPPPVPIAKLASPPQIQAKKIPPPVPAKISKLNPARSENDLLDPVGSVKKSNQSARPVSFVFSDKKDLGFVSGI

SEQ ID NO: 27751 - protein, 67 aa, Diabrotica virgifera
  misc_feature: Coding regions on vcDNA: vcDNA=SeqID_7448; Strand=-; Position=426-629
MFVYTIYFGDFTAFDLLSILGFNRELPHEECININSCIYTYIHIYTYIHIYTHIYTYIYSLWYLIKR

SEQ ID NO: 27752 - protein, 55 aa, Diabrotica virgifera
  misc_feature: Coding regions on vcDNA: vcDNA=SeqID_7449; Strand=+; Position=2-169
GSPWQASKTQKVRMCDYYDAIYHTSGQVRRRAWSTLTAQAQADTRPYHEMVKSYA

SEQ ID NO: 27753 - protein, 106 aa, Diabrotica virgifera
  misc_feature: Coding regions on vcDNA: vcDNA=SeqID_7450; Strand=+; Position=84-404
VAGNVRLIRALKVPRLPFLECLTTQKLPTTPSEGQTPQPQLCEKLKTPPAPNLPYSNLQGVNDQRVPEAEALADLVRRYDDMVHDQTFYSKLNTLPHLLLADLSTH

SEQ ID NO: 27754 - protein, 282 aa, Diabrotica virgifera
  misc_feature: Coding regions on vcDNA: vcDNA=SeqID_7451; Strand=+; Position=3-847
  misc_feature: Homolog annotation: Hit_ID=AAF87760.1; Match level="QueryCoverage =93%, HitCoverage=60%, E-value=8e-99, Identity=72%"; Hit description =cytochrome oxidase subunit I [Diabrotica virgifera zeae]
  misc_feature: Pfam annotation: Pfam_ID=COX1; Match level="Score=-85.3, E-value=2.5e- 08, Copies=1"; Pfam description=Cytochrome C and Quinol oxidase polyp
  misc_feature (6)..(12): Xaa can be any naturally occurring amino acid
  misc_feature (23)..(30): Xaa can be any naturally occurring amino acid
  misc_feature (51)..(51): Xaa can be any naturally occurring amino acid
  misc_feature (86)..(86): Xaa can be any naturally occurring amino acid
  misc_feature (103)..(103): Xaa can be any naturally occurring amino acid
  misc_feature (106)..(112): Xaa can be any naturally occurring amino acid
  misc_feature (139)..(145): Xaa can be any naturally occurring amino acid
  misc_feature (159)..(159): Xaa can be any naturally occurring amino acid
  misc_feature (167)..(183): Xaa can be any naturally occurring amino acid
  misc_feature (213)..(213): Xaa can be any naturally occurring amino acid
  misc_feature (229)..(236): Xaa can be any naturally occurring amino acid
  misc_feature (254)..(254): Xaa can be any naturally occurring amino acid
  misc_feature (257)..(257): Xaa can be any naturally occurring amino acid
DAWAEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFSFQRKRLRPLRITSXIDXLQFNPPAEHRYSELPILSSNLGNHT

SEQ ID NO: 27755 - protein, 111 aa, Diabrotica virgifera
  misc_feature: Coding regions on vcDNA: vcDNA=SeqID_7452; Strand=-; Position=3-335
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(107): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXGVIK

SEQ ID NO: 27756 - protein, 103 aa, Diabrotica virgifera
  misc_feature: Coding regions on vcDNA: vcDNA=SeqID_7453; Strand=+; Position=127-438
  misc_feature (10)..(17): Xaa can be any naturally occurring amino acid
  misc_feature (23)..(29): Xaa can be any naturally occurring amino acid
  misc_feature (31)..(42): Xaa can be any naturally occurring amino acid
  misc_feature (45)..(55): Xaa can be any naturally occurring amino acid
  misc_feature (63)..(72): Xaa can be any naturally occurring amino acid
  misc_feature (82)..(101): Xaa can be any naturally occurring amino acid
NLENFDLLIXXXXXXXXKCRKAXXXXXXXEXXXXXXXXXXXXILXXXXXXXXXXXLKFIYTQXXXXXXXXXXEHTKFLGMMXXXXXXXXXXXXXXXXXXXXVL

SEQ ID NO: 27757 - protein, 85 aa, Diabrotica virgifera
  misc_feature: Coding regions on vcDNA: vcDNA=SeqID_7454; Strand=+; Position=540-797
  misc_feature (37)..(47): Xaa can be any naturally occurring amino acid
NHFSPSGSFKNPQIAGDTRTRNITSRLQPNHLDCNDXXXXXXXXXXXTTPEPVAEPTAVPFDIKKLPSNQTPKAMHKYNPELFLA

SEQ ID NO: 27758 - protein, 99 aa, Diabrotica virgifera
  misc_feature: Coding regions on vcDNA: vcDNA=SeqID_7455; Strand=+; Position=332-631
  misc_feature (5)..(14): Xaa can be any naturally occurring amino acid
  misc_feature (17)..(30): Xaa can be any naturally occurring amino acid
  misc_feature (76)..(83): Xaa can be any naturally occurring amino acid
KLIIXXXXXXXXXXTLXXXXXXXXXXXXXXCILYIYAYDCGLLSSRYHVLVHNLVKKNRINDNFNGNVINNTMTMXXXXXXXXTVPSKFNSESMVAEVG

SEQ ID NO: 27759 - protein, 128 aa, Diabrotica virgifera
  misc_feature: Coding regions on vcDNA: vcDNA=SeqID_7456; Strand=+; Position=2-388
  misc_feature: Homolog annotation: Hit_ID=XP_392640.1; Match level="QueryCoverage =100%, HitCoverage=50%, E-value=2e-55, Identity=82%"; Hit description= similar to Probable dolichol-phosphate mannosyltransferase (Dolichol -phosphate
  misc_feature: Gene Ontology Annotation: Molecular function=dolichyl-phosphate beta -D-mannosyltransferase activity; Biological process=protein amino acid glycosylation
EKQQSQDYDVVSGTRYIGDGGVSGWDFKRKLVSRGANFLTQLLLRPGASDLTGSFRLYKKDVLEKLINSCVSKGYVFQMEMIVRARELNYSVGEVPITFVDRVYGESKLGGSEIVQFVRALLYLFATT

SEQ ID NO: 27760 - protein, 295 aa, Diabrotica virgifera
  misc_feature: Coding regions on vcDNA: vcDNA=SeqID_7457; Strand=+; Position=63-946
  misc_feature: Homolog annotation: Hit_ID=NP_477121.1; Match level="QueryCoverage =98%, HitCoverage=34%, E-value=1e-102, Identity=63%"; Hit description= CG7538-PA [Drosophila melanogaster] gb|AAF54207.1| CG7538-PA [Drosophila melanogaster]
  misc_feature: Gene Ontology Annotation: Molecular function=DNA binding; Cellular component=nucleus; Biological process=DNA replication
  misc_feature (266)..(266): Xaa can be any naturally occurring amino acid
  misc_feature (275)..(275): Xaa can be any naturally occurring amino acid
  misc_feature (284)..(284): Xaa can be any naturally occurring amino acid
  misc_feature (286)..(286): Xaa can be any naturally occurring amino acid
MSDRPEESPMPTPRSNVSSPGPDLAPFEDEGALLGDINSDIEEEDGEELFGDNMENDYRAMPHLDRYDDRVLDEDDYDQMSVGERLAAEEELRRRDRELGIIRRDDRELFYDQDDDEEDPRQRRRKEAEKAAAGEEADAEMIESIENLEDTKGYTIKEWVVMIGPRTEIANRFKNFLRTCTNSKGQYVYKDKIRRMCENNQSSFNVEFPSLAHKEHVLAYFLPEAPFQMIEVFDEVAKDIVLSMYPSYDRVTNEIHVRISDLPLIXELRTFRKLXCNQLVRTLXVXTATTGVYPT

SEQ ID NO: 27761 - protein, 321 aa, Diabrotica virgifera
  misc_feature: Coding regions on vcDNA: vcDNA=SeqID_7458; Strand=+; Position=1-963
  misc_feature: Homolog annotation: Hit_ID=XP_316463.1; Match level="QueryCoverage =92%, HitCoverage=24%, E-value=7e-68, Identity=44%"; Hit description =ENSANGP00000004277 [Anopheles gambiae]
  misc_feature: Gene Ontology Annotation: Molecular function=15-hydroxyprostaglandin dehydrogenase (NAD+) activity; Cellular component=cellular_component unknown; Biological process=biological_process unknown
  misc_feature: Pfam annotation: Pfam_ID=ABC_tran; Match level="Score=83.5, E-value =5.7e-22, Copies=1"; Pfam description=ABC transporter
  misc_feature (188)..(193): Xaa can be any naturally occurring amino acid
  misc_feature (207)..(214): Xaa can be any naturally occurring amino acid
  misc_feature (239)..(245): Xaa can be any naturally occurring amino acid
  misc_feature (256)..(262): Xaa can be any naturally occurring amino acid
  misc_feature (288)..(288): Xaa can be any naturally occurring amino acid
KQDLQELTGSDKGSIHIKKASAKWLKSQYENNLENIDMDVAAGSVAAVVGSVGSGKTTLLHIIMKELELESGYVNVTGKISYASQEPWLFGGSIRQNILFGETYDQLKYNEVVRVCALERDFTLFPYGDRTLAGERGVTLSGGQRARINLARAVYKDADIYLLDDPLSAVDTHVGKHIFEECICEYLXXXXXXLVTHQLQYLKSIQXXXXXXXXQIAVSGSYNNIKDSNTHYSELLHDXXXXXXXIRRKSKVVQTXXXXXXXEAGPVLQREGKSTGIISGRVYRQYAXAGGHIFKAFSILFLLILSQAFKRMSILVLSGSY

SEQ ID NO: 27762 - protein, 24 aa, Diabrotica virgifera
  misc_feature: Coding regions on vcDNA: vcDNA=SeqID_7459; Strand=-; Position=1-72
  misc_feature (3)..(22): Xaa can be any naturally occurring amino acid
SPXXXXXXXXXXXXXXXXXXXXIN

SEQ ID NO: 27763 - protein, 121 aa, Diabrotica virgifera
  misc_feature: Coding regions on vcDNA: vcDNA=SeqID_7460; Strand=+; Position=3-368
  misc_feature: Homolog annotation: Hit_ID=AAH22792.1; Match level="QueryCoverage =95%, HitCoverage=12%, E-value=5e-17, Identity=39%"; Hit description =VprBP protein [Homo sapiens]
  misc_feature: Gene Ontology Annotation: Molecular function=protein binding; Cellular component=nucleolus; Biological process=G1/S transition of mitotic cell cycle
TTFDVKKSIYDLACDNFDTQIAVVENQGLYNSVQESAVRVYDVGRRRDDEDEQEEDEEDSMEGSDDSENDDGDGDNNDNDDNNDDDDGDDNDNDSDAESWTSLSSGGSGDNLDFGALLASL

SEQ ID NO: 27764 - protein, 28 aa, Diabrotica virgifera
  misc_feature: Coding regions on vcDNA: vcDNA=SeqID_7461; Strand=+; Position=1-84
  misc_feature (1)..(1): Xaa can be any naturally occurring amino acid
XLLSLVAFSAALQHFLVERSGQRDGLVL

SEQ ID NO: 27765 - protein, 112 aa, Diabrotica virgifera
  misc_feature: Coding regions on vcDNA: vcDNA=SeqID_7462; Strand=-; Position=32-370
ESGKATIHMISSTLHQFLFEQQYDAGHKIPSSTISTPLKHSQIAIWGKCSNSNQGCTSLLDPGDSLQLTSQGGGVPFLFSLVGPALGKKLIPFSDMVVFYHNVHLSVEASDG

SEQ ID NO: 27766 - protein, 261 aa, Diabrotica virgifera
  misc_feature: Coding regions on vcDNA: vcDNA=SeqID_7463; Strand=+; Position=57-842
  misc_feature: Homolog annotation: Hit_ID=EAA09122.3; Match level="QueryCoverage =97%, HitCoverage=84%, E-value=5e-51, Identity=41%"; Hit description =ENSANGP00000011678 [Anopheles gambiae str. PEST] ref|XP_562245.1| ENSANGP00000011678 [Anopheles gambiae st
  misc_feature: Pfam annotation: Pfam_ID=ACBP; Match level="Score=144.0, E-value=3.4e- 40, Copies=1"; Pfam description=Acyl CoA binding protein
MTTEQKFNAAVNVIRSLPKNGSYQPSNELMLRFYAYFKQATNGTCTGSRPAFWDLVGRAKYDAWKSLGDMPKQEAMTKYVDELHSIVETMSYSDKVANFLEAPTNELDAINFDDLELIAGDVIERVRSQPNSPLASREGSPIRFGSKSPSVGSTPSVAPSTPDDSDHSDDEYIDTIENPDPPRMNISHDGIPNGYIQTPQNQHISRSKIKSTTNVDVSQEISLAVQSLRADIENISKKVNSLENANRLVAKRQKRLFPRSP

SEQ ID NO: 27767 - protein, 56 aa, Diabrotica virgifera
  misc_feature: Coding regions on vcDNA: vcDNA=SeqID_7464; Strand=+; Position=34-204
RTYQQRALEIIHRSYLLRLYESIIYISMCTFANLISHDPLKSSIIFTPKDLATISA

SEQ ID NO: 27768 - protein, 187 aa, Diabrotica virgifera
  misc_feature: Coding regions on vcDNA: vcDNA=SeqID_7465; Strand=+; Position=3-565
  misc_feature: Homolog annotation: Hit_ID=A32713; Match level="QueryCoverage=99%, HitCoverage=21%, E-value=2e-47, Identity=52%"; Hit description =reverse transcriptase homolog - fruit fly (Drosophila melanogaster)
  misc_feature: Pfam annotation: Pfam_ID=RVT_1; Match level="Score=20.5, E-value=6.5e- 06, Copies=1"; Pfam description=Reverse transcriptase (RNA-dependent D
  misc_feature (60)..(60): Xaa can be any naturally occurring amino acid
  misc_feature (133)..(133): Xaa can be any naturally occurring amino acid
  misc_feature (164)..(164): Xaa can be any naturally occurring amino acid
IEQVHRVVKQISNDLEKKRYCSAAFIDISQAFDKVWHPGLLYKIKKGLPYNFYSLLKSYXNRFFLVKQQSEYTNIYHIQSGVPQGSTLGPILYLLYTADIPTTEQTTVSTFADDTAILASHHNPAGATRNLQXLNKIGVWLKKWKIKANESKSIHVTFTMKKKXCPPVKLNNSQLAQADSVKYLVVM

SEQ ID NO: 27769 - protein, 292 aa, Diabrotica virgifera
  misc_feature: Coding regions on vcDNA: vcDNA=SeqID_7466; Strand=+; Position=1-876
  misc_feature: Homolog annotation: Hit_ID=NP_732976.1; Match level="QueryCoverage =98%, HitCoverage=23%, E-value=7e-80, Identity=54%"; Hit description =CG5695-PB, isoform B [Drosophila melanogaster] gb|AAN13992.1| CG5695- PB, isoform B [Drosophila
  misc_feature: Gene Ontology Annotation: Molecular function=molecular_function unknown; Cellular component=cellular_component unknown; Biological process=N-linked glycosylation
  misc_feature: Pfam annotation: Pfam_ID=E-MAP-115; Match level="Score=-85.5, E-value= 0.095, Copies=1"; Pfam description=E-MAP-115 family
NTLRNIKKLNSTLAQIEQSAQQLKKDKDSVRNDINNLKTQFDAAIDRIKKDDKIDKATAENLYKSLSDKVNLQMAALQKKIQEQKIADEQERLRKLQEEMERQRKLKEEEERRLREEEENRRLKAEMEARRKIEEEERRKQEEADRLLAKKLQEQHAKDEEEQRRLQEQEDQEKQDRELALRLAQESNGSIEESPPMIRNGVIEPDKIYKLNRSEAHRNHQATLANSKYDLSKWKYSELRDTINTSCDIDLLEACRHEFHRRLKVYHAWKAKNRKRTIMDENERAPRSVMES

SEQ ID NO: 27770 - protein, 81 aa, Diabrotica virgifera
  misc_feature: Coding regions on vcDNA: vcDNA=SeqID_7467; Strand=+; Position=198-443
EIMHEDRDHHPCHHRRIMDGERKTPGRRVLHSVAEALSDSVTATVVSMVYKNEVATFHRRFASITSAMHLILNYGITEVDL

SEQ ID NO: 27771 - protein, 108 aa, Diabrotica virgifera
  misc_feature: Coding regions on vcDNA: vcDNA=SeqID_7468; Strand=-; Position=36-362
YSASGKGVCFLSAVDLLLYHLTGSFCLHCIGLDRVAFLCLCCYSVCPPIGPYLFFYKDLLRKWNPVLATGSLTSLSGIVSSRVSPLFACFSVHARRQPVAVGVIKSVA

SEQ ID NO: 27772 - protein, 69 aa, Diabrotica virgifera
  misc_feature: Coding regions on vcDNA: vcDNA=SeqID_7469; Strand=+; Position=12-221
  misc_feature (6)..(6): Xaa can be any naturally occurring amino acid
  misc_feature (16)..(16): Xaa can be any naturally occurring amino acid
  misc_feature (18)..(31): Xaa can be any naturally occurring amino acid
  misc_feature (35)..(35): Xaa can be any naturally occurring amino acid
  misc_feature (41)..(41): Xaa can be any naturally occurring amino acid
  misc_feature (48)..(48): Xaa can be any naturally occurring amino acid
  misc_feature (54)..(54): Xaa can be any naturally occurring amino acid
  misc_feature (67)..(67): Xaa can be any naturally occurring amino acid
FYWRVXIDNKDCDLDXGXXXXXXXXXXXXXXVDFXILHDLXLTGVSQXGSIFIXYIFSTKDQYINNXLY

SEQ ID NO: 27773 - protein, 239 aa, Diabrotica virgifera
  misc_feature: Coding regions on vcDNA: vcDNA=SeqID_7470; Strand=+; Position=146-862
  misc_feature: Homolog annotation: Hit_ID=XP_394003.1; Match level="QueryCoverage =100%, HitCoverage=38%, E-value=4e-72, Identity=56%"; Hit description= similar to ENSANGP00000011815 [Apis mellifera]
  misc_feature: Gene Ontology Annotation: Molecular function=protein binding; Cellular component=SCF ubiquitin ligase complex; Biological process =apoptosis
  misc_feature: Pfam annotation: Pfam_ID=Cullin; Match level="Score=-31.2, E-value =1.6e-05, Copies=1"; Pfam description=Cullin family
MSLKPRRVDFNATWGAIRETINGVITLNHVARPVWNDRFSDVYSICVAHPEPMADRLYAETKQYLIDHVAKLLNKVQEEGEQNLIKNYFLYWSQYSVGSQYLHSLYLYLNQQHIKTQKLSDAEIIYGSPDSTGGEQMEIGELALEIWQSGMIAPLGLRLVKLLLEAIDQDRAKQTLTVPIEAVKGTILSFVEVQGYRKKAPLQLYQELFEEEFLDASGEHFKRDAARLLQEKDVSLYME

SEQ ID NO: 27774 - protein, 60 aa, Diabrotica virgifera
  misc_feature: Coding regions on vcDNA: vcDNA=SeqID_7471; Strand=+; Position=717-896
  misc_feature (33)..(40): Xaa can be any naturally occurring amino acid
LSSVICHLPYAYILRPIYVALKRSSVVLPYIPXXXXXXXXQLRHFFSLLNDEHAISLCIY

SEQ ID NO: 27775 - protein, 136 aa, Diabrotica virgifera
  misc_feature: Coding regions on vcDNA: vcDNA=SeqID_7472; Strand=+; Position=3-413
  misc_feature (1)..(11): Xaa can be any naturally occurring amino acid
  misc_feature (14)..(23): Xaa can be any naturally occurring amino acid
  misc_feature (26)..(33): Xaa can be any naturally occurring amino acid
  misc_feature (43)..(49): Xaa can be any naturally occurring amino acid
  misc_feature (65)..(71): Xaa can be any naturally occurring amino acid
  misc_feature (75)..(90): Xaa can be any naturally occurring amino acid
  misc_feature (102)..(109): Xaa can be any naturally occurring amino acid
  misc_feature (117)..(127): Xaa can be any naturally occurring amino acid
XXXXXXXXXXXPTXXXXXXXXXXKSXXXXXXXXDPSGPPGGPXXXXXXXPGANKKGEKKEGEGGXXXXXXXGKGXXXXXXXXXXXXXXXXEGGYPPRKFFLXXXXXXXXPGRGLLKXXXXXXXXXXXGKILPALGV

SEQ ID NO: 27776 - protein, 255 aa, Diabrotica virgifera
  misc_feature: Coding regions on vcDNA: vcDNA=SeqID_7473; Strand=+; Position=121-884
  misc_feature: Homolog annotation: Hit_ID=NP_730282.1; Match level="QueryCoverage =81%, HitCoverage=24%, E-value=6e-55, Identity=54%"; Hit description =CG7555-PC, isoform C [Drosophila melanogaster] gb|AAN11694.1| CG7555- PC, isoform C [Drosophila
  misc_feature: Gene Ontology Annotation: Molecular function=protein binding; Cellular component=ubiquitin ligase complex; Biological process =protein amino acid phosphorylation
  misc_feature: Pfam annotation: Pfam_ID=C2; Match level="Score=115.6, E-value=1.2e -31, Copies=1"; Pfam description=C2 domain
  misc_feature (234)..(234): Xaa can be any naturally occurring amino acid
  misc_feature (249)..(249): Xaa can be any naturally occurring amino acid
MPSRKNINEQASSSGYISRQRSNTWSNNEANSRAASTSVPSYDLGARGPRRSLWISEEPTSKLRLRVICAKNLMKKDIFGASDPYVRIDLNSVNGDETIDSVLTKTKKRTLSPEWNEEFIFRVKPGEHKLVLQVFDENRLTRDDFLGMVELPLLNLPKEQPERNIPPVKYLLQPRSDFSARSRVRGHLELYHAFLFDSNLPPIAAPEEPSDERDWEIVHEGREEEAAQPLYITXTTDSQPSPLPSGWEXRQDANG

SEQ ID NO: 27777 - protein, 220 aa, Diabrotica virgifera
  misc_feature: Coding regions on vcDNA: vcDNA=SeqID_7474; Strand=+; Position=162-820
  misc_feature: Homolog annotation: Hit_ID=NP_572427.1; Match level="QueryCoverage =84%, HitCoverage=28%, E-value=4e-14, Identity=25%"; Hit description =CG2206-PA, isoform A [Drosophila melanogaster] gb|AAF46301.1| CG2206- PA, isoform A [Drosophila
  misc_feature (194)..(194): Xaa can be any naturally occurring amino acid
MSHLRYFFILVVISGFFVPKSDPFEITLVGAVSIIKIAGEVVGGIAKAWNIVDQNVDFSHLPLPLLDKTEEKLFGKINVISQKLDELAVNLEGVGTSTITVVLNNLPDRVRLELRLNDLLKYMTSTDVNFKSFLRYADRTKDFERLTLEDFARMVVSHDSNSVVSILERIHAFIVPSGIGISDTGILELLRRIXMEVEGDMLCNSRQSPQQVIYKLYNAI

SEQ ID NO: 27778 - protein, 118 aa, Diabrotica virgifera
  misc_feature: Coding regions on vcDNA: vcDNA=SeqID_7475; Strand=-; Position=2-352
  misc_feature: Homolog annotation: Hit_ID=DAA00890.1; Match level="QueryCoverage =77%, HitCoverage=11%, E-value=8e-10, Identity=35%"; Hit description =TPA: reverse transcriptase [Schistosoma mansoni]
  misc_feature (41)..(41): Xaa can be any naturally occurring amino acid
  misc_feature (46)..(46): Xaa can be any naturally occurring amino acid
WETSHNFTFWRPKLLRPILSKTKPNSEQERTNNCIYNILCXNANKXYLGETSRPLNVRISEHQSYIKNREFDRSQICQHAWDNEHRVQWRDSSIVLKEDSKKRKIKEAALIMLNETNY

SEQ ID NO: 27779 - protein, 59 aa, Diabrotica virgifera
  misc_feature: Coding regions on vcDNA: vcDNA=SeqID_7476; Strand=-; Position=67-246
FQRSRISRPFTCSSSEAIAVGYLLPSCYSTRWLSTFSSIRWLFCIAVIRDQIRRCHSHR

SEQ ID NO: 27780 - protein, 43 aa, Diabrotica virgifera
  misc_feature: Coding regions on vcDNA: vcDNA=SeqID_7477; Strand=-; Position=12-143
FPGAPIPGNNLPPPKTQTFTMLLIIGKKVLWGRKTHKGFFPSV

SEQ ID NO: 27781 - protein, 130 aa, Diabrotica virgifera
  misc_feature: Coding regions on vcDNA: vcDNA=SeqID_7478; Strand=+; Position=276-668
  misc_feature: Homolog annotation: Hit_ID=XP_314956.1; Match level="QueryCoverage =100%, HitCoverage=57%, E-value=1e-29, Identity=52%"; Hit description= ENSANGP00000019325 [Anopheles gambiae]
  misc_feature (57)..(57): Xaa can be any naturally occurring amino acid
  misc_feature (75)..(75): Xaa can be any naturally occurring amino acid
  misc_feature (99)..(99): Xaa can be any naturally occurring amino acid
  misc_feature (115)..(115): Xaa can be any naturally occurring amino acid
GNNDMCEREKRKVRIPPYVRYVEEGAGNVIPGILTLIFELQRINMSDAEPATDNVYXEIDSNNHNQLSREELRDXLKQQRAAVDDGDVPSEEKNNMVVXHDKLAEQIFYLEHHDXNGYVSCGEFTGRKHD

SEQ ID NO: 27782 - protein, 56 aa, Diabrotica virgifera
  misc_feature: Coding regions on vcDNA: vcDNA=SeqID_7479; Strand=+; Position=2-169
KEGDKCIPPSSCKNCECDLLPHVSYVTYDDNEFTINGNCVYVMSRDQVPLVGQETS

SEQ ID NO: 27783 - protein, 179 aa, Diabrotica virgifera
  misc_feature: Coding regions on vcDNA: vcDNA=SeqID_7480; Strand=-; Position=157-696
MQHCGEDDNWRRGEITINETYLETATKDSASARLVQGDNVQNRYSLLAANGDLSITAGDLLNQGAGTRTGQRKLVINTPGHVNDHVWEGMEYIDVPAFNAATAAGNFDKARFEELKNRSPNVRPFSYTSDVTTWTDNGGPGYAATMQAGGTVNLNVARTLQNGTLHNNTLARVDWHAWR

SEQ ID NO: 27784 - protein, 146 aa, Diabrotica virgifera
  misc_feature: Coding regions on vcDNA: vcDNA=SeqID_7481; Strand=-; Position=406-846
  misc_feature (14)..(20): Xaa can be any naturally occurring amino acid
  misc_feature (22)..(29): Xaa can be any naturally occurring amino acid
  misc_feature (73)..(79): Xaa can be any naturally occurring amino acid
LKAKSPHTLSTFVXXXXXXXKXXXXXXXXTARFLIVSIVKNTVTRQYSMTCRQKMNSQITLKFHTSSYEESTXXXXXXXVGNNALSYRSAKLIEQPSNKIHQKPRNIISYFHWCDFINILYAIIFTWSTFLKKETVPLDVAQFIVQ

SEQ ID NO: 27785 - protein, 143 aa, Diabrotica virgifera
  misc_feature: Coding regions on vcDNA: vcDNA=SeqID_7482; Strand=-; Position=439-871
  misc_feature: Homolog annotation: Hit_ID=XP_309915.1; Match level="QueryCoverage =60%, HitCoverage=17%, E-value=3e-14, Identity=41%"; Hit description =ENSANGP00000015117 [Anopheles gambiae]
  misc_feature (49)..(49): Xaa can be any naturally occurring amino acid
  misc_feature (73)..(73): Xaa can be any naturally occurring amino acid
FFSWKRLVIGLFILNCVLYPYLKGTHHFRGHPVYKTLIRPVLIYGAVTXILFQNNERVLGLFYKKILTIERFXGLNENGLWRRRYNFELYQLYNDPDIVKFVKEQRLRWAGHIARMSDQEEIRARSHDRRLTLDLRRLTRDLK

SEQ ID NO: 27786 - protein, 67 aa, Diabrotica virgifera
  misc_feature: Coding regions on vcDNA: vcDNA=SeqID_7483; Strand=+; Position=101-301
TRRTTRRGRGIYHPTQDIPREKQLTQQKSKITPLVDRADKTLGGCGRSVRTPLPKKLGRGDVSEIVP

SEQ ID NO: 27787 - protein, 68 aa, Diabrotica virgifera
  misc_feature: Coding regions on vcDNA: vcDNA=SeqID_7484; Strand=-; Position=2-205
RNVSRHHHLVVRILDFIMRFCICNRIPRLVLNAPQHDKDYAGSKVNASAEYKRISPSPEGGVARGIPP

SEQ ID NO: 27788 - protein, 19 aa, Diabrotica virgifera
  misc_feature: Coding regions on vcDNA: vcDNA=SeqID_7485; Strand=-; Position=0-56
  misc_feature (3)..(13): Xaa can be any naturally occurring amino acid
PFXXXXXXXXXXXTNLAHT

SEQ ID NO: 27789 - protein, 291 aa, Diabrotica virgifera
  misc_feature: Coding regions on vcDNA: vcDNA=SeqID_7486; Strand=+; Position=5-880
  misc_feature: Homolog annotation: Hit_ID=XP_526619.1; Match level="QueryCoverage =67%, HitCoverage=14%, E-value=1e-18, Identity=32%"; Hit description =PREDICTED: similar to 2-aminoadipic 6-semialdehyde dehydrogenase [Pan troglodytes]
  misc_feature: Gene Ontology Annotation: Molecular function=molecular_function unknown; Cellular component=mitochondrion
MLIKNITNLKTSDKTAILLCSTNKILDIKTYKEIYEISKKIFQTMEQFLKNTTVNCVGLLMDKNVYLPSIIISYTRKCYINDEPRDSTLPIFRASGDLALLKNGKLYYKGRKNNVIKRFGHKINLAQIEETIFETFGLESRCVWSQQHKKILAFIVIKENHNIDVKERILDKLRSKLIHALPENSFPDYFDIIQQLPITSHGKVDTNKLETFYTISTNVPNGNVLHIFINLWCKYLGVSNGDTDYLNNYTFFEMGGNSISLMQLIEEFRTLTNNQYTDEIIAIIFEKLQIA

SEQ ID NO: 27790 - protein, 77 aa, Diabrotica virgifera
  misc_feature: Coding regions on vcDNA: vcDNA=SeqID_7487; Strand=-; Position=91-324
REAYTVATTPSIKLFAPKTLSLCSWPLLELVVLLPLRTSEILITNSRVRHLPLRIRYHFVILLNNMLYICLDLPFPY

SEQ ID NO: 27791 - protein, 126 aa, Diabrotica virgifera
  misc_feature: Coding regions on vcDNA: vcDNA=SeqID_7488; Strand=-; Position=1-378
HHPILCRLENICYRSNPHTLILNAGVDLVICVLITYFECPPVYILSTLSTAPASAISSLPSSCTSYGITSKIVVVFSITEARFFFIRRSYHYSCGLVVAWIFFCYGMVHPYMNASTRTFARGAWGP

SEQ ID NO: 27792 - protein, 17 aa, Diabrotica virgifera
  misc_feature: Coding regions on vcDNA: vcDNA=SeqID_7489; Strand=+; Position=1-51
  misc_feature (9)..(9): Xaa can be any naturally occurring amino acid
IHCYFRHTXNSSWTGYL

SEQ ID NO: 27793 - protein, 246 aa, Diabrotica virgifera
  misc_feature: Coding regions on vcDNA: vcDNA=SeqID_7490; Strand=+; Position=1-741
  misc_feature: Homolog annotation: Hit_ID=XP_472448.1; Match level="QueryCoverage =63%, HitCoverage=44%, E-value=3e-11, Identity=32%"; Hit description =OSJNBb0108J11.9 [Oryza sativa (japonica cultivar-group)] emb|CAE02917.3| OSJNBb0108J11.9 [Oryza
QGLQGLQSLRELRGFQGVHAALALVPIDSTYSQQPHVPTESTQSHLPPVPSDTHDPHEHPTHPYHYFNYVDPADAAYAPPSDPYETAQTPPPSTPYEPTPSNAYAVPVLPREAPNASKPYEEHEEPEPPPQRPPREPPKIYPPYPIYKTHEEREEPEYPVYKKEKVEAIATAYTPYPPAPPHLVQLQIPLLILLQVAGVHEDHTPCTPCDRAAAVQAVKVANYAYYVYGPYEDYGRLQGLLNVLSV

SEQ ID NO: 27794 - protein, 67 aa, Diabrotica virgifera
  misc_feature: Coding regions on vcDNA: vcDNA=SeqID_7491; Strand=-; Position=345-548
  misc_feature (7)..(16): Xaa can be any naturally occurring amino acid
IIGVHNXXXXXXXXXXKQSFFGYKTKKFVYKSIMSFKHYNSFFTTKKRLRHSRFLTSEPHNVAKTFE

SEQ ID NO: 27795 - protein, 54 aa, Diabrotica virgifera
  misc_feature: Coding regions on vcDNA: vcDNA=SeqID_7492; Strand=+; Position=1-162
  misc_feature (31)..(50): Xaa can be any naturally occurring amino acid
FPPRSRRFIHQVSFDQEHLLSFQTEAMGRKXXXXXXXXXXXXXXXXXXXXWRYT

SEQ ID NO: 27796 - protein, 159 aa, Diabrotica virgifera
  misc_feature: Coding regions on vcDNA: vcDNA=SeqID_7493; Strand=-; Position=0-476
  misc_feature (8)..(78): Xaa can be any naturally occurring amino acid
  misc_feature (88)..(132): Xaa can be any naturally occurring amino acid
  misc_feature (136)..(148): Xaa can be any naturally occurring amino acid
KTPSLFFXXXXXXXXXXXXXXXXXXXXXXXXXXXXXXXXXXXXXXXXXXXXXXXXXXXXXXXXXXXXXXXXXXXXXXXPPPTKKEEKXXXXXXXXXXXXXXXXXXXXXXXXXXXXXXXXXXXXXXXXXXXXXPPQXXXXXXXXXXXXXGGEKKNPAVCV

SEQ ID NO: 27797 - protein, 62 aa, Diabrotica virgifera
  misc_feature: Coding regions on vcDNA: vcDNA=SeqID_7494; Strand=-; Position=64-252
PLGDSGGGSLYGNGENTISALSLRVITAHSCVKCEDVAPTLVSSRCLHSPVYPSSHTLVVPS

SEQ ID NO: 27798 - protein, 190 aa, Diabrotica virgifera
  misc_feature: Coding regions on vcDNA: vcDNA=SeqID_7495; Strand=-; Position=0-569
  misc_feature (2)..(13): Xaa can be any naturally occurring amino acid
  misc_feature (22)..(35): Xaa can be any naturally occurring amino acid
  misc_feature (46)..(70): Xaa can be any naturally occurring amino acid
  misc_feature (72)..(104): Xaa can be any naturally occurring amino acid
  misc_feature (107)..(189): Xaa can be any naturally occurring amino acid
GXXXXXXXXXXXXVGGGVDKRXXXXXXXXXXXXXXGRWGVGARPPXXXXXXXXXXXXXXXXXXXXXXXXXSXXXXXXXXXXXXXXXXXXXXXXXXXXXXXXXXXFGXXXXXXXXXXXXXXXXXXXXXXXXXXXXXXXXXXXXXXXXXXXXXXXXXXXXXXXXXXXXXXXXXXXXXXXXXXXXXXXXXXXP

SEQ ID NO: 27799 - protein, 207 aa, Diabrotica virgifera
  misc_feature: Coding regions on vcDNA: vcDNA=SeqID_7496; Strand=-; Position=1-621
  misc_feature: Homolog annotation: Hit_ID=ZP_00262762.1; Match level="QueryCoverage =99%, HitCoverage=52%, E-value=3e-46, Identity=50%"; Hit description =hypothetical protein Pflu02005016 [Pseudomonas fluorescens PfO-1]
  misc_feature: Gene Ontology Annotation: Cellular component=extracellular space
MKRIWRLAGVGLLMVTVGAQVMADEQPRPEGGGQHEKGPEGHPGNNQPRPQNNQPRPQNNQPRPEAPRPENNQPRPQNPHFENNQPRPQNEHFERPNGGGQWQGRPQGNQEQPPHPAPQPANNLPIQGRPDTVRQTQEPRPGNYQDIPRRNDGNQHWQAGNGGQGGPGRPGFNGGGNNHPNDHRWPGRPDGHGNGWGPGPQYRPGYI

SEQ ID NO: 27800 - protein, 17 aa, Diabrotica virgifera
  misc_feature: Coding regions on vcDNA: vcDNA=SeqID_7497; Strand=-; Position=1-51
  misc_feature (16)..(16): Xaa can be any naturally occurring amino acid
HNYRFIVFIEYKIKCXY

SEQ ID NO: 27801 - protein, 95 aa, Diabrotica virgifera
  misc_feature: Coding regions on vcDNA: vcDNA=SeqID_7498; Strand=+; Position=2-292
  misc_feature: Homolog annotation: Hit_ID=CAA75108.1; Match level="QueryCoverage =98%, HitCoverage=59%, E-value=8e-14, Identity=46%"; Hit description =beta-galactosidase [Phagemid cloning vector pTZ19U]
  misc_feature (21)..(21): Xaa can be any naturally occurring amino acid
  misc_feature (33)..(33): Xaa can be any naturally occurring amino acid
  misc_feature (51)..(51): Xaa can be any naturally occurring amino acid
TPTGKPLSAGPPRNDGENPGXTQLRRRAAHTAXTRRRNTEKDRTDRPTQQXRHQNGQRDAPGSGAKNAEDALPTRKGTRTQDRGRPPAPNTHHPS

SEQ ID NO: 27802 - protein, 149 aa, Diabrotica virgifera
  misc_feature: Coding regions on vcDNA: vcDNA=SeqID_7499; Strand=+; Position=104-553
  misc_feature: Homolog annotation: Hit_ID=EAL26216.1; Match level="QueryCoverage =99%, HitCoverage=98%, E-value=3e-11, Identity=32%"; Hit description =GA14562-PA [Drosophila pseudoobscura]
MDVFMPIALCVIFIILFTICGWCCKRKREGTVYGYGPSVTVTTTTQHAQSPQVVPPYPIDTRHPVPASNITGYGNQAPYQQYPFHPTGNVASPMAGATPYPPQPYQQAAHDYSANPPPYDVAVSQPPLQPPPNSKEGYVKQSPYNPGYN

SEQ ID NO: 27803 - protein, 76 aa, Diabrotica virgifera
  misc_feature: Coding regions on vcDNA: vcDNA=SeqID_7500; Strand=-; Position=576-806
ASLVFAEIFHQLLFLLNFLRLFSCKLRQTTSRGYDLILIQLSYFHIPVFSQKCFAGFFSTCPPFYCIFGQHLKRSR

SEQ ID NO: 27804 - protein, 204 aa, Diabrotica virgifera
  misc_feature: Coding regions on vcDNA: vcDNA=SeqID_7501; Strand=-; Position=1-612
  misc_feature: Homolog annotation: Hit_ID=AAO58703.1; Match level="QueryCoverage =100%, HitCoverage=50%, E-value=5e-92, Identity=81%"; Hit description= imidazolonepropionase [Pseudomonas syringae pv. tomato str. DC3000] ref|NP_795008.1| imidazolonepropionas
MKTLWQHCHVATMAQGKYSIIEDAAIVTSGTLIEWIGPRAELPKADYATTHDLQGAWVTPGLIDCHTHTVFGGNRSGEFEQRLEGVSYAEIAAAGGGIASTVRATRAATEDELFESSRKRLRSLLRDGVTTVEIKSGYGLDLASERKILRVIRRLGTELPVSVRSTCLAAHALPPEYVDRADAYIAHICAEMLPALAAEGLVDA

SEQ ID NO: 27805 - protein, 320 aa, Diabrotica virgifera
  misc_feature: Coding regions on vcDNA: vcDNA=SeqID_7502; Strand=+; Position=2-961
  misc_feature (4)..(15): Xaa can be any naturally occurring amino acid
  misc_feature (31)..(45): Xaa can be any naturally occurring amino acid
  misc_feature (48)..(54): Xaa can be any naturally occurring amino acid
  misc_feature (73)..(81): Xaa can be any naturally occurring amino acid
  misc_feature (97)..(108): Xaa can be any naturally occurring amino acid
  misc_feature (111)..(124): Xaa can be any naturally occurring amino acid
  misc_feature (133)..(142): Xaa can be any naturally occurring amino acid
  misc_feature (147)..(153): Xaa can be any naturally occurring amino acid
  misc_feature (156)..(165): Xaa can be any naturally occurring amino acid
  misc_feature (208)..(214): Xaa can be any naturally occurring amino acid
  misc_feature (222)..(229): Xaa can be any naturally occurring amino acid
  misc_feature (257)..(269): Xaa can be any naturally occurring amino acid
  misc_feature (294)..(313): Xaa can be any naturally occurring amino acid
PTPXXXXXXXXXXXXGPQKVKISLVRGGTKXXXXXXXXXXXXXXXLPXXXXXXXPKGGGTGIFWRGEKGGGPXXXXXXXXXDPLNPGGFPSKKRGYXXXXXXXXXXXXGLXXXXXXXXXXXXXXLRGGGKNLXXXXXXXXXXPRGFXXXXXXXLWXXXXXXXXXXPFGPQKQRGAKGGAPSGGTKNSFKKWGGRIRFFPRGFGAPIPXXXXXXXGVRGSSFXXXXXXXXRGRGWGKRCGGETGPFFYKKFVPPGGLXXXXXXXXXXXXXWRNIRGKNSTHGFLCVGGGPRGPSXXXXXXXXXXXXXXXXXXXXPLCRPFF

SEQ ID NO: 27806 - protein, 79 aa, Diabrotica virgifera
  misc_feature: Coding regions on vcDNA: vcDNA=SeqID_7503; Strand=+; Position=25-264
MKSARSYKPHTLDMVIWNAVAGASNMIYLSIIKRIITPQLARILLKFSSDLCHENMCLLLTVMPYYCHALRQVYPARDE

SEQ ID NO: 27807 - protein, 87 aa, Diabrotica virgifera
  misc_feature: Coding regions on vcDNA: vcDNA=SeqID_7504; Strand=+; Position=196-459
  misc_feature: Homolog annotation: Hit_ID=AAP12676.1; Match level="QueryCoverage =72%, HitCoverage=21%, E-value=1e-09, Identity=47%"; Hit description =trypsin precursor LlGtP1 [Lygus lineolaris]
  misc_feature (8)..(8): Xaa can be any naturally occurring amino acid
RITRYCQXITQAQICTYASCKDACQHDSGGPVIWQDPDRRILYAVGVISYGLRWLYIIIHAVNMIITIYLDCGLTITKTLDACLRIF

SEQ ID NO: 27808 - protein, 238 aa, Diabrotica virgifera
  misc_feature: Coding regions on vcDNA: vcDNA=SeqID_7505; Strand=+; Position=148-864
  misc_feature: Homolog annotation: Hit_ID=AAS38911.1; Match level="QueryCoverage =85%, HitCoverage=83%, E-value=6e-11, Identity=35%"; Hit description =similar to Leishmania major. Ppg3 [Dictyostelium discoideum]
  misc_feature: Gene Ontology Annotation: Molecular function=single-stranded DNA binding; Cellular component=nucleolus; Biological process=ribosomal small subunit assembly and maintenance
VSNEEKENIPLSSTSKRSSRSSSSSSSSSSSVNSSSSSSSSSSSSSRCCSLEQGRFVSHILKGKEIEAQPQSLSSRTTSPSILESVILTPRTPAVHYRISPMNSEESDADISDNDPTYNEHQGRKRSPSSSSSSSDDGTSEVVATSPRRSKKRKADPTKWKQNNQKIKRNAGEQYISTKTRNVVPARQMKSPCNQKCRLKCSENFDEAKRLQHFKCFWALEDLQLQRMFIKARMALEP

SEQ ID NO: 27809 - protein, 87 aa, Diabrotica virgifera
  misc_feature: Coding regions on vcDNA: vcDNA=SeqID_7506; Strand=+; Position=284-547
  misc_feature (31)..(37): Xaa can be any naturally occurring amino acid
LKLMYEQYICSWIFPYHSYPLFSEDELRIIXXXXXXXPVKSWIIDLHILTSDIIHLYILLFVFYLHHLLAQPLPFSFLNTDDNSIII

SEQ ID NO: 27810 - protein, 287 aa, Diabrotica virgifera
  misc_feature: Coding regions on vcDNA: vcDNA=SeqID_7507; Strand=-; Position=0-860
  misc_feature (19)..(273): Xaa can be any naturally occurring amino acid
GQEGSICFCRSWGFRSLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWSSLQEQLFDLPLA

SEQ ID NO: 27811 - protein, 81 aa, Diabrotica virgifera
  misc_feature: Coding regions on vcDNA: vcDNA=SeqID_7508; Strand=+; Position=93-335
  misc_feature: Homolog annotation: Hit_ID=XP_318752.1; Match level="QueryCoverage =88%, HitCoverage=14%, E-value=7e-09, Identity=38%"; Hit description =ENSANGP00000004677 [Anopheles gambiae]
KEIKMVSLDPLRILRHKVAEEQAEIARIRRYVGAIDVGDMERNIWLLKEMDKMIITSATYAGSDKITDEVGIVLGTAVIEC

SEQ ID NO: 27812 - protein, 19 aa, Diabrotica virgifera
  misc_feature: Coding regions on vcDNA: vcDNA=SeqID_7509; Strand=-; Position=1-57
  misc_feature (1)..(8): Xaa can be any naturally occurring amino acid
XXXXXXXXFRFQCFLKAIS

SEQ ID NO: 27813 - protein, 187 aa, Diabrotica virgifera
  misc_feature: Coding regions on vcDNA: vcDNA=SeqID_7510; Strand=-; Position=3-563
  misc_feature (1)..(12): Xaa can be any naturally occurring amino acid
  misc_feature (15)..(25): Xaa can be any naturally occurring amino acid
  misc_feature (35)..(42): Xaa can be any naturally occurring amino acid
  misc_feature (45)..(58): Xaa can be any naturally occurring amino acid
  misc_feature (64)..(77): Xaa can be any naturally occurring amino acid
  misc_feature (82)..(187): Xaa can be any naturally occurring amino acid
XXXXXXXXXXXXPFXXXXXXXXXXXTILAHTGLNXXXXXXXXSNXXXXXXXXXXXXXXPTSRSXXXXXXXXXXXXXXVIRKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27814 - protein, 89 aa, Diabrotica virgifera
  misc_feature: Coding regions on vcDNA: vcDNA=SeqID_7511; Strand=-; Position=320-589
  misc_feature (10)..(15): Xaa can be any naturally occurring amino acid
ERHQRSSERXXXXXXQRQKFGSFHTNTTFIREVSFDKILLSYFLFIVRSNVDRSDLLLWVVLNRRLKRRQRRNRLHWVHPIKFMYFLMI

SEQ ID NO: 27815 - protein, 313 aa, Diabrotica virgifera
  misc_feature: Coding regions on vcDNA: vcDNA=SeqID_7512; Strand=+; Position=4-944
  misc_feature: Homolog annotation: Hit_ID=XP_393750.1; Match level="QueryCoverage =100%, HitCoverage=23%, E-value=1e-58, Identity=37%"; Hit description= similar to ENSANGP00000004277 [Apis mellifera]
  misc_feature: Gene Ontology Annotation: Molecular function=15-hydroxyprostaglandin dehydrogenase (NAD+) activity; Cellular component=cellular_component unknown; Biological process=biological_process unknown
  misc_feature: Pfam annotation: Pfam_ID=ABC_membrane; Match level="Score=-15.4, E -value=0.0026, Copies=1"; Pfam description=ABC transporter transmembrane region
  misc_feature (279)..(279): Xaa can be any naturally occurring amino acid
  misc_feature (288)..(288): Xaa can be any naturally occurring amino acid
  misc_feature (300)..(300): Xaa can be any naturally occurring amino acid
  misc_feature (303)..(303): Xaa can be any naturally occurring amino acid
MYTVMVILSLVLELLKTFAFLDFCKRASINIHKAMIKNVLHSVMAFFDTHFIGNILNRFSQDVINVDENLPFQLLNCLEVAINVGAAATLLMTVNPYFFFYISVTFGVMLLFLKLYLPITRNLRRLEASTRSPMIGHLNAALEGVTTVRAYKAENMIIDEYERHQDVFTSAHYSLLCFKFGMGFYMSMLAGVMVTLVICSFVLFETDATAGSIGLALTQVIYLGALIQGAVRCWADLETLMTATERALEYTGLKSETTQGSVPKHWPKDGTISFQNVSXSYNSTQRIXKHLSFQSQAKEXNGXVGRTGAGKSS

SEQ ID NO: 27816 - protein, 20 aa, Diabrotica virgifera
  misc_feature: Coding regions on vcDNA: vcDNA=SeqID_7513; Strand=+; Position=1-60
  misc_feature (13)..(19): Xaa can be any naturally occurring amino acid
KKGTPRAPPGIPXXXXXXXL

SEQ ID NO: 27817 - protein, 299 aa, Diabrotica virgifera
  misc_feature: Coding regions on vcDNA: vcDNA=SeqID_7514; Strand=+; Position=3-899
  misc_feature: Homolog annotation: Hit_ID=XP_320360.1; Match level="QueryCoverage =100%, HitCoverage=29%, E-value=4e-51, Identity=35%"; Hit description= ENSANGP00000013951 [Anopheles gambiae]
  misc_feature: Gene Ontology Annotation: Molecular function=profilin binding; Cellular component=lamellipodium; Biological process=actin filament organization
PVIAMVDIEVRNINEQMRQKVFYEVIADMGPPDSTIIVNFENASENGGFIGFDSTMMTVLLEEFSQLGEIILVRFVSDTMWITFRDGQVVLEALKKTKGELNVNGIDFTLSLKTPNWVDLAKEEIDLCTSNTIPLYTSPSQSDYNCLGIPEVNKVPRTAPPSRPPPPVVKSTQSSPRRAPPKAGVIHMPVRPPATISPTNNTNNYVSSAPPLPSPPMSSVPAAAPPLCSAPPQMPPPDLPSQMSQEEGVYEEISDDVISTPEPLGPPPPPPRPDSGALPPTPSRGPPPVPARSAPPPPL

SEQ ID NO: 27818 - protein, 88 aa, Diabrotica virgifera
  misc_feature: Coding regions on vcDNA: vcDNA=SeqID_7515; Strand=-; Position=1-264
  misc_feature: Homolog annotation: Hit_ID=BAD26672.1; Match level="QueryCoverage =81%, HitCoverage=98%, E-value=5e-13, Identity=55%"; Hit description =Ribosomal protein L29 [Plutella xylostella]
  misc_feature: Pfam annotation: Pfam_ID=Ribosomal_L29e; Match level="Score=39.1, E -value=1.3e-08, Copies=1"; Pfam description=Ribosomal L29e protein family
NGGGFPYPARAKSKNPPNHTQNRKAPRKGIKNPNQFPQESPLGRDAKFLKTQGFFKGPILSPKQQFKRAKERKPGRDNKGKKWGYHYL

SEQ ID NO: 27819 - protein, 257 aa, Diabrotica virgifera
  misc_feature: Coding regions on vcDNA: vcDNA=SeqID_7516; Strand=-; Position=3-773
  misc_feature (5)..(11): Xaa can be any naturally occurring amino acid
  misc_feature (20)..(27): Xaa can be any naturally occurring amino acid
  misc_feature (31)..(59): Xaa can be any naturally occurring amino acid
  misc_feature (61)..(78): Xaa can be any naturally occurring amino acid
  misc_feature (80)..(101): Xaa can be any naturally occurring amino acid
  misc_feature (111)..(117): Xaa can be any naturally occurring amino acid
  misc_feature (119)..(143): Xaa can be any naturally occurring amino acid
  misc_feature (147)..(162): Xaa can be any naturally occurring amino acid
  misc_feature (165)..(171): Xaa can be any naturally occurring amino acid
  misc_feature (173)..(187): Xaa can be any naturally occurring amino acid
  misc_feature (189)..(257): Xaa can be any naturally occurring amino acid
KRIIXXXXXXXQPVGLFPPXXXXXXXXEQKXXXXXXXXXXXXXXXXXXXXXXXXXXXXXGXXXXXXXXXXXXXXXXXXKXXXXXXXXXXXXXXXXXXXXXXKTPKKKIPPXXXXXXXPXXXXXXXXXXXXXXXXXXXXXXXXXFVAXXXXXXXXXXXXXXXXGGXXXXXXXIXXXXXXXXXXXXXXXKXXXXXXXXXXXXXXXXXXXXXXXXXXXXXXXXXXXXXXXXXXXXXXXXXXXXXXXXXXXXXXXXXXXXX

SEQ ID NO: 27820 - protein, 270 aa, Diabrotica virgifera
  misc_feature: Coding regions on vcDNA: vcDNA=SeqID_7517; Strand=+; Position=2-915
  misc_feature: Homolog annotation: Hit_ID=BAC82595.1; Match level="QueryCoverage =97%, HitCoverage=25%, E-value=2e-32, Identity=42%"; Hit description =reverse transcriptase [Anopheles gambiae]
  misc_feature: Pfam annotation: Pfam_ID=RVT_1; Match level="Score=41.4, E-value=2.6e- 09, Copies=1"; Pfam description=Reverse transcriptase (RNA-dependent
  misc_feature (235)..(235): Xaa can be any naturally occurring amino acid
DGVQNFWLKKFWSVHECLSTLINHVISNPQDIPSFLTQGTTYLIPKDQNNTQDPAKYRPITCLPTLYKLVTSCLARRIYQGFHGLLRTTYHRLNILRIYKVDDNIVTFLEHIMTEWKTRIHLQIPGESNIETENIAISRGLFQGDSLSPLWFCLAMNPLPQLLNSTDAGFSIKNNNNVVVKLNHLFYMDDLKLMASTRNELDEMLKTVETFSNDISMHFGLDKCRILNIVRGKVXPEDSYANGQNIVSMSENDMYTYLGVIKRGELTLNK

SEQ ID NO: 27821 - protein, 75 aa, Diabrotica virgifera
  misc_feature: Coding regions on vcDNA: vcDNA=SeqID_7518; Strand=-; Position=179-406
  misc_feature (17)..(28): Xaa can be any naturally occurring amino acid
  misc_feature (66)..(74): Xaa can be any naturally occurring amino acid
SRVTCSIRYPPPSIYYXXXXXXXXXXXXLIKILILFIRGKCYIGSTQLLRVPSPIFQNPPNYNRYXXXXXXXXXP

SEQ ID NO: 27822 - protein, 170 aa, Diabrotica virgifera
  misc_feature: Coding regions on vcDNA: vcDNA=SeqID_7519; Strand=-; Position=1-510
  misc_feature (152)..(167): Xaa can be any naturally occurring amino acid
PSLNLGTLQPLRKFTQNYVKQDLLVLANFFLSIRSPPGIARCTSATISTDEENNLISKSDFGFLTGFARKGMGSRLSAELDDAEAETNERSKRNIGFLPGFARKGIRNRRSVEIEDDEEENNERSKRNFGFLPGFARKGIRSRRSAELEPEXXXXXXXXXXXXXXXXPGG

SEQ ID NO: 27823 - protein, 244 aa, Diabrotica virgifera
  misc_feature: Coding regions on vcDNA: vcDNA=SeqID_7520; Strand=-; Position=1-732
  misc_feature (2)..(21): Xaa can be any naturally occurring amino acid
  misc_feature (23)..(49): Xaa can be any naturally occurring amino acid
  misc_feature (52)..(244): Xaa can be any naturally occurring amino acid
LXXXXXXXXXXXXXXXXXXXXPXXXXXXXXXXXXXXXXXXXXXXXXXXXSGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27824 - protein, 87 aa, Diabrotica virgifera
  misc_feature: Coding regions on vcDNA: vcDNA=SeqID_7521; Strand=+; Position=26-289
  misc_feature (43)..(43): Xaa can be any naturally occurring amino acid
  misc_feature (62)..(62): Xaa can be any naturally occurring amino acid
  misc_feature (68)..(68): Xaa can be any naturally occurring amino acid
MGRLRGPGRNFRGRPSLCGHCVRSQTNKMSDIEVDDAPPGPHXLSGGSMSEIQTLQEVLTTXALIHEXVLHGLYDAVLDLYVTLAAL

SEQ ID NO: 27825 - protein, 281 aa, Diabrotica virgifera
  misc_feature: Coding regions on vcDNA: vcDNA=SeqID_7522; Strand=+; Position=81-923
  misc_feature: Homolog annotation: Hit_ID=XP_312058.1; Match level="QueryCoverage =99%, HitCoverage=27%, E-value=1e-137, Identity=88%"; Hit description= ENSANGP00000022526 [Anopheles gambiae]
  misc_feature: Gene Ontology Annotation: Molecular function=sodium/potassium -exchanging ATPase activity; Cellular component=sodium/potassium -exchanging ATPase complex; Biological process=transport
  misc_feature: Pfam annotation: Pfam_ID=E1-E2_ATPase; Match level="Score=125.5, E -value=1.3e-34, Copies=1"; Pfam description=E1-E2 ATPase
  misc_feature (76)..(82): Xaa can be any naturally occurring amino acid
  misc_feature (276)..(276): Xaa can be any naturally occurring amino acid
MGDNENNDSRRKVKKVRKAEDLDDLKQELDIDYHKISPEELYQRFQTHPENGLSHAKAKENLDRDGPNALTPPKTXXXXXXXCKNLFGGFALLLWIGAILCFIAYSIQASTVEEPADDNLYLGIVLAAVVIVTGIFSYYQESKSSKIMESFKNMVPQFATVLREGEKLTLRAEDLVLGDVVEVKFGDRIPADIRIIESRGFKVDNSSLTGESEPQSRSPDFTHENPLETKNLAFFSTNAVEGTAKGVVISCGDNTVMGRIAGLASGWDTGETPIAXEIHHF

SEQ ID NO: 27826 - protein, 227 aa, Diabrotica virgifera
  misc_feature: Coding regions on vcDNA: vcDNA=SeqID_7523; Strand=+; Position=337-1016
  misc_feature: Homolog annotation: Hit_ID=XP_316447.1; Match level="QueryCoverage =94%, HitCoverage=37%, E-value=3e-56, Identity=52%"; Hit description =ENSANGP00000020407 [Anopheles gambiae]
  misc_feature: Gene Ontology Annotation: Cellular component=mitochondrion
  misc_feature (170)..(170): Xaa can be any naturally occurring amino acid
  misc_feature (191)..(192): Xaa can be any naturally occurring amino acid
  misc_feature (194)..(194): Xaa can be any naturally occurring amino acid
  misc_feature (208)..(208): Xaa can be any naturally occurring amino acid
MAGIFQTTGWPGVVTVMSNWFGKSKRGLIFGLWNSHTSIGNILGTLIAAKYVEKDWALSFIMPGLFIGVAGFIIFLFLVVNPSDVGCATPDRSDIRPKRPRLLDPQQSVNDETSSGIDSDVDDTNIIVGEQEVQRRITERTQLLARSHSEPEERAIGFVDALRIPGGIEXSLALFFFKLVSYTFLYWLPLXXNXITSMSAEDSADLSXLFDVGGSLEHNRWVFTDKT

SEQ ID NO: 27827 - protein, 141 aa, Diabrotica virgifera
  misc_feature: Coding regions on vcDNA: vcDNA=SeqID_7524; Strand=+; Position=24-449
TSTFRTHIAVLGYSFPDHSWLRVVSISKTARFSYIGKRQSVLDVIVSNRKKLQISQNHMIREALNVPRYVPLRYIYRDTDQRKILRTMDEKAYDIFTNARNHPSRWLRELTDYDENVRTKHRRPKQQIQGYRQVPAEEHDV

SEQ ID NO: 27828 - protein, 309 aa, Diabrotica virgifera
  misc_feature: Coding regions on vcDNA: vcDNA=SeqID_7525; Strand=+; Position=19-950
  misc_feature: Homolog annotation: Hit_ID=XP_319685.1; Match level="QueryCoverage =93%, HitCoverage=56%, E-value=8e-58, Identity=41%"; Hit description =ENSANGP00000021422 [Anopheles gambiae]
  misc_feature: Gene Ontology Annotation: Molecular function=inorganic phosphate transporter activity; Cellular component=integral to membrane; Biological process=phosphate transport
  misc_feature: Pfam annotation: Pfam_ID=MFS_1; Match level="Score=8.5, E-value =0.0018, Copies=1"; Pfam description=Major Facilitator Superfamily
  misc_feature (139)..(143): Xaa can be any naturally occurring amino acid
  misc_feature (285)..(287): Xaa can be any naturally occurring amino acid
  misc_feature (290)..(291): Xaa can be any naturally occurring amino acid
TKYPETKGQQHKVGDDQVNQSEYWNSSAENTENATSTNKVPGFGYRHIQIGLLFLMLAIGYAMRVNLSVGIVAMTNGTTTENPDVPWYEWKNKSVVLSSFFWGYICLQIFAGQLGQTYGTKWLAFVSMAVNSTACFIIXXXXXWLGSSGVIACRVVQGLSQGFFFPSVHNILGKWAPLEERAFLSMIAFAGPSFGTIVSLIASGAIASSWAGWPYAFYIFGGLGYVWMLPWAFLAANTPALHPNISKAEKDYIENSLSVKTQVVAPTPWKDIFTSVPVWAFCITXXXQNXXYSTLLTEIPNYFEHIMHF

SEQ ID NO: 27829 - protein, 146 aa, Diabrotica virgifera
  misc_feature: Coding regions on vcDNA: vcDNA=SeqID_7526; Strand=+; Position=1-441
  misc_feature: Pfam annotation: Pfam_ID=PBP_GOBP; Match level="Score=10.4, E-value =0.0016, Copies=1"; Pfam description=PBP/GOBP family
  misc_feature (100)..(107): Xaa can be any naturally occurring amino acid
KYYKEELVFNSANNMWNINIRILFLFVGFVTIALASRQDILNSIRKHIHECQKEINVSDDFVAEIGSKTESDPKKAGEFAWCVNIKTGIQTLTGEFVDDXXXXXXXXLEIDESTVKIILSKCKLKTSSGGGEAALFYFQCLNDVVD

SEQ ID NO: 27830 - protein, 303 aa, Diabrotica virgifera
  misc_feature: Coding regions on vcDNA: vcDNA=SeqID_7527; Strand=+; Position=2-913
  misc_feature (17)..(289): Xaa can be any naturally occurring amino acid
DNIVVIHLTFKILDWDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYPPLTMGVPVTLIG

SEQ ID NO: 27831 - protein, 71 aa, Diabrotica virgifera
  misc_feature: Coding regions on vcDNA: vcDNA=SeqID_7528; Strand=-; Position=11-226
  misc_feature (36)..(42): Xaa can be any naturally occurring amino acid
  misc_feature (48)..(55): Xaa can be any naturally occurring amino acid
VVDHFDGTFVDYLPHLYTKSSSSSRLSIMYVSNDIXXXXXXXLYRTYXXXXXXXXRLFEIRLRIKGTLLGM

SEQ ID NO: 27832 - protein, 78 aa, Diabrotica virgifera
  misc_feature: Coding regions on vcDNA: vcDNA=SeqID_7529; Strand=+; Position=78-314
APLFLWVALELTQQTPPGDYTPRNTQTQTNNEINVCPDELPRVLLSRDAAHILRNQSVPQLEHLGSIIHPRYLDNLAH

SEQ ID NO: 27833 - protein, 221 aa, Diabrotica virgifera
  misc_feature: Coding regions on vcDNA: vcDNA=SeqID_7530; Strand=+; Position=237-899
MAGDDRKEGASWTKSPLLRDTFKYLVTDFYPEKILKSLSSGFGSSNRTKNNEGAKSSVVYPLMMEGVSLLLNRFIENGSSESTTENSQGAIRGRIANILTESIGELLQNKFANSGIVSTVENKKSSADGNTEGIGGINLETVKSLLPLIQKAESNGEFSNFMSKFLKNPPGELGDLNSLLQNYSPQLNGILSNRRVLDALRSKFKSIESIEFDEYHGAIHT

SEQ ID NO: 27834 - protein, 132 aa, Diabrotica virgifera
  misc_feature: Coding regions on vcDNA: vcDNA=SeqID_7531; Strand=-; Position=439-838
  misc_feature: Homolog annotation: Hit_ID=NP_508248.1; Match level="QueryCoverage =69%, HitCoverage=11%, E-value=1e-12, Identity=38%"; Hit description =predicted CDS, reverse transcriptase family member (XB968) [Caenorhabditis elegans]
  misc_feature (21)..(21): Xaa can be any naturally occurring amino acid
  misc_feature (69)..(69): Xaa can be any naturally occurring amino acid
KVFIYIEPGVRKGDTMSPKLXNTMPEHGFKNMDWLTKGIKIDGEYLKNLRLAVDIVLIVEDLEMAREMXQKLVEATENVGLNINISKAKIITNLVPNQNISICGQEIELLDKYKYLEYEIMMGGDNEIHELK

SEQ ID NO: 27835 - protein, 65 aa, Diabrotica virgifera
  misc_feature: Coding regions on vcDNA: vcDNA=SeqID_7532; Strand=+; Position=2-199
YIDVKTVFNDEEESGRDTSIHRKMSLIYGAEPLRLYSRRLAVHPMRDGDGTHNSNELQQGSKTPM

SEQ ID NO: 27836 - protein, 51 aa, Diabrotica virgifera
  misc_feature: Coding regions on vcDNA: vcDNA=SeqID_7533; Strand=+; Position=71-226
SGGYSQTETDTIGSHDLAVKRHNRTENMTHHRFSGLAYDRSLESFHIFSTS

SEQ ID NO: 27837 - protein, 256 aa, Diabrotica virgifera
  misc_feature: Coding regions on vcDNA: vcDNA=SeqID_7534; Strand=+; Position=156-926
  misc_feature: Homolog annotation: Hit_ID=XP_321392.1; Match level="QueryCoverage =97%, HitCoverage=46%, E-value=7e-59, Identity=48%"; Hit description =ENSANGP00000012194 [Anopheles gambiae]
  misc_feature: Gene Ontology Annotation: Molecular function=receptor binding; Cellular component=insoluble fraction; Biological process=amino acid derivative metabolism
  misc_feature: Pfam annotation: Pfam_ID=Amidase; Match level="Score=-113.5, E-value =4e-07, Copies=1"; Pfam description=Amidase
  misc_feature (113)..(118): Xaa can be any naturally occurring amino acid
  misc_feature (256)..(256): Xaa can be any naturally occurring amino acid
MPPGIIAIRVLFWMVIKSVNVLYIPVLIKRIFRKSRACPPVKNEILLLSASELAERIRQQKVTCESVIKAYIARIQQVNPFINAVIEDRYQAAIDEAKRIDQYLSSSSRNLDXXXXXXPLLGVPISIKGSIEVAKMKSTAGMVTRANVIADYDAVTVKYAREAGAILLVTTNIPELCLNWESTNKLVGTTKNPYDTSRTCGGSSGGEASLLATAGSIIGIGSDIAGSLRLPAHFCGVWGHKPTPGTVSSGGHYPSX

SEQ ID NO: 27838 - protein, 94 aa, Diabrotica virgifera
  misc_feature: Coding regions on vcDNA: vcDNA=SeqID_7535; Strand=+; Position=3-287
  misc_feature: Homolog annotation: Hit_ID=CAF98695.1; Match level="QueryCoverage =100%, HitCoverage=65%, E-value=4e-26, Identity=53%"; Hit description= unnamed protein product [Tetraodon nigroviridis]
  misc_feature: Gene Ontology Annotation: Molecular function=translation factor activity, nucleic acid binding; Biological process=protein biosynthesis
  misc_feature: Pfam annotation: Pfam_ID=IF4E; Match level="Score=-2.2, E-value=5e -11, Copies=1"; Pfam description=Eukaryotic initiation factor 4E
NNDLDRYWLDIILCLIGEAFENSEEICGAVVNIRQKGDKIAVWTADAQNSHAVLEIGSKLKERLHIPSRVTLGYQLHKDTIQKTGSVSKYSYTV

SEQ ID NO: 27839 - protein, 314 aa, Diabrotica virgifera
  misc_feature: Coding regions on vcDNA: vcDNA=SeqID_7536; Strand=-; Position=0-941
  misc_feature (17)..(309): Xaa can be any naturally occurring amino acid
KTLLKKCLTSLSFRGVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKEGIV

SEQ ID NO: 27840 - protein, 99 aa, Diabrotica virgifera
  misc_feature: Coding regions on vcDNA: vcDNA=SeqID_7537; Strand=-; Position=42-341
  misc_feature (80)..(87): Xaa can be any naturally occurring amino acid
KLQEYSHSQYLVIKVWSDSLSRRPENGVNRLTLLELFYEIDISKTTNAVRQHSTCYTLFFVFKQPKVAISNNCRSQVIYXXXXXXXXRPRNKFHISDIR

SEQ ID NO: 27841 - protein, 261 aa, Diabrotica virgifera
  misc_feature: Coding regions on vcDNA: vcDNA=SeqID_7538; Strand=+; Position=1-786
  misc_feature: Homolog annotation: Hit_ID=NP_885269.1; Match level="QueryCoverage =98%, HitCoverage=44%, E-value=1e-126, Identity=82%"; Hit description= hypothetical protein BPP3090 [Bordetella parapertussis 12822] ref|NP _889589.1| hypothetical
  misc_feature (22)..(33): Xaa can be any naturally occurring amino acid
  misc_feature (119)..(123): Xaa can be any naturally occurring amino acid
WMKKYAPQQAMGMTFSESGPVXXXXXXXXXXXXYTAFTADMTKKGLPVVNEDGTPKWRMAPSPYGPYWKDGMQNGYQDVGSWTFFKSTNPDKMAAAWLYAQFVTAKTVSLKKSITGLTXXXXXDIHSDYFSKNAANYGGLIEFYRSPARVAWTPTGNNVPDYPKLAQLWWKNVATAVTGEKTPQAAMDNLANEMDQVMARLERAGMAQCAPKLNAKGDPNKWLSDQHAPWKKLGNEKPKGETVAYEQLLEAWEGGEGAVIL

SEQ ID NO: 27842 - protein, 198 aa, Diabrotica virgifera
  misc_feature: Coding regions on vcDNA: vcDNA=SeqID_7539; Strand=+; Position=113-706
  misc_feature: Homolog annotation: Hit_ID=XP_309675.1; Match level="QueryCoverage =91%, HitCoverage=38%, E-value=6e-29, Identity=36%"; Hit description =ENSANGP00000024473 [Anopheles gambiae]
  misc_feature: Gene Ontology Annotation: Cellular component=membrane; Biological process=signal transduction
FHNFVASRKVPTQIGNLLALTGDTTLTWSSPILTKLDSNDTDINPLGRKITLDEISWIGSLQYIGAMVGILPFAVLADVIGRKPVLLLLAVPHIISFLSFAFAKTIGWYYVGRFLGGVSLSSVYIILPMYVAEIAEDSYRGMLLMSYSTFASLGDLIPYVLGPYVSVLWFNIILAVFPISFLVIFLIIAPESPYYYVN

SEQ ID NO: 27843 - protein, 280 aa, Diabrotica virgifera
  misc_feature: Coding regions on vcDNA: vcDNA=SeqID_7540; Strand=+; Position=1-843
  misc_feature: Homolog annotation: Hit_ID=AAT70350.1; Match level="QueryCoverage =81%, HitCoverage=52%, E-value=2e-27, Identity=38%"; Hit description =variable lymphocyte receptor [Petromyzon marinus]
  misc_feature: Gene Ontology Annotation: Molecular function=enzyme regulator activity; Cellular component=extracellular; Biological process =biological_process unknown
  misc_feature: Pfam annotation: Pfam_ID=LRR_1; Match level="Score=86.5, E-value=7.1e- 23, Copies=8"; Pfam description=Leucine Rich Repeat
ELEAFCFKGLKALTYLNLNKNQFSVLKNDTFAGLVNLETLDVSLNQLTTIDSNAFRSLGALKELNLKNNRLQNLTVNIFNTLVNLERLNLQKNEISRLERGLFDGLKNLLELNLAETHLTIMDVGVFHQLNNLKVLNLSKNSMGSVKPPRNSFEIGIFSNLANLEILDLSFNLISSLSVKNMFMSLRNLKELLLDHNGLKYVDFGGLLNNCKKLSYIGISFNTWKCEYLADITEKLFNSSISYHPKTPIYNQDNIEGIYCTDVCKFVYCEGSEGSELEIQ

SEQ ID NO: 27844 - protein, 77 aa, Diabrotica virgifera
  misc_feature: Coding regions on vcDNA: vcDNA=SeqID_7541; Strand=+; Position=407-640
  misc_feature (20)..(29): Xaa can be any naturally occurring amino acid
YVITARDLKIRLDIILAVIXXXXXXXXXXASNQGWIEIVMLNDFKSEIINFLFKYWYYLHYFTWNTSNFSTSIKYRE

SEQ ID NO: 27845 - protein, 89 aa, Diabrotica virgifera
  misc_feature: Coding regions on vcDNA: vcDNA=SeqID_7542; Strand=+; Position=284-550
YTIPPQSIKSHTTEPVTTDTYKLQIHTEDCYHANVCPPMRIGTGPNHISYLWRPVIRFNFTWQKMPPWSTNTTCTITTYMDLLFKGSDL

SEQ ID NO: 27846 - protein, 140 aa, Diabrotica virgifera
  misc_feature: Coding regions on vcDNA: vcDNA=SeqID_7543; Strand=+; Position=139-561
FSLFAILDLSLDSYRIKESTVIIMKTIISILLFAVVLALSSSEKIVNKDDCHCHEGFLAKTTPDKGYKCFGVLLKLITNCNTIKRPRCVCTEATGILSDESGTHCVEYRSGREIQKWNCENQADWEKFFTEYPGERFVKL

SEQ ID NO: 27847 - protein, 178 aa, Diabrotica virgifera
  misc_feature: Coding regions on vcDNA: vcDNA=SeqID_7544; Strand=+; Position=295-828
  misc_feature (10)..(92): Xaa can be any naturally occurring amino acid
  misc_feature (127)..(142): Xaa can be any naturally occurring amino acid
  misc_feature (150)..(156): Xaa can be any naturally occurring amino acid
  misc_feature (160)..(166): Xaa can be any naturally occurring amino acid
KIHQIKHLEXXXXXXXXXXXXXXXXXXXXXXXXXXXXXXXXXXXXXXXXXXXXXXXXXXXXXXXXXXXXXXXXXXXXXXXXXXXXXXXXXXXAPKNIFRGRFLKTGGGKKRGGPQIFLLGKTPPFPXXXXXXXXXXXXXXXXFAPPKREXXXXXXXHNKXXXXXXXTGGEIYFLGGPK

SEQ ID NO: 27848 - protein, 58 aa, Diabrotica virgifera
  misc_feature: Coding regions on vcDNA: vcDNA=SeqID_7545; Strand=-; Position=75-251
HCNKNLSQYVLSSHVLKSLVPTTSAAVAHESMCLRSTAVTLMITVSLQPMTNTAKNSI

SEQ ID NO: 27849 - protein, 182 aa, Diabrotica virgifera
  misc_feature: Coding regions on vcDNA: vcDNA=SeqID_7546; Strand=+; Position=329-877
  misc_feature (2)..(10): Xaa can be any naturally occurring amino acid
  misc_feature (181)..(182): Xaa can be any naturally occurring amino acid
LXXXXXXXXXDLNQDFEDPRGNLFDLTDPNTDLNYGASTSSGLHLELTTELSQNDSFIDQNYEIHDEAQQNNPNGVFLHYNTDLDTDSPTDNQSSSQLRTIVVNDFSTEEHQGASQVVNDIPVSELEYNPDNSSPLEDFFFLDNVAEINQSNNGSEKVKSPKAKSLFDDSNSRRERSLRIXX

SEQ ID NO: 27850 - protein, 42 aa, Diabrotica virgifera
  misc_feature: Coding regions on vcDNA: vcDNA=SeqID_7547; Strand=-; Position=56-184
LGWPHRLYGLVLASSITDRLSCYESGRSHCDLSLLLFLLLDS

SEQ ID NO: 27851 - protein, 85 aa, Diabrotica virgifera
  misc_feature: Coding regions on vcDNA: vcDNA=SeqID_7548; Strand=-; Position=2-256
  misc_feature (1)..(19): Xaa can be any naturally occurring amino acid
  misc_feature (22)..(32): Xaa can be any naturally occurring amino acid
  misc_feature (42)..(49): Xaa can be any naturally occurring amino acid
  misc_feature (52)..(65): Xaa can be any naturally occurring amino acid
  misc_feature (71)..(84): Xaa can be any naturally occurring amino acid
XXXXXXXXXXXXXXXXXXXPFXXXXXXXXXXXTNLAHTGLNXXXXXXXXSNXXXXXXXXXXXXXXPTSRSXXXXXXXXXXXXXXV

SEQ ID NO: 27852 - protein, 197 aa, Diabrotica virgifera
  misc_feature: Coding regions on vcDNA: vcDNA=SeqID_7549; Strand=+; Position=75-668
  misc_feature: Homolog annotation: Hit_ID=NP_647881.1; Match level="QueryCoverage =99%, HitCoverage=98%, E-value=2e-64, Identity=61%"; Hit description =CG11586-PA [Drosophila melanogaster] gb|AAF47873.1| CG11586-PA [Drosophila melanogaster]
  misc_feature: Pfam annotation: Pfam_ID=zf-U1; Match level="Score=10.9, E-value =0.0038, Copies=1"; Pfam description=U1 zinc finger
  misc_feature (31)..(40): Xaa can be any naturally occurring amino acid
  misc_feature (129)..(140): Xaa can be any naturally occurring amino acid
MSVRPDDHRRKWDKDEYEKLAEERIKEEKYXXXXXXXXXXGIPVKRELLKIRDYKVDLDSKLGKSIVINKNTPTSQSGGYYCNVCDCVVKDSINFLDHINGKKHQRNLGMSMKVERSSLDSVRKRFEAXXXXXXXXXXXXDMASRLQELAEEEEKLKEYRKEKRREKRKIEEDAEEEPQSELASIMGFSGFGSSKKK

SEQ ID NO: 27853 - protein, 286 aa, Diabrotica virgifera
  misc_feature: Coding regions on vcDNA: vcDNA=SeqID_7550; Strand=+; Position=100-957
  misc_feature: Homolog annotation: Hit_ID=XP_392728.1; Match level="QueryCoverage =93%, HitCoverage=31%, E-value=3e-78, Identity=60%"; Hit description =similar to p47 [Apis mellifera]
MLYLEDYLEMIEHLPQELRDRFTDMREMDLTIHNNMDELEKRVKNFFSDCKRCPNDLPQSVEAEFQGIRKEYYKTLEEADEKVHLASQMYDLVDKYLRRLDSELHKFKCELEADNKGITEVLEKRSLELDTPNTTPNISSLQQKENRYDSAFRYSRPRAEKRRDSSVSIPAQLTEKRQAVTPVAPPPLIETRHATTSVQPIAPSSATTTTMSYNLGHNLGAGPAIAAAASQAIAATQQMQQGRRTASLKASYEAINTGVHGHEFGIGRELAGAAQTAHPAIQDHAN

SEQ ID NO: 27854 - protein, 175 aa, Diabrotica virgifera
  misc_feature: Coding regions on vcDNA: vcDNA=SeqID_7551; Strand=+; Position=35-562
MASFKFLLFLGIVGYCCAAPAVNWDEVSRKINEIGNKVQTAARGACGFINSIPGGQPSPFNPQGFNTGFRGFQPSYFPQSPGFAAGRGFPQFPAGRGFPQSPGFPSYYPPSYYPNRFPGRAPNSPPASPQTPNSVPPSSSGGIRPNGMPPVPNTSYLTSISSSLNSGSSRHSNIF

SEQ ID NO: 27855 - protein, 71 aa, Diabrotica virgifera
  misc_feature: Coding regions on vcDNA: vcDNA=SeqID_7552; Strand=-; Position=555-770
SYLTENVGTAHPTKLRQTNVPSYYQRRTTGGSGWLTPSKFHATDEMATLVKFSDFPLFSMQTIYSPFATPK

SEQ ID NO: 27856 - protein, 106 aa, Diabrotica virgifera
  misc_feature: Coding regions on vcDNA: vcDNA=SeqID_7553; Strand=-; Position=81-401
  misc_feature (51)..(57): Xaa can be any naturally occurring amino acid
TKSFRYNYFGSYNLRGQAHKKTCIANTYQRVIIFTGNVLGITLIIGTSDIXXXXXXXFHKSNKESLASSAPVYPFRYTLSSTLCTKKDTHGSLCSICCVSQKDTLA

SEQ ID NO: 27857 - protein, 87 aa, Diabrotica virgifera
  misc_feature: Coding regions on vcDNA: vcDNA=SeqID_7554; Strand=-; Position=2-262
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (74)..(83): Xaa can be any naturally occurring amino acid
PFXXXXXXXXXXXTNLAHTGLNXXXXXXXXSNXXXXXXXXXXXXXXPTSRSXXXXXXXXXXXXXXVIPKVIYWXXXXXXXXXXRAEK

SEQ ID NO: 27858 - protein, 322 aa, Diabrotica virgifera
  misc_feature: Coding regions on vcDNA: vcDNA=SeqID_7555; Strand=+; Position=1-966
  misc_feature (13)..(321): Xaa can be any naturally occurring amino acid
LLTGSVQKTYSCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXS

SEQ ID NO: 27859 - protein, 124 aa, Diabrotica virgifera
  misc_feature: Coding regions on vcDNA: vcDNA=SeqID_7556; Strand=+; Position=2-376
FCNVLKLLAAGGINVGGTWQRNKFQKLRISKTEKLSSILIENVTRSKPVKETIVGVKGKVKHGLNFSFFKFDLYIAIPQWSLPSRIFSKFCTMQIIIALNYSFHNKFVGCIVNLIDFLTQDKYN

SEQ ID NO: 27860 - protein, 66 aa, Diabrotica virgifera; identical to SEQ ID NO: 26808
  misc_feature: Coding regions on vcDNA: vcDNA=SeqID_7557; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 27861 - protein, 69 aa, Diabrotica virgifera
  misc_feature: Coding regions on vcDNA: vcDNA=SeqID_7558; Strand=-; Position=417-626
TLSPSHPHYPSKLPPTNNTSTHIIIFKYSPKSPTIPPYHITHHLSLPTSSLTTNHYSFHHTMVISQPFS

SEQ ID NO: 27862 - protein, 35 aa, Diabrotica virgifera
  misc_feature: Coding regions on vcDNA: vcDNA=SeqID_7559; Strand=-; Position=48-155
  misc_feature (28)..(34): Xaa can be any naturally occurring amino acid
VIRTIVTFYVTFSRLNWFLKIYFHVNLXXXXXXXH

SEQ ID NO: 27863 - protein, 104 aa, Diabrotica virgifera
  misc_feature: Coding regions on vcDNA: vcDNA=SeqID_7560; Strand=-; Position=78-392
TYLHWNNVNWNNVLFSDESYFCLNGSDGRRRVWRRPGERYAAACFDERLPFGGGSVMVWTGITLQARTVSLHTKYLLYGQQICNRSFRSSSYASHDLGEYDIFM

SEQ ID NO: 27864 - protein, 47 aa, Diabrotica virgifera
  misc_feature: Coding regions on vcDNA: vcDNA=SeqID_7561; Strand=-; Position=1-141
  misc_feature (23)..(23): Xaa can be any naturally occurring amino acid
  misc_feature (31)..(31): Xaa can be any naturally occurring amino acid
  misc_feature (34)..(42): Xaa can be any naturally occurring amino acid
KSPKWASSLVNLFVEIALDAAIXIKHKPIGXILXXXXXXXXXLYNNL

SEQ ID NO: 27865 - protein, 257 aa, Diabrotica virgifera
  misc_feature: Coding regions on vcDNA: vcDNA=SeqID_7562; Strand=+; Position=3-773
  misc_feature: Homolog annotation: Hit_ID=AAF87760.1; Match level="QueryCoverage =98%, HitCoverage=57%, E-value=3e-90, Identity=70%"; Hit description =cytochrome oxidase subunit I [Diabrotica virgifera zeae]
  misc_feature: Pfam annotation: Pfam_ID=COX1; Match level="Score=-118.7, E-value =3.3e-07, Copies=1"; Pfam description=Cytochrome C and Quinol oxidase polyp
  misc_feature (5)..(12): Xaa can be any naturally occurring amino acid
  misc_feature (33)..(33): Xaa can be any naturally occurring amino acid
  misc_feature (68)..(68): Xaa can be any naturally occurring amino acid
  misc_feature (85)..(85): Xaa can be any naturally occurring amino acid
  misc_feature (88)..(94): Xaa can be any naturally occurring amino acid
  misc_feature (121)..(127): Xaa can be any naturally occurring amino acid
  misc_feature (141)..(141): Xaa can be any naturally occurring amino acid
  misc_feature (149)..(165): Xaa can be any naturally occurring amino acid
  misc_feature (195)..(195): Xaa can be any naturally occurring amino acid
  misc_feature (211)..(218): Xaa can be any naturally occurring amino acid
  misc_feature (223)..(223): Xaa can be any naturally occurring amino acid
  misc_feature (239)..(239): Xaa can be any naturally occurring amino acid
  misc_feature (247)..(247): Xaa can be any naturally occurring amino acid
HIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFSXQRKRLRPLRITSFIEXLQFNPPAXHRYSDCQYYH

SEQ ID NO: 27866 - protein, 318 aa, Diabrotica virgifera
  misc_feature: Coding regions on vcDNA: vcDNA=SeqID_7563; Strand=+; Position=2-956
  misc_feature: Homolog annotation: Hit_ID=XP_313331.1; Match level="QueryCoverage =99%, HitCoverage=64%, E-value=1e-119, Identity=64%"; Hit description= ENSANGP00000011393 [Anopheles gambiae]
  misc_feature: Gene Ontology Annotation: Molecular function=electron transporter activity; Cellular component=mitochondrion; Biological process =alcohol metabolism
  misc_feature: Pfam annotation: Pfam_ID=Aldedh; Match level="Score=215.5, E-value=1e- 61, Copies=1"; Pfam description=Aldehyde dehydrogenase family
  misc_feature (231)..(239): Xaa can be any naturally occurring amino acid
  misc_feature (260)..(260): Xaa can be any naturally occurring amino acid
  misc_feature (289)..(289): Xaa can be any naturally occurring amino acid
  misc_feature (305)..(306): Xaa can be any naturally occurring amino acid
ASKKVEVKYTKLFINNQFVDSVSKKTFEVLNPSTGKPITNVAEGDKEDIDKAVRAAKAAFARGAPWRSMDASSRGAIINKFADLVEQHLDEISELEVLENGKTLEFAKMCIQFAVSCYRYYAGFCDKVYGQTIPADGPIMCMTRKEPIGVVGQIIPWNFPALMLTWKWGPALAAGCTLVLKPAEQTPLTALYMAALTKEAGFPDGVINVVNGFGPTAGASLALHKDVRKIXXXXXXXXXHLIMEYAAKSNLKKVSLELGXQSPLVVFDDYDVDEAVKIAGNAIFGNHGXSCCAGSRTYVQSGIYXXFVKKAAEYAKTL

SEQ ID NO: 27867 - protein, 285 aa, Diabrotica virgifera
  misc_feature: Coding regions on vcDNA: vcDNA=SeqID_7564; Strand=+; Position=109-964
  misc_feature: Homolog annotation: Hit_ID=EAL29286.1; Match level="QueryCoverage =92%, HitCoverage=48%, E-value=1e-88, Identity=58%"; Hit description =GA10247-PA [Drosophila pseudoobscura]
  misc_feature: Gene Ontology Annotation: Molecular function=transcription factor activity; Cellular component=nucleus; Biological process=mitosis
  misc_feature: Pfam annotation: Pfam_ID=RRM_1; Match level="Score=99.2, E-value=1.1e- 26, Copies=2"; Pfam description=RNA recognition motif. (a.k.a. RRM, R
  misc_feature (185)..(185): Xaa can be any naturally occurring amino acid
  misc_feature (238)..(238): Xaa can be any naturally occurring amino acid
  misc_feature (254)..(254): Xaa can be any naturally occurring amino acid
MAIDYVLVVDEESEYPIELPTEENGNLLLSTVTAQFPGASGLKYKVSVQSRTFRGVRLSDGVLHPPADEGWDNIVFCCVYPKENKRKHDDALEAPASKVKRLESKLNCTDLIVLGLPYKSTEKELKRYFEKYGELLVVQLKTDKEGRSKGYGFIRFAKYECQIKVLSQRHMIEGRWCDVKIPNSXEGSVPLPRRVYVGRLTEDITAEDVRQYFEKFGQVTDVYMPKDFRAFCFVTFFXDPEIAQALCGEDHIIXRSSVYVSDAAPKNNSRKQMIQAKTINIWVLI

SEQ ID NO: 27868 - protein, 92 aa, Diabrotica virgifera
  misc_feature: Coding regions on vcDNA: vcDNA=SeqID_7565; Strand=-; Position=239-517
  misc_feature: Homolog annotation: Hit_ID=BAD07480.1; Match level="QueryCoverage =76%, HitCoverage=11%, E-value=1e-10, Identity=45%"; Hit description =putative transposase yabusame-W [Bombyx mori]
CASCERFSHQATTGVTNCLPLKPEIISFYDVIKGAVDVVDDMKILYSVSRVSCRWSLTIYFSMLNIGGINSRHILYKDNNNKTEKRRVFLKQ

SEQ ID NO: 27869 - protein, 162 aa, Diabrotica virgifera
  misc_feature: Coding regions on vcDNA: vcDNA=SeqID_7566; Strand=+; Position=397-885
  misc_feature: Homolog annotation: Hit_ID=XP_312274.1; Match level="QueryCoverage =95%, HitCoverage=3%, E-value=3e-15, Identity=32%"; Hit description =ENSANGP00000002826 [Anopheles gambiae]
  misc_feature: Gene Ontology Annotation: Molecular function=ubiquitin conjugating enzyme activity; Cellular component=cellular_component unknown; Biological process=anti-apoptosis
  misc_feature (137)..(137): Xaa can be any naturally occurring amino acid
MVTQKATFSTLSEPNTVGDAIFHLLALLARKASDKNLLLKPLLMFLSQVNQLSEPVFWFVLQFLDTEEAVELFFNSGGISILGKNIVNSTNSPSTLSKIGTISTVMQHFSCINSSSDIRSILTAHATKKSAHTFPEXKMSMINFAPYCTISCESSTAQSADV

SEQ ID NO: 27870 - protein, 63 aa, Diabrotica virgifera
  misc_feature: Coding regions on vcDNA: vcDNA=SeqID_7567; Strand=+; Position=250-441
TTQTVCSTPCCSLIDCFSEFLHHALKTNMVDGRIPTNSFTRNARREPILRLKDDLRQLMCLPL

SEQ ID NO: 27871 - protein, 274 aa, Diabrotica virgifera
  misc_feature: Coding regions on vcDNA: vcDNA=SeqID_7568; Strand=-; Position=86-910
  misc_feature (11)..(264): Xaa can be any naturally occurring amino acid
RFDSPIKLRCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNNVSITKRII

SEQ ID NO: 27872 - protein, 81 aa, Diabrotica virgifera
  misc_feature: Coding regions on vcDNA: vcDNA=SeqID_7569; Strand=+; Position=544-789
GLCDGSFERLFSNINIDMIVYTGCPKLYVIYLFEKSTLLSLKLNVQTAKRQVGGNFTLYNNIYLSNKHFLLFLTTVKCISN

SEQ ID NO: 27873 - protein, 248 aa, Diabrotica virgifera
  misc_feature: Coding regions on vcDNA: vcDNA=SeqID_7570; Strand=+; Position=153-895
  misc_feature: Homolog annotation: Hit_ID=AAC47271.1; Match level="QueryCoverage =43%, HitCoverage=15%, E-value=8e-12, Identity=31%"; Hit description =protease, reverse transcriptase and RNase H pir||S68306 pol polyprotein, truncated - red flour beetle retr
  misc_feature (193)..(193): Xaa can be any naturally occurring amino acid
  misc_feature (234)..(234): Xaa can be any naturally occurring amino acid
MIVGVDELAEKHVVIDFKNNTMKLDKEHEKQNTDESGKEQTVEMNLAAKQGQCGSSKEELSPEEENLRVSETKDTWDSSKEETSSGEEEIKQKNESEKNMIETVVFEEDVYANEDAECTVNMCEESEKKDRKLICGEGKEKELRLMLRNYENLINEENRVAKKYEHSFEVKNLGNFRSKTYPIPYKYRQEVKXRINKMLEDQIIERCDSPYVNPIVIVKKRNGELRLCLDARNXHQHTVSQYESPSNI

SEQ ID NO: 27874 - protein, 101 aa, Diabrotica virgifera
  misc_feature: Coding regions on vcDNA: vcDNA=SeqID_7571; Strand=+; Position=90-395
FLPHLPKCPTTSLTPLLPISAIHQPYDQPLIKRPRVAKTIRKMLLTYLQDSNPSDPTFYIVYRSTSWSGCLSLNAVNVPVEAEFQLSFADFTDTDLCSFPG

SEQ ID NO: 27875 - protein, 251 aa, Diabrotica virgifera
  misc_feature: Coding regions on vcDNA: vcDNA=SeqID_7572; Strand=-; Position=0-752
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(178): Xaa can be any naturally occurring amino acid
  misc_feature (186)..(193): Xaa can be any naturally occurring amino acid
  misc_feature (196)..(228): Xaa can be any naturally occurring amino acid
  misc_feature (230)..(243): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVQINRWAXXXXXXXXKDXXXXXXXXXXXXXXXXXXXXXXXXXXXXXXXXXSXXXXXXXXXXXXXXRVRDRERP

SEQ ID NO: 27876 - protein, 262 aa, Diabrotica virgifera
  misc_feature: Coding regions on vcDNA: vcDNA=SeqID_7573; Strand=+; Position=91-876
  misc_feature (22)..(31): Xaa can be any naturally occurring amino acid
  misc_feature (37)..(61): Xaa can be any naturally occurring amino acid
  misc_feature (64)..(260): Xaa can be any naturally occurring amino acid
SQIRERNLFTFLKEKSYFSYLXXXXXXXXXXIIIYLXXXXXXXXXXXXXXXXXXXXXXXXXEIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYR

SEQ ID NO: 27877 - protein, 88 aa, Diabrotica virgifera
  misc_feature: Coding regions on vcDNA: vcDNA=SeqID_7574; Strand=+; Position=299-565
CSYYDYRITDYEYESPRISLRFQNDTLIQEVLNELKCTYSTNINELKCTPNTNVLKVIHVLSIVLILIILISSRMEYLKLKCIVNVTL

SEQ ID NO: 27878 - protein, 66 aa, Diabrotica virgifera
  misc_feature: Coding regions on vcDNA: vcDNA=SeqID_7575; Strand=-; Position=3-200
  misc_feature (3)..(11): Xaa can be any naturally occurring amino acid
  misc_feature (23)..(31): Xaa can be any naturally occurring amino acid
  misc_feature (35)..(46): Xaa can be any naturally occurring amino acid
  misc_feature (48)..(48): Xaa can be any naturally occurring amino acid
  misc_feature (53)..(65): Xaa can be any naturally occurring amino acid
SFXXXXXXXXXIENQPASQRFKXXXXXXXXXEQTXXXXXXXXXXXXSXIEVAXXXXXXXXXXXXXC

SEQ ID NO: 27879 - protein, 222 aa, Diabrotica virgifera
  misc_feature: Coding regions on vcDNA: vcDNA=SeqID_7576; Strand=-; Position=3-668
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(178): Xaa can be any naturally occurring amino acid
  misc_feature (185)..(219): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFKLIGGXXXXXXXXXXXXXXXXXXXXXXXXXXXXXXXXXXXIRF

SEQ ID NO: 27880 - protein, 273 aa, Diabrotica virgifera
  misc_feature: Coding regions on vcDNA: vcDNA=SeqID_7577; Strand=+; Position=1-822
  misc_feature: Homolog annotation: Hit_ID=NP_610922.1; Match level="QueryCoverage =94%, HitCoverage=75%, E-value=1e-94, Identity=68%"; Hit description =CG8067-PA [Drosophila melanogaster] gb|AAF58305.1| CG8067-PA [Drosophila melanogaster]
IKRKFKLAADIGCSRGYVSRHISPDSVEELILCDISESNLNAAVVQDGIKTTKQILDEEHIEFKPNSLDIVISCLSLHWVNDLPKAFKRILLSLKEDGVFLASVFGGDTLYELRSSLQLAELERRGGISPHISPFTEVRDIGSLLTRAGFTMLTIDTDEIIVRYPSMFELMIDLKGMAESNAALNRSLHLHRDTQFAAAALYQQLYGAPDPESGEMSVPATFQIINMLGWKPHPKQPKPIERGSGEVSLKDLHRLDEIIKEVKSIKIDDDDKR

SEQ ID NO: 27881 - protein, 66 aa, Diabrotica virgifera; identical to SEQ ID NO: 26808
  misc_feature: Coding regions on vcDNA: vcDNA=SeqID_7578; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 27882 - protein, 36 aa, Diabrotica virgifera
  misc_feature: Coding regions on vcDNA: vcDNA=SeqID_7579; Strand=+; Position=3-110
KFIVLLNFVIQWKYTTPPFTHTSYTYKLKNYVYIIL

SEQ ID NO: 27883 - protein, 321 aa, Diabrotica virgifera
  misc_feature: Coding regions on vcDNA: vcDNA=SeqID_7580; Strand=+; Position=53-1015
  misc_feature: Homolog annotation: Hit_ID=NP_291079.1; Match level="QueryCoverage =55%, HitCoverage=40%, E-value=8e-16, Identity=32%"; Hit description =B-cell leukemia/lymphoma 3 [Mus musculus] gb|AAC79694.1| BCL3 [Mus musculus] sp|Q9Z2F6|BCL3_MOUSE
  misc_feature: Gene Ontology Annotation: Biological process=cytoplasmic sequestering of NF-kappaB
  misc_feature: Pfam annotation: Pfam_ID=Ank; Match level="Score=54.8, E-value=2.4e -13, Copies=3"; Pfam description=Ankyrin repeat
MFAKPITVRNKVMCIPINQDSVESVALDLTKHCESQTVKTPAKMFRDQGTQVDIDIKPPKPETVSIETNTDITGDIVKKEENWFNLLDFSSLDNDIPQSPFPEGNFDLPGKSMDNSKEYTTLTNAVTGKNVANYSDNSVNTAKNLFMELRQALVNNDEGNLPIHVGVIANNFKLVKRNLFLLKVLKHSVDVPNSHDYTPLQLALIHNSSIEIIEALLAEGASCRTTDSEGNSILHYGAELNRKEALKLLVSFAGLQRCTLNPFNHEGLTPLMVCCLNKNFECAEILLDADARSHIKDQISGRTALFHAAEKHDVEMVEMLL

SEQ ID NO: 27884 - protein, 106 aa, Diabrotica virgifera
  misc_feature: Coding regions on vcDNA: vcDNA=SeqID_7581; Strand=+; Position=88-405
GCFRSIRVYVNAGILTYCHRWFDSDRKTLPLDRPSVSEATADGIYLHYDPVWKMEAMQSVTRRSYICIATLLQGHVTRYTAICNCCTKYVTSTSSHYMQEYNVCIL

SEQ ID NO: 27885 - protein, 74 aa, Diabrotica virgifera
  misc_feature: Coding regions on vcDNA: vcDNA=SeqID_7582; Strand=+; Position=5-229
AACHRGTAGEINIFGALVFSESTIAKYHFKYSTFHIVVVKLTFLIINCLCFKQRGHRTYSFSRGEKSKPQRPNL

SEQ ID NO: 27886 - protein, 86 aa, Diabrotica virgifera
  misc_feature: Coding regions on vcDNA: vcDNA=SeqID_7583; Strand=+; Position=485-745
  misc_feature (76)..(76): Xaa can be any naturally occurring amino acid
STVHRPFWKMIIRVLEMVLTASFERVYPFLKHFRGDGWGTAFPRPVSLTLFRLSDKFTAAFRYWDNVNMLMTRDAXTRPACTLEFF

SEQ ID NO: 27887 - protein, 75 aa, Diabrotica virgifera
  misc_feature: Coding regions on vcDNA: vcDNA=SeqID_7584; Strand=+; Position=20-247
VKFTLNTKINSVYYTTTPNITPIYSQSDVATLAPPTCSMSYLLLLHHGMKVINNLQYISILLHLILTGSNLTLLY

SEQ ID NO: 27888 - protein, 82 aa, Diabrotica virgifera
  misc_feature: Coding regions on vcDNA: vcDNA=SeqID_7585; Strand=-; Position=406-654
TYLVFVEYKTVQCLINHFKRNKKAIFSCRYPFLLILLWYLNSHFRFWGTHFIVFIYPIFIEGTQSGLLLSVKSAGFPTRLDC

SEQ ID NO: 27889 - protein, 305 aa, Diabrotica virgifera
  misc_feature: Coding regions on vcDNA: vcDNA=SeqID_7586; Strand=+; Position=30-944
  misc_feature: Homolog annotation: Hit_ID=XP_311148.1; Match level="QueryCoverage =93%, HitCoverage=64%, E-value=1e-100, Identity=62%"; Hit description= ENSANGP00000004765 [Anopheles gambiae]
  misc_feature: Gene Ontology Annotation: Molecular function=tyrosine-tRNA ligase activity; Cellular component=mitochondrion; Biological process=amino acid activation
  misc_feature: Pfam annotation: Pfam_ID=tRNA-synt_1b; Match level="Score=136.6, E -value=5.9e-38, Copies=1"; Pfam description=tRNA synthetases class I (W and Y)
  misc_feature (151)..(151): Xaa can be any naturally occurring amino acid
  misc_feature (276)..(276): Xaa can be any naturally occurring amino acid
MFIKFLLNRGKTSIICYHRQYSNRNILKLKERGMFEDIFPDNSGNVVTDLMNARPQTVYAGFDPTANSLHVGNLLILINLLHWQRGGHQTIALVGGATAKIGDPSGRNTEREEISKSFIAENIQGLCNNISTIFLNHEKFLWKEKNSLKPXLNNASWYQVMDPVDLIGGAGRYLRMGTLLSRTSVQTRLQSAAGMSFTEFSYQLFQAYDWLHLFKNHNCSFQIGGNDQMGNIMSGQELISKTCKKPVYGLTLPLVTTEMGDKFGKSAGNAVWLSEXKTSAFTFYPVWMRQPRSESEKFLKLVTFD

SEQ ID NO: 27890 - protein, 332 aa, Diabrotica virgifera
  misc_feature: Coding regions on vcDNA: vcDNA=SeqID_7587; Strand=-; Position=1-996
  misc_feature (3)..(11): Xaa can be any naturally occurring amino acid
  misc_feature (18)..(18): Xaa can be any naturally occurring amino acid
  misc_feature (42)..(329): Xaa can be any naturally occurring amino acid
STXXXXXXXXXIINLIHXRGRNLYYRFDFSNKITLLSLKVIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGSR

SEQ ID NO: 27891 - protein, 67 aa, Diabrotica virgifera
  misc_feature: Coding regions on vcDNA: vcDNA=SeqID_7588; Strand=+; Position=58-261
KKMSLSTDRPLGSVYNEKLELAEEANMLLCRSAQWTLMLADIQDLQAKTRSDDTVISPTTSRTTSKI

SEQ ID NO: 27892 - protein, 94 aa, Diabrotica virgifera
  misc_feature: Coding regions on vcDNA: vcDNA=SeqID_7589; Strand=-; Position=2-283
  misc_feature (60)..(67): Xaa can be any naturally occurring amino acid
HLEVGLRTGCPCGPWKPWYLDRVHPFSCQIYKVYFAYYPIKFELIPKFVLQYFNLRPTDXXXXXXXXLVFRIVLFSKKIHLKCPNYYYDVFTKL

SEQ ID NO: 27893 - protein, 188 aa, Diabrotica virgifera
  misc_feature: Coding regions on vcDNA: vcDNA=SeqID_7590; Strand=+; Position=1-566
  misc_feature: Homolog annotation: Hit_ID=CAH04312.1; Match level="QueryCoverage =82%, HitCoverage=64%, E-value=2e-50, Identity=65%"; Hit description =S2e ribosomal protein [Meladema coriacea]
  misc_feature: Gene Ontology Annotation: Molecular function=structural constituent of ribosome; Cellular component=cytosolic small ribosomal subunit (sensu Eukarya); Biological process=protein biosynthesis
  misc_feature: Pfam annotation: Pfam_ID=Ribosomal_S5; Match level="Score=46.3, E -value=8.7e-11, Copies=1"; Pfam description=Ribosomal protein S5, N -terminal doma
  misc_feature (58)..(58): Xaa can be any naturally occurring amino acid
  misc_feature (91)..(91): Xaa can be any naturally occurring amino acid
SCPAEEEGTRQWWTPLQPVNLENSEEVSGGGGRGGSRGGPTIKGRGRGRGRGRDKEDXKKWVPETKLRRLGKDEKSRSPKEIYLFSLPIKXFEIMDHVIESDLNDEVSKIMPVHKETRVGKCTRSQDNVAVGDTKGHIGLGVKCNKEVATAIGGAIILDALTVGAKRIRDWGNKIDRTQTVPSKETEQ

SEQ ID NO: 27894 - protein, 228 aa, Diabrotica virgifera
  misc_feature: Coding regions on vcDNA: vcDNA=SeqID_7591; Strand=+; Position=2-688
  misc_feature: Homolog annotation: Hit_ID=AAK61417.1; Match level="QueryCoverage =100%, HitCoverage=63%, E-value=7e-28, Identity=31%"; Hit description= transposase [Ceratitis rosa]
RRMVFCEEMMNKQNADQNFLKNILFTDESTFSLHRKHNSSIVRYGSRENKHLSIPVRTQYPQKLNVWSGILGDYVIGPFFIEGNLNGTKYLELLQNQIVPAIQQLPNMNLGDIWYQHDGCPSHNTRAVTEYLQRTFPNRLIATNGTIKWPPRSADLSPNDFFFWGFLKSKFYRHNFERAQNLMELIAKIVQYCADITPDQLRHTRESLYDRFTHCSYVQGGLFEPLLH

SEQ ID NO: 27895 - protein, 298 aa, Diabrotica virgifera
  misc_feature: Coding regions on vcDNA: vcDNA=SeqID_7592; Strand=+; Position=2-895
  misc_feature: Homolog annotation: Hit_ID=NP_572756.2; Match level="QueryCoverage =95%, HitCoverage=28%, E-value=1e-63, Identity=34%"; Hit description =CG1886-PA [Drosophila melanogaster] gb|AAF48104.2| CG1886-PA [Drosophila melanogaster]
  misc_feature: Gene Ontology Annotation: Molecular function=copper-exporting ATPase activity; Cellular component=integral to membrane; Biological process=intracellular copper ion transport
  misc_feature: Pfam annotation: Pfam_ID=HMA; Match level="Score=139.4, E-value=8.4e -39, Copies=3"; Pfam description=Heavy-metal-associated domain
  misc_feature (29)..(35): Xaa can be any naturally occurring amino acid
  misc_feature (275)..(275): Xaa can be any naturally occurring amino acid
KYDSNILTPQSVCDYIDEMGFEASLPLLXXXXXXXKESCIVEIKGMTCNSCVQSIEGMISTKEGVQKIHVDLHKGEGYVEFQPSKVTPEQIAEMIEDMGFEAYIKSINDKSVEKNIVTSPKSSKASTSREVDESSKSNLSRCYLQVKGMTCASCVAAIEKHVLKIPGVNKIVISLLGARADIKYNPTEVSPPDIATSITNLGFPSTVIQQSDLDEAEVDIEITGMTCASCVHKIETDVMKLPGLNSAKVALPTKRGKFKYNPEITGPRNIIEAIXTLGFEAQLFEGERQRRLFNIGGN

SEQ ID NO: 27896 - protein, 44 aa, Diabrotica virgifera
  misc_feature: Coding regions on vcDNA: vcDNA=SeqID_7593; Strand=-; Position=2-133
  misc_feature (10)..(44): Xaa can be any naturally occurring amino acid
QKKMGSKIIXXXXXXXXXXXXXXXXXXXXXXXXXXXXXXXXXXX

SEQ ID NO: 27897 - protein, 66 aa, Diabrotica virgifera
  misc_feature: Coding regions on vcDNA: vcDNA=SeqID_7594; Strand=+; Position=531-731
  misc_feature (22)..(29): Xaa can be any naturally occurring amino acid
TFSRYFAFLTYDTERRCVIILXXXXXXXXQPYHSLFFENHYTVECVYSQHPATRMCFCFTSLSIMQ

SEQ ID NO: 27898 - protein, 108 aa, Diabrotica virgifera; identical to SEQ ID NO: 27732
  misc_feature: Coding regions on vcDNA: vcDNA=SeqID_7595; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 27899 - protein, 244 aa, Diabrotica virgifera
  misc_feature: Coding regions on vcDNA: vcDNA=SeqID_7596; Strand=+; Position=3-737
  misc_feature (91)..(103): Xaa can be any naturally occurring amino acid
KDLFTNITIVEDRSKEMSQNETTVYENENSFITKKDDMYFKMKKLRDMECVKMKEASSALWMIKNSANSSWAEELLAESILLETQLRYKLXXXXXXXXXXXXXPIKTRKLTGSVTLSNLQYDIREQDKKSNDCTTFYLLAISHGTVVLTTKAIESIDDNKLIFNETFTLNDLDDDFEIKAEVYSITLNTAKPGIVEKLLKRKPKCCCPSNKIYYENVNTAELKESSILKPSFLSCGEFTIKSNT

SEQ ID NO: 27900 - protein, 45 aa, Diabrotica virgifera
  misc_feature: Coding regions on vcDNA: vcDNA=SeqID_7597; Strand=-; Position=0-134
  misc_feature (1)..(43): Xaa can be any naturally occurring amino acid
XXXXXXXXXXXXXXXXXXXXXXXXXXXXXXXXXXXXXXXXXXXIP

SEQ ID NO: 27901 - protein, 84 aa, Diabrotica virgifera
  misc_feature: Coding regions on vcDNA: vcDNA=SeqID_7598; Strand=+; Position=169-423
IEYKQKLPLYYLFVLLPQHLWLDFYDHHHYGVTTLLEYLPRLLLPSMFVGHVPLSPIISLPFSLDPSLCIPPPEMLIVLISKVC

SEQ ID NO: 27902 - protein, 34 aa, Diabrotica virgifera; identical to SEQ ID NO: 27603
  misc_feature: Coding regions on vcDNA: vcDNA=SeqID_7599; Strand=-; Position=80-184

SEQ ID NO: 27903 - protein, 132 aa, Diabrotica virgifera
  misc_feature: Coding regions on vcDNA: vcDNA=SeqID_7600; Strand=+; Position=501-896
  misc_feature: Homolog annotation: Hit_ID=XP_307274.1; Match level="QueryCoverage =68%, HitCoverage=17%, E-value=1e-10, Identity=38%"; Hit description =ENSANGP00000023005 [Anopheles gambiae]
TFLATTRVEQVEDFEYLGTIIDGKMQKELNNRIAKTSQLYHSLNLGFISKREISKKTKVSVYKTIYLPTLLYGSETWTLTEREKSKIQSSEMKYLRRVGVTLMDKKNETIRNNLDVESANKEKELLRQELAT

SEQ ID NO: 27904 - protein, 117 aa, Diabrotica virgifera
  misc_feature: Coding regions on vcDNA: vcDNA=SeqID_7601; Strand=-; Position=3-353
  misc_feature (2)..(17): Xaa can be any naturally occurring amino acid
  misc_feature (27)..(57): Xaa can be any naturally occurring amino acid
  misc_feature (64)..(71): Xaa can be any naturally occurring amino acid
  misc_feature (74)..(97): Xaa can be any naturally occurring amino acid
  misc_feature (110)..(117): Xaa can be any naturally occurring amino acid
AXXXXXXXXXXXXXXXXDIVVINKCNXXXXXXXXXXXXXXXXXXXXXXXXXXXXXXXSSSYYKXXXXXXXXIKXXXXXXXXXXXXXXXXXXXXXXXXLIKYHSIKFLLAXXXXXXXX

SEQ ID NO: 27905 - protein, 59 aa, Diabrotica virgifera
  misc_feature: Coding regions on vcDNA: vcDNA=SeqID_7602; Strand=+; Position=93-272
  misc_feature (19)..(25): Xaa can be any naturally occurring amino acid
  misc_feature (38)..(48): Xaa can be any naturally occurring amino acid
YLILLEINYVDLLTIYLLXXXXXXXRLMIVMDDLIYKXXXXXXXXXXXMITRLPIDEYE

SEQ ID NO: 27906 - protein, 165 aa, Diabrotica virgifera
  misc_feature: Coding regions on vcDNA: vcDNA=SeqID_7603; Strand=+; Position=18-515
  misc_feature (75)..(81): Xaa can be any naturally occurring amino acid
EVATAPLRMNTRIIDKCMNNVVLVVYTTFLLMCVTVVCEIIQNEELLHDYNVEGRKKSEKSDLLTKILPTLAMPXXXXXXXLPVMLFFLKLTMINSMFLGKLGIFLWFMNYLFNRQNPEGALHSHAININHGRHPDNEGMYSNDPIMKTSNQNSYQNVKRKKRKK

SEQ ID NO: 27907 - protein, 291 aa, Diabrotica virgifera
  misc_feature: Coding regions on vcDNA: vcDNA=SeqID_7604; Strand=-; Position=1-873
  misc_feature (1)..(9): Xaa can be any naturally occurring amino acid
  misc_feature (11)..(291): Xaa can be any naturally occurring amino acid
XXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27908 - protein, 63 aa, Diabrotica virgifera
  misc_feature: Coding regions on vcDNA: vcDNA=SeqID_7605; Strand=+; Position=296-487
NTVCAANLKPRNRLSKFFSRDSIDQRFSICGTCTTGGTFHYLRWYAKLKTAKISTTIGTIIVN

SEQ ID NO: 27909 - protein, 63 aa, Diabrotica virgifera
  misc_feature: Coding regions on vcDNA: vcDNA=SeqID_7606; Strand=-; Position=3-191
  misc_feature (60)..(60): Xaa can be any naturally occurring amino acid
APFSASAMSTQALTKNSNCISLRSQGPHVPAHVRKRLILTHHANIAGQQEKTRYQIHHPXHPK

SEQ ID NO: 27910 - protein, 290 aa, Diabrotica virgifera
  misc_feature: Coding regions on vcDNA: vcDNA=SeqID_7607; Strand=+; Position=25-893
  misc_feature: Homolog annotation: Hit_ID=CAB53677.2; Match level="QueryCoverage =98%, HitCoverage=99%, E-value=8e-86, Identity=48%"; Hit description =hypothetical protein [Homo sapiens] dbj|BAB14145.1| unnamed protein product [Homo sapiens]
  misc_feature: Gene Ontology Annotation: Molecular function=specific RNA polymerase II transcription factor activity; Cellular component=nucleus; Biological process=negative regulation of transcription from Pol II promoter
  misc_feature: Pfam annotation: Pfam_ID=zf-C2H2; Match level="Score=314.6, E-value =1.5e-91, Copies=10"; Pfam description=Zinc finger, C2H2 type
  misc_feature (240)..(240): Xaa can be any naturally occurring amino acid
  misc_feature (258)..(258): Xaa can be any naturally occurring amino acid
ECILGEKPFECEICTKQFSTNLLLTRHIRVHTGEKPFKCEICTKQFSTNSLLTRHIRVHTVEKPFECEICTKQFSTKQVLKAHMRVHTGEKPFECEICTKKFSTKQVLKWHMRVHTGKKPFECEICTKQFSTKQVLKWHMRVHTGEKLFECEICTKQFSTKQVLKGHMRVHTGEKSFECEICTKKFSTKQVLKWHMRVHTGKKPFECEICTKQFLTKQVLKWHMRVHTGKKLFECEICTXQFSKNSLLTRHMRVHTGXKPFECENCTKQFSTKHILKLHMRVHTGEKHLN

SEQ ID NO: 27911 - protein, 54 aa, Diabrotica virgifera
  misc_feature: Coding regions on vcDNA: vcDNA=SeqID_7608; Strand=-; Position=241-405
WSRPRTIKFYKLKTSSQYIALTQRKTVIANLVSSLCSHRVDLLICNSLCHPQGY

SEQ ID NO: 27912 - protein, 105 aa, Diabrotica virgifera
  misc_feature: Coding regions on vcDNA: vcDNA=SeqID_7609; Strand=+; Position=200-518
  misc_feature: Homolog annotation: Hit_ID=AAV68692.1; Match level="QueryCoverage =91%, HitCoverage=21%, E-value=5e-13, Identity=37%"; Hit description =putative IDGF [Diaprepes abbreviatus]
  misc_feature (36)..(36): Xaa can be any naturally occurring amino acid
LIGTWTYQIRLMNEQLYLSQHNCRRVGDINRKFPEXRLVLSDGGDRDASGEDTETSMDYRNGDLRADRKLALTHSDKNLNHYDGVDGIDRGWEMPRTKPKRILRN

SEQ ID NO: 27913 - protein, 37 aa, Diabrotica virgifera
  misc_feature: Coding regions on vcDNA: vcDNA=SeqID_7610; Strand=-; Position=1-114
KRSSIIFVLPRSPAFPRFWNQFAGVISPLRDPFFKGG

SEQ ID NO: 27914 - protein, 186 aa, Diabrotica virgifera
  misc_feature: Coding regions on vcDNA: vcDNA=SeqID_7611; Strand=+; Position=122-682
  misc_feature: Homolog annotation: Hit_ID=NP_650860.1; Match level="QueryCoverage =81%, HitCoverage=48%, E-value=8e-11, Identity=28%"; Hit description =CG4854-PA [Drosophila melanogaster] gb|AAF55735.1| CG4854-PA [Drosophila melanogaster]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=53.4, E-value =6.6e-13, Copies=2"; Pfam description=Zinc finger, C2H2 type
MEVKQEQDIFPVEGCEMKTEVMDFPNDSFHSSVKTEIKEEEHHPLIYEEEDQYVADSLNNDTKSSFVNGCSSNQLNMDISVGDIKLEEEEDKAELVQIDNGCLEKNTETIKTFEHPCHNEQDTGPKKSHQCQICFKIYSRKYGLNKHMLIHAEGKSLHCGICFKSFFHASDLERHARTHTAQKPYQ

SEQ ID NO: 27915 - protein, 110 aa, Diabrotica virgifera
  misc_feature: Coding regions on vcDNA: vcDNA=SeqID_7612; Strand=-; Position=378-710
  misc_feature: Homolog annotation: Hit_ID=ZP_00262347.1; Match level="QueryCoverage =100%, HitCoverage=31%, E-value=5e-37, Identity=76%"; Hit description= COG0547: Anthranilate phosphoribosyltransferase [Pseudomonas fluorescens PfO-1]
  misc_feature (81)..(90): Xaa can be any naturally occurring amino acid
LKDDQSTELFVEPEDPRYKSQSLHGLAVESPAASLELIRDALGRRKTENGQKPPEMIVLNAGAALYAADHAYILKEGVALXXXXXXXXXXREKLEELGAFTAVFKVENEG

SEQ ID NO: 27916 - protein, 53 aa, Diabrotica virgifera
  misc_feature: Coding regions on vcDNA: vcDNA=SeqID_7613; Strand=-; Position=371-532
CLRVPLLFVNKIIRFPIVLTVNIYQQTCSSNKVHLFFHKTSILILYLILIIRN

SEQ ID NO: 27917 - protein, 66 aa, Diabrotica virgifera
  misc_feature: Coding regions on vcDNA: vcDNA=SeqID_7614; Strand=+; Position=1-198
  misc_feature (14)..(22): Xaa can be any naturally occurring amino acid
  misc_feature (24)..(35): Xaa can be any naturally occurring amino acid
  misc_feature (38)..(51): Xaa can be any naturally occurring amino acid
  misc_feature (53)..(63): Xaa can be any naturally occurring amino acid
DQLISIRERIFSFXXXXXXXXXTXXXXXXXXXXXXIYXXXXXXXXXXXXXXIXXXXXXXXXXXSKR

SEQ ID NO: 27918 - protein, 98 aa, Diabrotica virgifera
  misc_feature: Coding regions on vcDNA: vcDNA=SeqID_7615; Strand=+; Position=459-752
SSIRKVCNVRRIVWFGIEWIFGYFGCHNVSKSNIAPYSPIHLQHTDQEDVIFPQIDHRSPKFKVVITSYHPCLLPSFVNYPMEIQLGARIIIERIFHL

SEQ ID NO: 27919 - protein, 45 aa, Diabrotica virgifera
  misc_feature: Coding regions on vcDNA: vcDNA=SeqID_7616; Strand=-; Position=156-293
  misc_feature (20)..(25): Xaa can be any naturally occurring amino acid
FYSFIVGKTSSDTWTFPPLXXXXXXCDHMSSRIFSPNSYIYVHTY

SEQ ID NO: 27920 - protein, 246 aa, Diabrotica virgifera
  misc_feature: Coding regions on vcDNA: vcDNA=SeqID_7617; Strand=-; Position=0-737
  misc_feature (2)..(243): Xaa can be any naturally occurring amino acid
SXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFR

SEQ ID NO: 27921 - protein, 165 aa, Diabrotica virgifera
  misc_feature: Coding regions on vcDNA: vcDNA=SeqID_7618; Strand=-; Position=0-494
  misc_feature (16)..(31): Xaa can be any naturally occurring amino acid
  misc_feature (33)..(104): Xaa can be any naturally occurring amino acid
  misc_feature (116)..(132): Xaa can be any naturally occurring amino acid
  misc_feature (142)..(163): Xaa can be any naturally occurring amino acid
GGGGRLPRPIISIERXXXXXXXXXXXXXXXXGXXXXXXXXXXXXXXXXXXXXXXXXXXXXXXXXXXXXXXXXXXXXXXXXXXXXXXXXXXXXXXXXXXXXXXXXNNKKKEKEEEKXXXXXXXXXXXXXXXXXARGGGPPPWXXXXXXXXXXXXXXXXXXXXXXFP

SEQ ID NO: 27922 - protein, 35 aa, Diabrotica virgifera
  misc_feature: Coding regions on vcDNA: vcDNA=SeqID_7619; Strand=-; Position=1-105
WKGAPLLLLLRCAAGVENVEAIGDGACTVKADVRT

SEQ ID NO: 27923 - protein, 111 aa, Diabrotica virgifera
  misc_feature: Coding regions on vcDNA: vcDNA=SeqID_7620; Strand=-; Position=130-465
IPLYGDPFVFYLEPFSCSNYVVGLLCFSLCIISMSEEALFLRITAGPGLLYIISYLKARCLDSLKQNFTYIAAYTIHIIFALRCIYIVTCMLNMLHLSFVPVWFTENMRVS

SEQ ID NO: 27924 - protein, 225 aa, Diabrotica virgifera
  misc_feature: Coding regions on vcDNA: vcDNA=SeqID_7621; Strand=-; Position=32-709
  misc_feature: Homolog annotation: Hit_ID=XP_318645.1; Match level="QueryCoverage =96%, HitCoverage=26%, E-value=8e-58, Identity=50%"; Hit description =ENSANGP00000020999 [Anopheles gambiae]
  misc_feature: Gene Ontology Annotation: Molecular function=snoRNA binding; Cellular component=small nucleolar ribonucleoprotein complex; Biological process=processing of 20S pre-rRNA
  misc_feature: Pfam annotation: Pfam_ID=WD40; Match level="Score=18.1, E-value =0.027, Copies=1"; Pfam description=WD domain, G-beta repeat
  misc_feature (18)..(18): Xaa can be any naturally occurring amino acid
  misc_feature (60)..(60): Xaa can be any naturally occurring amino acid
  misc_feature (79)..(79): Xaa can be any naturally occurring amino acid
CLGVKGMQILSPGGDGLXKLFSVKTSECTCTLDQHDAQVWAVAVKQDESGLVTGGGDSIXIKWKDVTEELRLKKTPKKXEELTLQEQKLSNYMMSGNYLKALKQALKLDKPFQVLKIVETIIKNGETGLADTIKELRNDQKDNLLKTAITWNTNSKHTHPAQLVINILLNEMQNDTFKPSGLRSALESALPYTERHLNRLTKLMQDLQFINYVVKCMKPHSDDVV

SEQ ID NO: 27925 - protein, 108 aa, Diabrotica virgifera
  misc_feature: Coding regions on vcDNA: vcDNA=SeqID_7622; Strand=-; Position=2-325
  misc_feature (4)..(42): Xaa can be any naturally occurring amino acid
  misc_feature (45)..(55): Xaa can be any naturally occurring amino acid
  misc_feature (65)..(72): Xaa can be any naturally occurring amino acid
  misc_feature (75)..(88): Xaa can be any naturally occurring amino acid
  misc_feature (94)..(107): Xaa can be any naturally occurring amino acid
HASXXXXXXXXXXXXXXXXXXXXXXXXXXXXXXXXXXXXXXXPFXXXXXXXXXXXTNLAHTGLNXXXXXXXXSNXXXXXXXXXXXXXXPTSRSXXXXXXXXXXXXXXV

SEQ ID NO: 27926 - protein, 76 aa, Diabrotica virgifera
  misc_feature: Coding regions on vcDNA: vcDNA=SeqID_7623; Strand=+; Position=122-352
  misc_feature (60)..(66): Xaa can be any naturally occurring amino acid
RNFVCTSSIFLFFLYTFSYLVYIIIIVQFWLILLLKVRYVPLVVYGNNYKIRVSVKQRTXXXXXXXGKQACFVYIS

SEQ ID NO: 27927 - protein, 98 aa, Diabrotica virgifera
  misc_feature: Coding regions on vcDNA: vcDNA=SeqID_7624; Strand=+; Position=1-297
DFVHYRVYSTLTNKIRHKNFSVPSVLTLHFRLPYIQSLFRNSISDKYFFTLFSVIRSFFRTVITISGIHHSRTKKLRHIQISDFFLRFFFVNSTFISV

SEQ ID NO: 27928 - protein, 34 aa, Diabrotica virgifera
  misc_feature: Coding regions on vcDNA: vcDNA=SeqID_7625; Strand=+; Position=1-102
  misc_feature (12)..(19): Xaa can be any naturally occurring amino acid
LVLIFLGWCHVXXXXXXXXFHISFVGLTGKFSSY

SEQ ID NO: 27929 - protein, 124 aa, Diabrotica virgifera
  misc_feature: Coding regions on vcDNA: vcDNA=SeqID_7626; Strand=+; Position=2-376
  misc_feature: Homolog annotation: Hit_ID=XP_393409.1; Match level="QueryCoverage =97%, HitCoverage=5%, E-value=2e-31, Identity=56%"; Hit description =similar to ENSANGP00000022340 [Apis mellifera]
PFKHTVDDGLDIRKAAYERTYTPLDTFLEKSDLAEFINHLERASNDHYDIKTLTHHIIIRPSQISPRSSYSQSMNKLLGPLKSSLEVKVKANSVKQEYEKQEELKKSAEQVIAVLQSIPSAVAC

SEQ ID NO: 27930 - protein, 77 aa, Diabrotica virgifera
  misc_feature: Coding regions on vcDNA: vcDNA=SeqID_7627; Strand=-; Position=2-232
  misc_feature (2)..(11): Xaa can be any naturally occurring amino acid
  misc_feature (14)..(24): Xaa can be any naturally occurring amino acid
  misc_feature (34)..(41): Xaa can be any naturally occurring amino acid
  misc_feature (44)..(57): Xaa can be any naturally occurring amino acid
  misc_feature (63)..(76): Xaa can be any naturally occurring amino acid
MXXXXXXXXXXPFXXXXXXXXXXXTNLAHTGLNXXXXXXXXSNXXXXXXXXXXXXXXPTSRSXXXXXXXXXXXXXXV

SEQ ID NO: 27931 - protein, 106 aa, Diabrotica virgifera
  misc_feature: Coding regions on vcDNA: vcDNA=SeqID_7628; Strand=-; Position=3-320
LPIITLFQHNRSLGNNKDSYPNGKQNGASKENSTAEAHNTPMEGRNTDLSEESDFDDNIADPDFQNDEASYPESTADSSDSSANTGHDSINENYTQQVNQEEHWKG

SEQ ID NO: 27932 - protein, 244 aa, Diabrotica virgifera
  misc_feature: Coding regions on vcDNA: vcDNA=SeqID_7629; Strand=+; Position=2-733
  misc_feature (1)..(21): Xaa can be any naturally occurring amino acid
  misc_feature (31)..(44): Xaa can be any naturally occurring amino acid
  misc_feature (47)..(69): Xaa can be any naturally occurring amino acid
  misc_feature (72)..(88): Xaa can be any naturally occurring amino acid
  misc_feature (90)..(102): Xaa can be any naturally occurring amino acid
  misc_feature (118)..(128): Xaa can be any naturally occurring amino acid
  misc_feature (131)..(139): Xaa can be any naturally occurring amino acid
  misc_feature (153)..(204): Xaa can be any naturally occurring amino acid
  misc_feature (207)..(228): Xaa can be any naturally occurring amino acid
  misc_feature (233)..(239): Xaa can be any naturally occurring amino acid
XXXXXXXXXXXXXXXXXXXXXEEGGARCKKXXXXXXXXXXXXXXTTXXXXXXXXXXXXXXXXXXXXXXXATXXXXXXXXXXXXXXXXXRXXXXXXXXXXXXXRYPIIFYFSFSSPAPXXXXXXXXXXXPPXXXXXXXXXGTPKKRNRKKNNKXXXXXXXXXXXXXXXXXXXXXXXXXXXXXXXXXXXXXXXXXXXXXXXXXXXXDKXXXXXXXXXXXXXXXXXXXXXXPTHPXXXXXXXPLSFF

SEQ ID NO: 27933 - protein, 142 aa, Diabrotica virgifera
  misc_feature: Coding regions on vcDNA: vcDNA=SeqID_7630; Strand=+; Position=18-446
  misc_feature: Homolog annotation: Hit_ID=ZP_00273672.1; Match level="QueryCoverage =92%, HitCoverage=52%, E-value=1e-12, Identity=32%"; Hit description =hypothetical protein Reut02003472 [Ralstonia metallidurans CH34]
MVAWGTQRPGRRFLFRMDRLSHVQVLDEAADVDPSFDLEDYVRREDALNFHSSEDIEIVLKVDEPLMEDGRPRRHPLREFWLAQDQRMQECEGGFELRATVKPSTMLWQLLHGYGCSIEILQPDSIRTSFADNARRLAERYT

SEQ ID NO: 27934 - protein, 303 aa, Diabrotica virgifera
  misc_feature: Coding regions on vcDNA: vcDNA=SeqID_7631; Strand=+; Position=50-958
  misc_feature: Homolog annotation: Hit_ID=EAL33734.1; Match level="QueryCoverage =76%, HitCoverage=54%, E-value=3e-69, Identity=59%"; Hit description =GA15533-PA [Drosophila pseudoobscura]
  misc_feature: Gene Ontology Annotation: Molecular function=transcription factor activity; Cellular component=extracellular space; Biological process= neuron differentiation
  misc_feature: Pfam annotation: Pfam_ID=Fork_head; Match level="Score=256.1, E-value= 6.2e-74, Copies=1"; Pfam description=Fork head domain
  misc_feature (37)..(69): Xaa can be any naturally occurring amino acid
  misc_feature (234)..(239): Xaa can be any naturally occurring amino acid
MVKREDTVLIVPTMARTPLKSSFSISSILPETALEAXXXXXXXXXXXXXXXXXXXXXXXXXXXXXXXXXSPVVDCSKSEEKSSEDKKSKEKPPYSYNALIMMAIRNSPEKRLTLNGIYEYIMCNFPYYRENKQGWQNSIRHNLSLNKCFVKVPRHYDDPGKGNYWMLDPSAEDVFIGGTTGKLRRRSTAASRSRLAAYKRTLSMYSPLQPMYPGFYPPSPALLAAAYQRYHPYXXXXXXTAIPTVLRPSPVQPQPGPQPFSMERLLGATPSVDFFRHLLDLYSSFRLPPPSSMLAHHQMALSP

SEQ ID NO: 27935 - protein, 270 aa, Diabrotica virgifera
  misc_feature: Coding regions on vcDNA: vcDNA=SeqID_7632; Strand=-; Position=11-823
  misc_feature (1)..(7): Xaa can be any naturally occurring amino acid
  misc_feature (11)..(30): Xaa can be any naturally occurring amino acid
  misc_feature (35)..(243): Xaa can be any naturally occurring amino acid
XXXXXXXLPSXXXXXXXXXXXXXXXXXXXXQKDHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDWLFIFAIFGIILKIENSQPNLSARIE

SEQ ID NO: 27936 - protein, 67 aa, Diabrotica virgifera
  misc_feature: Coding regions on vcDNA: vcDNA=SeqID_7633; Strand=-; Position=1-201
  misc_feature (3)..(12): Xaa can be any naturally occurring amino acid
  misc_feature (22)..(30): Xaa can be any naturally occurring amino acid
  misc_feature (35)..(46): Xaa can be any naturally occurring amino acid
  misc_feature (53)..(65): Xaa can be any naturally occurring amino acid
PFXXXXXXXXXXRNQPGSTRLXXXXXXXXXVDQTXXXXXXXXXXXXIQHRGRXXXXXXXXXXXXXLL

SEQ ID NO: 27937 - protein, 67 aa, Diabrotica virgifera
  misc_feature: Coding regions on vcDNA: vcDNA=SeqID_7634; Strand=-; Position=2-202
  misc_feature (4)..(14): Xaa can be any naturally occurring amino acid
  misc_feature (24)..(31): Xaa can be any naturally occurring amino acid
  misc_feature (34)..(47): Xaa can be any naturally occurring amino acid
  misc_feature (53)..(66): Xaa can be any naturally occurring amino acid
GLFXXXXXXXXXXXTNLAHTGLNXXXXXXXXSNXXXXXXXXXXXXXXPTSRSXXXXXXXXXXXXXXV

SEQ ID NO: 27938 - protein, 28 aa, Diabrotica virgifera
  misc_feature: Coding regions on vcDNA: vcDNA=SeqID_7635; Strand=-; Position=9-95
FHQTKQTFFTSTEFLPRNKQYCIQLYVI

SEQ ID NO: 27939 - protein, 172 aa, Diabrotica virgifera
  misc_feature: Coding regions on vcDNA: vcDNA=SeqID_7636; Strand=+; Position=38-556
  misc_feature: Homolog annotation: Hit_ID=NP_908521.1; Match level="QueryCoverage =76%, HitCoverage=16%, E-value=1e-14, Identity=36%"; Hit description =putative transposable element Tip100 protein [Oryza sativa (japonica cultivar-group)]
NDLIDEYSSRLLKNIITKGNQVEYFATSEQLAILIRDVDAEGTKIYERAIGLHHLKDCGAESIANAIQSMLSDKRLDIENCVGQCYDGTNVISGVQARIKDLAPHATYFHCQADRLNLVVVDVLGNIDKVKDFFLQFKLYRFISNTATRHQLFVKIQQRMNKPLLNLERTVT

SEQ ID NO: 27940 - protein, 254 aa, Diabrotica virgifera
  misc_feature: Coding regions on vcDNA: vcDNA=SeqID_7637; Strand=+; Position=126-887
  misc_feature: Homolog annotation: Hit_ID=EAA07114.2; Match level="QueryCoverage =87%, HitCoverage=26%, E-value=1e-66, Identity=53%"; Hit description =ENSANGP00000022084 [Anopheles gambiae str. PEST] ref|XP_559036.1| ENSANGP00000022084 [Anopheles gambiae st
  misc_feature: Gene Ontology Annotation: Molecular function=transporter activity; Cellular component=integral to membrane; Biological process=transport
  misc_feature: Pfam annotation: Pfam_ID=ABC_tran; Match level="Score=62.4, E-value =1.3e-15, Copies=1"; Pfam description=ABC transporter
  misc_feature (232)..(232): Xaa can be any naturally occurring amino acid
  misc_feature (234)..(234): Xaa can be any naturally occurring amino acid
MGGQVLDIFRSKKISENIVEESRDVGVHEDRDVKNERQRVNNLIRDPQNNRSVITVENLHKVYQKGVKSGICSRSAESLKVAIKSISLAVDSAEVFGLLGHNGAGKTTAMKIITAEEAPTRGRVQIVGRNITSSANTAFQYLGYCPQHDAQWKNITVKEHLELYSHIRGIPKNEIKRTVDLYLTGLQIHEHKDKQAEKCSGGTRRKLSYAMAMIGNPKIVLLDEPSTGMDPXSXRFLFLGVQELFFTHTPWKKL

SEQ ID NO: 27941 - protein, 43 aa, Diabrotica virgifera
  misc_feature: Coding regions on vcDNA: vcDNA=SeqID_7638; Strand=+; Position=1-129
  misc_feature: Homolog annotation: Hit_ID=ZP_00263594.1; Match level="QueryCoverage =100%, HitCoverage=24%, E-value=3e-11, Identity=76%"; Hit description= COG5430: Uncharacterized secreted protein [Pseudomonas fluorescens PfO-1]
GGLHGGVGEVRYLGAAAPSIKPIPYRIYADAARRIPLAVDVPV

SEQ ID NO: 27942 - protein, 112 aa, Diabrotica virgifera
  misc_feature: Coding regions on vcDNA: vcDNA=SeqID_7639; Strand=+; Position=248-586
QVSDIRRKLPERMFNLWDGGDLDVIGEKTEGGIKYGNVGQRVGRRLPTPWTEKDLNNYDGVNGYCCRGKMTRTETNCLLRHDLNWLVSDSRKSRSVLNMRTQWQNINSETTS

SEQ ID NO: 27943 - protein, 46 aa, Diabrotica virgifera
  misc_feature: Coding regions on vcDNA: vcDNA=SeqID_7640; Strand=+; Position=1-141
HPHKYQDQLYLSCPYNLSYKITTTPRLIHKDSDTKISPHSEFHLIT

SEQ ID NO: 27944 - protein, 110 aa, Diabrotica virgifera
  misc_feature: Coding regions on vcDNA: vcDNA=SeqID_7641; Strand=-; Position=370-702
LGTILKRLFAHKDVMCEEYIISMKLQLIVNIYNNAIMTVRLHKDTKSMKIKRGIRQGDTLSLKLFTAVLEHAFKQLGVGRQRNKCRRQKALPPLRFADDIVLMIQSIFYS

SEQ ID NO: 27945 - protein, 153 aa, Diabrotica virgifera
  misc_feature: Coding regions on vcDNA: vcDNA=SeqID_7642; Strand=+; Position=255-716
  misc_feature: Homolog annotation: Hit_ID=XP_394647.1; Match level="QueryCoverage =99%, HitCoverage=43%, E-value=1e-39, Identity=50%"; Hit description =similar to ENSANGP00000021759 [Apis mellifera]
MWGRAMLLVLVTSLWLTSTNALQEAEDSQLKVGKSIDLFTRYGYLTLSMKVISRNETDWIFREPTIDIFADIERFATNPERVPKRQRRVFEGDFHMEFCDNVGQLVQAYFRDFTFEKLDQPWKAFTSSWTTETIGRNLGINGSFIAKEHCYVD

SEQ ID NO: 27946 - protein, 85 aa, Diabrotica virgifera
  misc_feature: Coding regions on vcDNA: vcDNA=SeqID_7643; Strand=-; Position=2-256
  misc_feature (3)..(4): Xaa can be any naturally occurring amino acid
  misc_feature (7)..(19): Xaa can be any naturally occurring amino acid
  misc_feature (22)..(32): Xaa can be any naturally occurring amino acid
  misc_feature (42)..(49): Xaa can be any naturally occurring amino acid
  misc_feature (52)..(65): Xaa can be any naturally occurring amino acid
  misc_feature (71)..(84): Xaa can be any naturally occurring amino acid
LLXXRVXXXXXXXXXXXXXPFXXXXXXXXXXXTNLAHTGLNXXXXXXXXSNXXXXXXXXXXXXXXPTSRSXXXXXXXXXXXXXXV

SEQ ID NO: 27947 - protein, 256 aa, Diabrotica virgifera
  misc_feature: Coding regions on vcDNA: vcDNA=SeqID_7644; Strand=+; Position=54-821
  misc_feature: Homolog annotation: Hit_ID=XP_312768.1; Match level="QueryCoverage =82%, HitCoverage=72%, E-value=4e-26, Identity=33%"; Hit description =ENSANGP00000003158 [Anopheles gambiae]
  misc_feature: Gene Ontology Annotation: Molecular function=lipase activity; Cellular component=extracellular; Biological process=digestion
  misc_feature: Pfam annotation: Pfam_ID=Abhydro_lipase; Match level="Score=26.8, E -value=2.7e-06, Copies=1"; Pfam description=ab-hydrolase associated lipase region
MGFKIYISFRSIISITVCKTELDYYTNENCWENNDDDLNTTQILRNWGFTAEEYEINTDDGYGLTIIRGYGTITNPTPIVMGHAVLINSRGFLFLQNSSLAYQIISSGHQIFLINFRGTEYSRKHVNLTSEDREYWNFSWHESGYYDIPKVLELVSNITYGQKAILVGYSMGSTTSLVYATSFPDEAAEKLLGIICLGTASLYKNTPSLLRVVAMLDPIVAPLGLRLWNGRFPIKAEIGPLFELGSSDPILYNMMD

SEQ ID NO: 27948 - protein, 193 aa, Diabrotica virgifera
  misc_feature: Coding regions on vcDNA: vcDNA=SeqID_7645; Strand=+; Position=217-796
  misc_feature: Homolog annotation: Hit_ID=NP_663503.1; Match level="QueryCoverage =95%, HitCoverage=37%, E-value=1e-48, Identity=51%"; Hit description =hypothetical protein D2Ertd391e [Mus musculus] gb|AAH23712.1| Hypothetical protein D2Ertd391e
  misc_feature (163)..(163): Xaa can be any naturally occurring amino acid
  misc_feature (174)..(174): Xaa can be any naturally occurring amino acid
MKLSTQEKRELDKFTKFLALKCTQIIVQSRLGEKVTSNCRSQTTSTDWFNLNISDLPEVLAETKRVLNGEILSSNLPLCVEISLRTVEGDHMVLENWCLGMLPEQQCDPTTRIVHTIYNRMGTLLKSLVSITRVVPAYKLSRRQGPDSFVICYRIFLGEPLIXCLGEDFHKVQXGQICTPIGTLNLFRFVPHQ

SEQ ID NO: 27949 - protein, 26 aa, Diabrotica virgifera
  misc_feature: Coding regions on vcDNA: vcDNA=SeqID_7646; Strand=-; Position=1-81
  misc_feature (9)..(15): Xaa can be any naturally occurring amino acid
  misc_feature (18)..(24): Xaa can be any naturally occurring amino acid
VGLRCENRXXXXXXXLIXXXXXXXIC

SEQ ID NO: 27950 - protein, 38 aa, Diabrotica virgifera
  misc_feature: Coding regions on vcDNA: vcDNA=SeqID_7647; Strand=-; Position=71-187
VFSSKNIITRPNHINVVEPSPFHKDKRQPIIIRLLILQ

SEQ ID NO: 27951 - protein, 75 aa, Diabrotica virgifera
  misc_feature: Coding regions on vcDNA: vcDNA=SeqID_7648; Strand=-; Position=537-764
  misc_feature (22)..(22): Xaa can be any naturally occurring amino acid
VLMSTAHLPSFYRDSCCHLVFXTFMTFRYFAYKINNYKLFIFLFLVTIFRCKKSYLHIKCRYGTISDPVICPLLN

SEQ ID NO: 27952 - protein, 96 aa, Diabrotica virgifera
  misc_feature: Coding regions on vcDNA: vcDNA=SeqID_7649; Strand=+; Position=673-960
WKRKNAEDGEEMRSHKNNTNEKTGISSPHNERERYSLLMLIMQGKIFRKKNVGRRMISWLQILGRGRVAFIKLFQIAPTSKIAGAEPPPRWETNAT

SEQ ID NO: 27953 - protein, 126 aa, Diabrotica virgifera
  misc_feature: Coding regions on vcDNA: vcDNA=SeqID_7650; Strand=-; Position=572-952
  misc_feature (75)..(75): Xaa can be any naturally occurring amino acid
VYIRAEKIWKRMKVECSITKKVENQISFSGTGMYKECQSTGGRKKILNWNSTGRRQRGRPSVRWKTYIGNYMIDXSEKSTGRIVCRASTFHTLRRGTDSLILVNDNLYHIYHGLNPTCLCHWYMYI

SEQ ID NO: 27954 - protein, 209 aa, Diabrotica virgifera
  misc_feature: Coding regions on vcDNA: vcDNA=SeqID_7651; Strand=+; Position=1-627
  misc_feature (1)..(159): Xaa can be any naturally occurring amino acid
  misc_feature (165)..(183): Xaa can be any naturally occurring amino acid
  misc_feature (187)..(204): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTIAYSXXXXXXXXXXXXXXXXXXXQNLXXXXXXXXXXXXXXXXXXRDILT

SEQ ID NO: 27955 - protein, 177 aa, Diabrotica virgifera
  misc_feature: Coding regions on vcDNA: vcDNA=SeqID_7652; Strand=+; Position=119-652
  misc_feature: Homolog annotation: Hit_ID=T30319; Match level="QueryCoverage=90%, HitCoverage=13%, E-value=1e-25, Identity=39%"; Hit description=Lian -Aa1 retrotransposition protein - yellow fever mosquito gb|AAB65093.1| Lian-Aa1
  misc_feature: Pfam annotation: Pfam_ID=RnaseH; Match level="Score=96.2, E-value =8.3e-26, Copies=1"; Pfam description=RNase H
  misc_feature (132)..(132): Xaa can be any naturally occurring amino acid
RLRLQGYTWYTDGSKTVDGWGAGIFCSGENFNISIPLGEYTSVFQAETFAILQRARENSLRAFELQRVNICTDSQAAIGALINPKVNSRLVWECRQELDRLAQHNSVILVWVPGHRGIYGNERADALAKRAXATKYLGPEPAVGVPKSTVRERKKTWIRSQHNSHWESVPGQTHGKM

SEQ ID NO: 27956 - protein, 210 aa, Diabrotica virgifera
  misc_feature: Coding regions on vcDNA: vcDNA=SeqID_7653; Strand=-; Position=102-734
  misc_feature: Homolog annotation: Hit_ID=XP_311699.1; Match level="QueryCoverage =96%, HitCoverage=94%, E-value=3e-57, Identity=50%"; Hit description =ENSANGP00000015021 [Anopheles gambiae]
  misc_feature: Gene Ontology Annotation: Molecular function=thiol-disulfide exchange intermediate activity; Cellular component=intracellular; Biological process=response to oxidative stress
  misc_feature: Pfam annotation: Pfam_ID=Thioredoxin; Match level="Score=7.9, E-value= 2.8e-06, Copies=1"; Pfam description=Thioredoxin
KHRRAFDDAVKGSNLSVVHFQAEWAEQCAQVNELLEALSSQQANSNIKFYSCPAEELSEVSVKYNIEAVPTVILFQSGKNVEVINGADTLKIAEAVKKHSSGSGDSKSEPLEERLKALINKSKVMLFMKGNRDVPRCGFSRKIIDILNSVNASYETFDILSDEEVRQGLKTYSDWPTYPQLYISGELVGGLDIVKEMLESGDLAEAISNA

SEQ ID NO: 27957 - protein, 66 aa, Diabrotica virgifera; identical to SEQ ID NO: 26808
  misc_feature: Coding regions on vcDNA: vcDNA=SeqID_7654; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 27958 - protein, 144 aa, Diabrotica virgifera
  misc_feature: Coding regions on vcDNA: vcDNA=SeqID_7655; Strand=+; Position=134-569
  misc_feature: Homolog annotation: Hit_ID=EAL28923.1; Match level="QueryCoverage =81%, HitCoverage=20%, E-value=4e-13, Identity=37%"; Hit description =GA10768-PA [Drosophila pseudoobscura]
  misc_feature (71)..(71): Xaa can be any naturally occurring amino acid
  misc_feature (78)..(78): Xaa can be any naturally occurring amino acid
  misc_feature (87)..(87): Xaa can be any naturally occurring amino acid
MGPMHERCHCLWYQGKGQNKSSQKTQTTFEKNLELNEYTGQQDSLSLHVFTNKLPPKKSRLKPVMLYIHAXGFIRGSXKTTMYGPEXLMSEHIFLVIRHVQNWSSWYFLKKREINLCTFSGNAGLKDQVLSLKGEHSDVDPREH

SEQ ID NO: 27959 - protein, 223 aa, Diabrotica virgifera
  misc_feature: Coding regions on vcDNA: vcDNA=SeqID_7656; Strand=+; Position=2-673
  misc_feature: Homolog annotation: Hit_ID=XP_309623.1; Match level="QueryCoverage =78%, HitCoverage=60%, E-value=7e-48, Identity=48%"; Hit description =ENSANGP00000011157 [Anopheles gambiae]
SNTKWNSAANSPITPKTSTPSSPAKKITSTATTNDKSKSLQQAPSSSRPSAKQQSPRSVVTRDDLTERNYCGRRFAEDRVQKHEEVCSKTGKKKRKAYDATKHRVMGTELESYILPSKGKAKANNMKVSTKNPPKKDWRRTHEEFIAAIRAAKEAQTHLAKGGKLSDLPPPPPSTNPDYVQCPHCNRRFNEAAAERHIPKCADYQFNKPKPGASKTKPTYGKK

SEQ ID NO: 27960 - protein, 78 aa, Diabrotica virgifera
  misc_feature: Coding regions on vcDNA: vcDNA=SeqID_7657; Strand=-; Position=102-338
PQIFCIFYCVYTFILTNSDHSSLVFSNRVSITTENNAKVVTLHEDGRSICFIANNLNIAMMLLRSILRLDKTKIREKK

SEQ ID NO: 27961 - protein, 77 aa, Diabrotica virgifera
  misc_feature: Coding regions on vcDNA: vcDNA=SeqID_7658; Strand=+; Position=94-324
YTYRIDRSRIIFDNLVMCLTVYGLDDYNEDLNPEGLKVSFWITFNKKFLTSRARISILAISVPNNNSTTSIELLIVP

SEQ ID NO: 27962 - protein, 124 aa, Diabrotica virgifera
  misc_feature: Coding regions on vcDNA: vcDNA=SeqID_7659; Strand=+; Position=765-1136
  misc_feature (12)..(19): Xaa can be any naturally occurring amino acid
  misc_feature (87)..(100): Xaa can be any naturally occurring amino acid
  misc_feature (112)..(118): Xaa can be any naturally occurring amino acid
CCIKNFNITILXXXXXXXXCRTLIELRNSELIYLFRFISCNFYAEFFGFFVFFPTKIYPLPLISKSPGQFQFWGLWGPPKIFGFQKXXXXXXXXXXXXXXGDKPFPPFLTLXXXXXXXTKPSFG

SEQ ID NO: 27963 - protein, 136 aa, Diabrotica virgifera
  misc_feature: Coding regions on vcDNA: vcDNA=SeqID_7660; Strand=-; Position=1-408
  misc_feature: Homolog annotation: Hit_ID=CAD22154.1; Match level="QueryCoverage =94%, HitCoverage=50%, E-value=2e-35, Identity=55%"; Hit description =pherophorin-dz1 protein [Volvox carteri f. nagariensis]
  misc_feature: Gene Ontology Annotation: Molecular function=single-stranded DNA binding; Cellular component=nucleus; Biological process=actin filament organization
  misc_feature (85)..(91): Xaa can be any naturally occurring amino acid
GAARLANPLALPPPRPPPIRPPPMPPLPPAPPPPPAGPLPPPGALNLEGRPALVSLDLNPPSPEPPPRPPPPLRPPPEPKPPLRXXXXXXXEPKPPLLPPAPPPLRPPRPPRPPPRPPPPPPPRPPPPLPPPMRSL

SEQ ID NO: 27964 - protein, 85 aa, Diabrotica virgifera
  misc_feature: Coding regions on vcDNA: vcDNA=SeqID_7661; Strand=+; Position=1-255
  misc_feature (4)..(13): Xaa can be any naturally occurring amino acid
  misc_feature (17)..(34): Xaa can be any naturally occurring amino acid
  misc_feature (38)..(55): Xaa can be any naturally occurring amino acid
  misc_feature (58)..(68): Xaa can be any naturally occurring amino acid
  misc_feature (74)..(85): Xaa can be any naturally occurring amino acid
LANXXXXXXXXXXEGVXXXXXXXXXXXXXXXXXXSKKXXXXXXXXXXXXXXXXXXQVXXXXXXXXXXXHLNGRXXXXXXXXXXXX

SEQ ID NO: 27965 - protein, 66 aa, Diabrotica virgifera
  misc_feature: Coding regions on vcDNA: vcDNA=SeqID_7662; Strand=-; Position=172-372
  misc_feature (43)..(48): Xaa can be any naturally occurring amino acid
DRLISPHAGMHLITRNSLESLGGSFLGQNTRESTNIVLHLDLXXXXXXWNVSLVYGDDSVLYPLSC

SEQ ID NO: 27966 - protein, 101 aa, Diabrotica virgifera
  misc_feature: Coding regions on vcDNA: vcDNA=SeqID_7663; Strand=+; Position=2-307
  misc_feature: Homolog annotation: Hit_ID=XP_309799.1; Match level="QueryCoverage =86%, HitCoverage=12%, E-value=2e-32, Identity=67%"; Hit description =ENSANGP00000012524 [Anopheles gambiae]
  misc_feature: Gene Ontology Annotation: Molecular function=oxysterol binding; Cellular component=cytoplasm
GYAQVEFKNGNKYSWRKVTTTIHNIIVGKLWVDQHGDMEIVGKGPTEGIKCVLKYIPYSYFTRDSQRRVKGVVWIINGTWDDQDEIAIRYWQYRYQWKCCL

SEQ ID NO: 27967 - protein, 45 aa, Diabrotica virgifera
  misc_feature: Coding regions on vcDNA: vcDNA=SeqID_7664; Strand=-; Position=2-136
RMLYYYFRKGDVMMTSFRRLAFSRNCLFNKATKKRRGGSSPSQMS

SEQ ID NO: 27968 - protein, 61 aa, Diabrotica virgifera
  misc_feature: Coding regions on vcDNA: vcDNA=SeqID_7665; Strand=-; Position=215-400
  misc_feature (17)..(23): Xaa can be any naturally occurring amino acid
  misc_feature (28)..(35): Xaa can be any naturally occurring amino acid
  misc_feature (46)..(61): Xaa can be any naturally occurring amino acid
AIFMHPSVTLASSRAPXXXXXXXYYIYXXXXXXXXGSLKNKFTCFXXXXXXXXXXXXXXXX

SEQ ID NO: 27969 - protein, 253 aa, Diabrotica virgifera
  misc_feature: Coding regions on vcDNA: vcDNA=SeqID_7666; Strand=-; Position=53-812
  misc_feature: Homolog annotation: Hit_ID=DAA04499.1; Match level="QueryCoverage =85%, HitCoverage=17%, E-value=9e-37, Identity=35%"; Hit description =TPA: pol polyprotein [Schistosoma mansoni]
  misc_feature: Pfam annotation: Pfam_ID=rve; Match level="Score=73.3, E-value=6.6e -19, Copies=1"; Pfam description=Integrase core domain
  misc_feature (90)..(90): Xaa can be any naturally occurring amino acid
  misc_feature (217)..(217): Xaa can be any naturally occurring amino acid
MEDSLLNEYWKMMTLQRREQLVNQKSRIAEVLRQLHDSPLGGHLGVKKILQRIRERFYWMNNSNDVKDWCKKCTTCATSNGSYRKIKAPXQKVKMIVSRYMLVVIDYFTKWAEIYAIPDQKAATIADVLIKEYISRFGVPLEIHSNQRRNFESDVFQGICDRLGIKKTRTTAYYPQSDEMVERMNKTVGKYLTKMVSNHQRDWDQYLQFFAMAYRSXVNESTGQTPPKVLFSHFSILLFQHSIKSDCRCVATV

SEQ ID NO: 27970 - protein, 222 aa, Diabrotica virgifera
  misc_feature: Coding regions on vcDNA: vcDNA=SeqID_7667; Strand=+; Position=3-672
  misc_feature: Homolog annotation: Hit_ID=AAL83698.1; Match level="QueryCoverage =100%, HitCoverage=27%, E-value=3e-62, Identity=55%"; Hit description= translation elongation factor 2 [Spodoptera exigua]
  misc_feature: Gene Ontology Annotation: Molecular function=ATP binding; Cellular component=nucleolus; Biological process=protein biosynthesis
  misc_feature: Pfam annotation: Pfam_ID=GTP_EFTU; Match level="Score=-36.0, E-value =0.00024, Copies=1"; Pfam description=Elongation factor Tu GTP binding domai
  misc_feature (76)..(76): Xaa can be any naturally occurring amino acid
  misc_feature (110)..(116): Xaa can be any naturally occurring amino acid
  misc_feature (168)..(168): Xaa can be any naturally occurring amino acid
  misc_feature (182)..(182): Xaa can be any naturally occurring amino acid
  misc_feature (191)..(191): Xaa can be any naturally occurring amino acid
DGQEQWITIESTAISMFFQVHDKDLVPVTTADQRDKDETGFLINLIDSPAHAHFSSKVVNCASGVCVLTETVLRQXIAERITSILFLNKMHRALLQLLLESEELYQTFQXXXXXXXAIIATYNDDSGPMRELKADPSNGSAGCGSGLLGRDIALRHFPEMDADTFFIXASKLMNRVRGENFXNADISHVCXHLDGDLTLSYCMHVLHALHSTLDSIMPYTRE

SEQ ID NO: 27971 - protein, 224 aa, Diabrotica virgifera
  misc_feature: Coding regions on vcDNA: vcDNA=SeqID_7668; Strand=+; Position=110-786
  misc_feature: Homolog annotation: Hit_ID=EAA06020.2; Match level="QueryCoverage =84%, HitCoverage=39%, E-value=4e-37, Identity=49%"; Hit description =ENSANGP00000005638 [Anopheles gambiae str. PEST] ref|XP_559659.1| ENSANGP00000005638 [Anopheles gambiae st
  misc_feature: Gene Ontology Annotation: Molecular function=magnesium ion binding; Cellular component=cytoplasm; Biological process=proteolysis and peptidolysis
  misc_feature: Pfam annotation: Pfam_ID=Peptidase_M17_N; Match level="Score=83.2, E -value=6.8e-22, Copies=1"; Pfam description=Cytosol aminopeptidase family, N-term
  misc_feature (169)..(169): Xaa can be any naturally occurring amino acid
  misc_feature (192)..(192): Xaa can be any naturally occurring amino acid
MALRSHHMRYFRLCSNINNFGFVRFSSTAGVSKKGLVLGVRTSSTDEVILTPAATKYNEISQGKLLQQFKLAGNEIKAGKCFVFWGLDPEYNAVAVTGLGKDTDKQDDIELICQENENVRIAASAGCRALESVGVKNIDVEDFCNAEAAAEGSNLGIWKFQEYKSKKRXLPQVQLSQLNGSGVAEDWQKGVXKAEAQNLARKLADTPANLLTPTIFLRTRPIEF

SEQ ID NO: 27972 - protein, 92 aa, Diabrotica virgifera
  misc_feature: Coding regions on vcDNA: vcDNA=SeqID_7669; Strand=-; Position=634-912
  misc_feature (64)..(71): Xaa can be any naturally occurring amino acid
IPGYLFFILEEEGKMFSLEVFREGIFRYNVWIFESIMGIFLGFYERKISQPLHVLLLGLGTPSXXXXXXXXISNLPSLEQKPYVSYLSLDIF

SEQ ID NO: 27973 - protein, 69 aa, Diabrotica virgifera
  misc_feature: Coding regions on vcDNA: vcDNA=SeqID_7670; Strand=-; Position=228-437
LHYHIGSINDRFKKIRRTIFIFHTAKLNLTRRSSISPGLDHEMATLMNFSFVILVVLTFKNILSKCSCH

SEQ ID NO: 27974 - protein, 58 aa, Diabrotica virgifera
  misc_feature: Coding regions on vcDNA: vcDNA=SeqID_7671; Strand=+; Position=165-338
PPKLESPTNREKNPLEEHLLGGGGFFPPFFTPRRKKKNIARPPLYLLVWGSRLPPPPP

SEQ ID NO: 27975 - protein, 176 aa, Diabrotica virgifera
  misc_feature: Coding regions on vcDNA: vcDNA=SeqID_7672; Strand=-; Position=2-529
  misc_feature (69)..(78): Xaa can be any naturally occurring amino acid
  misc_feature (95)..(102): Xaa can be any naturally occurring amino acid
  misc_feature (123)..(133): Xaa can be any naturally occurring amino acid
  misc_feature (142)..(142): Xaa can be any naturally occurring amino acid
  misc_feature (157)..(157): Xaa can be any naturally occurring amino acid
ILMRISKNLECQVLEFFRLFILLFHLHCIRDFFNSNTVWSIFIFSCIKGRIIYRNFYMCTNCFFCITYXXXXXXXXXXFHLHFIRTLFNFRTVWXXXXXXXXKVWIIYRNLFSCPPCFLCLAXXXXXXXXXXXVSLLFPLRXCFRVSAAWVFSSVSXPVGFLSRPASFVFFFLFAF

SEQ ID NO: 27976 - protein, 200 aa, Diabrotica virgifera
  misc_feature: Coding regions on vcDNA: vcDNA=SeqID_7673; Strand=+; Position=2-601
  misc_feature: Homolog annotation: Hit_ID=NP_651000.1; Match level="QueryCoverage =89%, HitCoverage=48%, E-value=4e-39, Identity=48%"; Hit description =CG6439-PA [Drosophila melanogaster] gb|AAF55942.1| CG6439-PA [Drosophila melanogaster]
  misc_feature: Gene Ontology Annotation: Molecular function=isocitrate dehydrogenase (NAD+) activity; Cellular component=mitochondrial matrix; Biological process=TCA intermediate metabolism
  misc_feature (57)..(62): Xaa can be any naturally occurring amino acid
LQFLPKTRTRGLSSGRGERPGAKTTGPWIPGEGGGPKLGFSAPKGFRGGGNPGDLDXXXXXXENPPLRAPLKKEVESFSRNRVGWKGIWVTPNYGHTGEWQTLNRKLKKALVLYPRGVLEKSLPGAKSRPRNLEGVFIKKQTEGKYSALEHEGEKGEEKGLKLVTAKKPQKMANFAFDYATKNNGKKVPVVHKANIMKWG

SEQ ID NO: 27977 - protein, 104 aa, Diabrotica virgifera
  misc_feature: Coding regions on vcDNA: vcDNA=SeqID_7674; Strand=-; Position=148-462
SRTGPTLYPHYFSVSKIYDKFSFKRTPNHPKSSGRMYKHFQFLCNTKMQQLHNTLVKSESAGRVYTGFGGFFLISSPISSSLRFPQVSYFGPFRIAKNEMSRMN

SEQ ID NO: 27978 - protein, 239 aa, Diabrotica virgifera
  misc_feature: Coding regions on vcDNA: vcDNA=SeqID_7675; Strand=+; Position=5-721
  misc_feature: Homolog annotation: Hit_ID=AAR89978.1; Match level="QueryCoverage =80%, HitCoverage=41%, E-value=3e-75, Identity=75%"; Hit description =putative elongation factor 1-alpha [Homalodisca coagulata] gb|AAS60203.1| putative elongation factor 1-alp
  misc_feature: Pfam annotation: Pfam_ID=GTP_EFTU; Match level="Score=44.6, E-value =2.9e-10, Copies=1"; Pfam description=Elongation factor Tu GTP binding domai
  misc_feature (2)..(27): Xaa can be any naturally occurring amino acid
  misc_feature (29)..(46): Xaa can be any naturally occurring amino acid
  misc_feature (66)..(73): Xaa can be any naturally occurring amino acid
  misc_feature (94)..(104): Xaa can be any naturally occurring amino acid
  misc_feature (145)..(157): Xaa can be any naturally occurring amino acid
  misc_feature (177)..(188): Xaa can be any naturally occurring amino acid
MXXXXXXXXXXXXXXXXXXXXXXXXXXIXXXXXXXXXXXXXXXXXXQEMGKGSFKYAWVLDKLKAXXXXXXXXDIALWKFETAKYYVTIIDAPXXXXXXXXXXXGTSQADCAVLIVAAGTGEFEAGISKNGQTREHALLAFTLGXXXXXXXXXXXXXTEPAYSESRFEEIKKEVSSXXXXXXXXXXXXAFVPISGWHGDNMLEGSDKMPWFKGWQIERKEGKAEGKCLIEALDAILPPI

SEQ ID NO: 27979 - protein, 101 aa, Diabrotica virgifera
  misc_feature: Coding regions on vcDNA: vcDNA=SeqID_7676; Strand=+; Position=247-552
  misc_feature: Homolog annotation: Hit_ID=YP_003151.1; Match level="QueryCoverage =94%, HitCoverage=23%, E-value=6e-10, Identity=37%"; Hit description =isocitrate dehydrogenase [Leptospira interrogans serovar Copenhageni str. Fiocruz L1-130]
  misc_feature: Gene Ontology Annotation: Molecular function=isocitrate dehydrogenase (NADP+) activity; Cellular component=cytosol; Biological process =glutathione metabolism
  misc_feature (40)..(40): Xaa can be any naturally occurring amino acid
  misc_feature (64)..(64): Xaa can be any naturally occurring amino acid
GSTIMIYIVGITRAALTPDDNGVFDLEIKHMRKSPNGAIXDIIQCTVVLVPFIRKNIPREIWRXYKPINVDKNTLTDLYISSDDILPIAEYLDLIFTGAFA

SEQ ID NO: 27980 - protein, 302 aa, Diabrotica virgifera
  misc_feature: Coding regions on vcDNA: vcDNA=SeqID_7677; Strand=+; Position=3-911
  misc_feature (3)..(17): Xaa can be any naturally occurring amino acid
  misc_feature (19)..(44): Xaa can be any naturally occurring amino acid
  misc_feature (46)..(57): Xaa can be any naturally occurring amino acid
  misc_feature (60)..(196): Xaa can be any naturally occurring amino acid
  misc_feature (199)..(267): Xaa can be any naturally occurring amino acid
  misc_feature (271)..(271): Xaa can be any naturally occurring amino acid
  misc_feature (274)..(274): Xaa can be any naturally occurring amino acid
  misc_feature (276)..(276): Xaa can be any naturally occurring amino acid
  misc_feature (279)..(279): Xaa can be any naturally occurring amino acid
  misc_feature (284)..(299): Xaa can be any naturally occurring amino acid
RIXXXXXXXXXXXXXXXTXXXXXXXXXXXXXXXXXXXXXXXXXXHXXXXXXXXXXXXETXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAHXXXXXXXXXXXXXXXXXXXXXXXXXXXXXXXXXXXXXXXXXXXXXXXXXXXXXXXXXXXXXXXXXXXXXFFRXKFXYXIIXLIWGXXXXXXXXXXXXXXXXKNF

SEQ ID NO: 27981 - protein, 66 aa, Diabrotica virgifera
  misc_feature: Coding regions on vcDNA: vcDNA=SeqID_7678; Strand=-; Position=2-199
  misc_feature (3)..(12): Xaa can be any naturally occurring amino acid
  misc_feature (21)..(21): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PFXXXXXXXXXXETNLAHTGXNXXXXXXXXSNXXXXXXXXXXXXXXPTSRSXXXXXXXXXXXXXXV

SEQ ID NO: 27982 - protein, 94 aa, Diabrotica virgifera
  misc_feature: Coding regions on vcDNA: vcDNA=SeqID_7679; Strand=-; Position=180-464
TDSPSGTPSSVKAGLTCRVSFIVSANKPGRSRNVRTSEICCYLAFRSGITLYWSILHESDICLWDWISWIQVLQGFASRLSSYLSSYSSSVILL

SEQ ID NO: 27983 - protein, 99 aa, Diabrotica virgifera
  misc_feature: Coding regions on vcDNA: vcDNA=SeqID_7680; Strand=-; Position=91-390
  misc_feature (9)..(66): Xaa can be any naturally occurring amino acid
  misc_feature (69)..(77): Xaa can be any naturally occurring amino acid
  misc_feature (88)..(88): Xaa can be any naturally occurring amino acid
  misc_feature (93)..(93): Xaa can be any naturally occurring amino acid
LYSFSLLDXXXXXXXXXXXXXXXXXXXXXXXXXXXXXXXXXXXXXXXXXXXXXXXXXXXXXXXXXXSLXXXXXXXXXDRTQPGPYPFXPDHVXFKVDQT

SEQ ID NO: 27984 - protein, 124 aa, Diabrotica virgifera
  misc_feature: Coding regions on vcDNA: vcDNA=SeqID_7681; Strand=-; Position=1-372
  misc_feature (4)..(10): Xaa can be any naturally occurring amino acid
  misc_feature (15)..(21): Xaa can be any naturally occurring amino acid
  misc_feature (35)..(43): Xaa can be any naturally occurring amino acid
  misc_feature (45)..(58): Xaa can be any naturally occurring amino acid
  misc_feature (65)..(77): Xaa can be any naturally occurring amino acid
  misc_feature (79)..(124): Xaa can be any naturally occurring amino acid
IYLXXXXXXXMWSYXXXXXXXLKDRNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXX

SEQ ID NO: 27985 - protein, 56 aa, Diabrotica virgifera
  misc_feature: Coding regions on vcDNA: vcDNA=SeqID_7682; Strand=+; Position=100-270
CSIRRICILALIDHESHYPGLGAMKRRTIIAISPKRARGNCIKIWIPQTVTGRAQD

SEQ ID NO: 27986 - protein, 186 aa, Diabrotica virgifera
  misc_feature: Coding regions on vcDNA: vcDNA=SeqID_7683; Strand=-; Position=1-558
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(186): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27987 - protein, 150 aa, Diabrotica virgifera
  misc_feature: Coding regions on vcDNA: vcDNA=SeqID_7684; Strand=+; Position=15-467
  misc_feature: Homolog annotation: Hit_ID=XP_318689.1; Match level="QueryCoverage =100%, HitCoverage=98%, E-value=2e-47, Identity=56%"; Hit description= ENSANGP00000010318 [Anopheles gambiae] gb|EAA13833.1| ENSANGP00000010318 [Anopheles gambiae
  misc_feature: Gene Ontology Annotation: Biological process=positive regulation of embryonic development
  misc_feature: Pfam annotation: Pfam_ID=GRIM-19; Match level="Score=206.0, E-value =7.7e-59, Copies=1"; Pfam description=GRIM-19 protein
MSKVEFKQDMPPQGGYNPINYKRVPAKTLFGGWALIGGYLGMTAGAAYLYYLNVKAVKTRELELKGASLALYPILMAERDREYMKQLRRNRDEERELMKNVEGWQTGTWYGEPIYKTKDKDTLIHPLFHEYYIHSSYKDYTVRANVGLMS

SEQ ID NO: 27988 - protein, 243 aa, Diabrotica virgifera
  misc_feature: Coding regions on vcDNA: vcDNA=SeqID_7685; Strand=+; Position=223-955
  misc_feature: Homolog annotation: Hit_ID=XP_397177.1; Match level="QueryCoverage =73%, HitCoverage=15%, E-value=1e-78, Identity=75%"; Hit description =similar to hypothetical protein A930013K19 [Apis mellifera]
  misc_feature: Pfam annotation: Pfam_ID=IRS; Match level="Score=2.5, E-value=8.7e -05, Copies=1"; Pfam description=PTB domain (IRS-1 type)
  misc_feature (180)..(180): Xaa can be any naturally occurring amino acid
MVDNSCVIEGTVKFRDGKKWKSRWCVMRKLSPVADCLHLQLYRDSKDRYKQGQTKASLSLEHFLGLETGFTLDKESNTVAILCQDVVVVLAFDNRERLMQWQVKLSSHLNDGPHFLVLVSSAPPKSRLPPGPARLHVQERGFCLTTGVPPRVAGQWLISNLRRYGVVEGRFCFEGGSRCXRGEGLYVLLTDQGEKIPDPLKGAFGREFGFFPGKRAGFKKKWSGVGKAPRKGHHAGAPGRNKE

SEQ ID NO: 27989 - protein, 78 aa, Diabrotica virgifera
  misc_feature: Coding regions on vcDNA: vcDNA=SeqID_7686; Strand=-; Position=22-258
RLIFKNAWDCILFQLRICQISVKKLVSICWSNQNVFYDTTELASYCKIFTVNRSNSLITKVIVFGKRECTLGLFDILK

SEQ ID NO: 27990 - protein, 226 aa, Diabrotica virgifera
  misc_feature: Coding regions on vcDNA: vcDNA=SeqID_7687; Strand=-; Position=1-678
  misc_feature (5)..(13): Xaa can be any naturally occurring amino acid
  misc_feature (35)..(43): Xaa can be any naturally occurring amino acid
  misc_feature (55)..(67): Xaa can be any naturally occurring amino acid
  misc_feature (69)..(226): Xaa can be any naturally occurring amino acid
SLLCXXXXXXXXXRNQTWVHPGLTSGSCKILKVGXXXXXXXXXNYNFNPTSEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27991 - protein, 131 aa, Diabrotica virgifera
  misc_feature: Coding regions on vcDNA: vcDNA=SeqID_7688; Strand=+; Position=201-596
  misc_feature: Homolog annotation: Hit_ID=EAA01376.2; Match level="QueryCoverage =68%, HitCoverage=100%, E-value=5e-16, Identity=50%"; Hit description= ENSANGP00000022169 [Anopheles gambiae str. PEST] ref|XP_551168.1| ENSANGP00000022169 [Anopheles gambiae s
  misc_feature: Pfam annotation: Pfam_ID=PAM2; Match level="Score=21.3, E-value =0.0031, Copies=1"; Pfam description=Ataxin-2 C-terminal region
KCLATRKQITGHYEYEENSYFTEGIENNVVEDFNTAPENDFSEYMWMEHEEEFDKEVMQRLEEEALMEECLQAFMNDENNLANTQLQDVNSAQSQQSVPAPESIANSKLNPEAAEFVPSSRRATQVPTSSS

SEQ ID NO: 27992 - protein, 128 aa, Diabrotica virgifera
  misc_feature: Coding regions on vcDNA: vcDNA=SeqID_7689; Strand=+; Position=63-449
  misc_feature (116)..(123): Xaa can be any naturally occurring amino acid
LMIFYELYIMYFYHSFTCLLMLWTLVRYSLVVIYSSFFFSKVLKLLSCGGRLRTPPRYLDFNGFSFIVGLKATTNCPTLPRYLDNIFVNIYSFYFTLFTYFTIVFKKEPNSQSMSXXXXXXXXETITI

SEQ ID NO: 27993 - protein, 73 aa, Diabrotica virgifera
  misc_feature: Coding regions on vcDNA: vcDNA=SeqID_7690; Strand=-; Position=164-385
  misc_feature (7)..(28): Xaa can be any naturally occurring amino acid
  misc_feature (30)..(54): Xaa can be any naturally occurring amino acid
SRFRTSXXXXXXXXXXXXXXXXXXXXXXGXXXXXXXXXXXXXXXXXXXXXXXXXIRINYLRDNSVILLESSNR

SEQ ID NO: 27994 - protein, 26 aa, Diabrotica virgifera
  misc_feature: Coding regions on vcDNA: vcDNA=SeqID_7691; Strand=-; Position=3-80
MGNWCEVSIKMKLDSFLFRSWIKTTS

SEQ ID NO: 27995 - protein, 66 aa, Diabrotica virgifera
  misc_feature: Coding regions on vcDNA: vcDNA=SeqID_7692; Strand=+; Position=2-199
  misc_feature: Homolog annotation: Hit_ID=EAL40266.1; Match level="QueryCoverage =86%, HitCoverage=12%, E-value=1e-09, Identity=49%"; Hit description =ENSANGP00000026826 [Anopheles gambiae str. PEST] ref|XP_557830.1| ENSANGP00000026826 [Anopheles gambiae st
  misc_feature (13)..(13): Xaa can be any naturally occurring amino acid
VDVPSACSQFEHXITYLPESILKERYRNLLLSSSHTDGGHFAAFEAPNVLAKDTYDFVYLYVFIIS

SEQ ID NO: 27996 - protein, 199 aa, Diabrotica virgifera
  misc_feature: Coding regions on vcDNA: vcDNA=SeqID_7693; Strand=-; Position=96-696
  misc_feature: Homolog annotation: Hit_ID=NP_647847.1; Match level="QueryCoverage =100%, HitCoverage=58%, E-value=8e-45, Identity=45%"; Hit description= CG1134-PA [Drosophila melanogaster] gb|AAF47822.1| CG1134-PA [Drosophila melanogaster]
  misc_feature: Pfam annotation: Pfam_ID=zf-C3HC4; Match level="Score=20.5, E-value =0.0002, Copies=1"; Pfam description=Zinc finger, C3HC4 type (RING finger)
  misc_feature (13)..(13): Xaa can be any naturally occurring amino acid
  misc_feature (31)..(31): Xaa can be any naturally occurring amino acid
MDVISDNFHPTVXSVIDHIWSFFAGIRQRGXQSQEKMLRTGSVITGIGELVSEKDGNLKLQPPTEGESFYLTNMGILSLLKKLNSSKSNYRIMCIVFGSIGIVISGFIVKKYLRIKSEKESEEQQRSQLELSRKERRRKIRDEDLNENQICVVCKENPKEIILLPCGHVCLCEDCALGINEFCPICRSHIERKNVAYVA

SEQ ID NO: 27997 - protein, 169 aa, Diabrotica virgifera
  misc_feature: Coding regions on vcDNA: vcDNA=SeqID_7694; Strand=+; Position=65-571
  misc_feature: Homolog annotation: Hit_ID=CAE47502.1; Match level="QueryCoverage =97%, HitCoverage=50%, E-value=2e-32, Identity=48%"; Hit description =cathepsin B-like proteinase [Diabrotica virgifera virgifera]
  misc_feature: Gene Ontology Annotation: Molecular function=peroxidase activity; Cellular component=extracellular space; Biological process=protein targeting
  misc_feature (85)..(92): Xaa can be any naturally occurring amino acid
  misc_feature (128)..(147): Xaa can be any naturally occurring amino acid
ATISQVLDSFDASENWIVCSDVINTIGDQSGCLSGCPVAAASAMSDRGCIRSQAKFRVPVSAENLMVCIASGCDGGSLEDEWCLXXXXXXXXGGLYGSIQVCQPYSLPPCEHNTTGTKVQWRILKLNXXXXXXXXXXXXXXXXXXXXVASRPSYSCTTVANMLKEMLSN

SEQ ID NO: 27998 - protein, 137 aa, Diabrotica virgifera
  misc_feature: Coding regions on vcDNA: vcDNA=SeqID_7695; Strand=-; Position=3-413
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(132): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXGVIKK

SEQ ID NO: 27999 - protein, 331 aa, Diabrotica virgifera
  misc_feature: Coding regions on vcDNA: vcDNA=SeqID_7696; Strand=-; Position=1-993
  misc_feature (7)..(39): Xaa can be any naturally occurring amino acid
  misc_feature (54)..(76): Xaa can be any naturally occurring amino acid
  misc_feature (92)..(120): Xaa can be any naturally occurring amino acid
  misc_feature (139)..(158): Xaa can be any naturally occurring amino acid
  misc_feature (163)..(219): Xaa can be any naturally occurring amino acid
  misc_feature (222)..(243): Xaa can be any naturally occurring amino acid
  misc_feature (248)..(266): Xaa can be any naturally occurring amino acid
  misc_feature (273)..(305): Xaa can be any naturally occurring amino acid
  misc_feature (307)..(331): Xaa can be any naturally occurring amino acid
HTHHTQXXXXXXXXXXXXXXXXXXXXXXXXXXXXXXXXXGRGPPRAPRPRPRLXXXXXXXXXXXXXXXXXXXXXXXHPPHPAHPRPRRPGRXXXXXXXXXXXXXXXXXXXXXXXXXXXXXQPPPPTHTPHTPTSGGRVXXXXXXXXXXXXXXXXXXXXHPLPXXXXXXXXXXXXXXXXXXXXXXXXXXXXXXXXXXXXXXXXXXXXXXXXXXXXXXXXXPPXXXXXXXXXXXXXXXXXXXXXXKGGVXXXXXXXXXXXXXXXXXXXGRGGWEXXXXXXXXXXXXXXXXXXXXXXXXXXXXXXXXXEXXXXXXXXXXXXXXXXXXXXXXXXX

SEQ ID NO: 28000 - protein, 72 aa, Diabrotica virgifera
  misc_feature: Coding regions on vcDNA: vcDNA=SeqID_7697; Strand=+; Position=3-221
  misc_feature (8)..(21): Xaa can be any naturally occurring amino acid
  misc_feature (23)..(29): Xaa can be any naturally occurring amino acid
  misc_feature (37)..(47): Xaa can be any naturally occurring amino acid
  misc_feature (51)..(61): Xaa can be any naturally occurring amino acid
CHLFSNNXXXXXXXXXXXXXXLXXXXXXXPFYLSSRXXXXXXXXXXXLLLXXXXXXXXXXXTPKELTIFIVQ

SEQ ID NO: 28001 - protein, 91 aa, Diabrotica virgifera
  misc_feature: Coding regions on vcDNA: vcDNA=SeqID_7698; Strand=-; Position=48-323
  misc_feature: Homolog annotation: Hit_ID=XP_453846.1; Match level="QueryCoverage =56%, HitCoverage=42%, E-value=1e-13, Identity=74%"; Hit description =unnamed protein product [Kluyveromyces lactis] emb|CAH00942.1| unnamed protein product
LLLNLVRLEAACPSKKNCVYADSKNRVQQEQETPPTGLWDVEIRLVSRLESRSLSELTRQIAPPTKNGHAPPPTESRKSSQSVNPSGVRAW

SEQ ID NO: 28002 - protein, 100 aa, Diabrotica virgifera
  misc_feature: Coding regions on vcDNA: vcDNA=SeqID_7699; Strand=+; Position=324-621
  misc_feature: Homolog annotation: Hit_ID=EAL28529.1; Match level="QueryCoverage =93%, HitCoverage=28%, E-value=2e-21, Identity=63%"; Hit description =GA13321-PA [Drosophila pseudoobscura]
  misc_feature: Gene Ontology Annotation: Cellular component=signalosome complex; Biological process=glia cell migration
  misc_feature (79)..(79): Xaa can be any naturally occurring amino acid
LHTACDTKHQPDIRCPIPCDKDPHVFKDIKIAASALLIIDMHERPGGTLEVMGLILRKLHVNTMIVMCSFALPVRCTEXTRDTALAHPYEYMTAYVEAPQ

SEQ ID NO: 28003 - protein, 47 aa, Diabrotica virgifera
  misc_feature: Coding regions on vcDNA: vcDNA=SeqID_7700; Strand=-; Position=259-402
  misc_feature (24)..(31): Xaa can be any naturally occurring amino acid
DFIQLLISLFSIKFTFTINLFHWXXXXXXXXFFYPIIVINHFLIPFF

SEQ ID NO: 28004 - protein, 280 aa, Diabrotica virgifera
  misc_feature: Coding regions on vcDNA: vcDNA=SeqID_7701; Strand=+; Position=29-868
  misc_feature: Homolog annotation: Hit_ID=XP_396239.1; Match level="QueryCoverage =90%, HitCoverage=28%, E-value=2e-39, Identity=38%"; Hit description =similar to Hypothetical protein CBG23143 [Apis mellifera]
  misc_feature: Pfam annotation: Pfam_ID=PDZ; Match level="Score=18.6, E-value =0.0097, Copies=1"; Pfam description=PDZ domain (Also known as DHR or GLGF
TPQEKSPLSVLNVKSEKSEKKRTLDDSALGEKEVKVISLRSEDFTGLGFNICGNMREGIYIKDVLHRGPAYDSGKLNSGDRINSVTINFEHMVYEDALAILSYASPYEVVIEAKGGKLIHNVPGQGGQPGHPVYKSSSHLDLYNVDKTGKKKNDSGSLDSNYSSLKKSISNMTTLERKESNSPRINATPKKIVNNINPEHLKVQLEQRIDNHAKGKDQEPMEMETQKTENKFPFGIRVLPSERQTSPKSAEQNDNNINIEKHLEAKPISIDEVDDSKLPP

SEQ ID NO: 28005 - protein, 123 aa, Diabrotica virgifera
  misc_feature: Coding regions on vcDNA: vcDNA=SeqID_7702; Strand=+; Position=277-648
IVRNNNDCKMLSLELDTIDDFTTQLMQKKVDKWSCKKPIPNVSYGVKYIDNHSIADFSCLDITRINELFQQAIEKNDTSSVLELINQCISHRLCPTLSNLLYTFICMFTKWRYCYDKEDTTFI

SEQ ID NO: 28006 - protein, 66 aa, Diabrotica virgifera; identical to SEQ ID NO: 26808
  misc_feature: Coding regions on vcDNA: vcDNA=SeqID_7703; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28007 - protein, 214 aa, Diabrotica virgifera
  misc_feature: Coding regions on vcDNA: vcDNA=SeqID_7704; Strand=+; Position=160-805
  misc_feature: Homolog annotation: Hit_ID=EAL29215.1; Match level="QueryCoverage =100%, HitCoverage=37%, E-value=3e-92, Identity=75%"; Hit description= GA17577-PA [Drosophila pseudoobscura]
  misc_feature: Gene Ontology Annotation: Molecular function=ATP binding; Cellular component=DNA-directed RNA polymerase II, core complex; Biological process=intracellular signaling cascade
  misc_feature: Pfam annotation: Pfam_ID=HS1_rep; Match level="Score=211.6, E-value =1.5e-60, Copies=4"; Pfam description=Repeat in HS1/Cortactin
  misc_feature (68)..(74): Xaa can be any naturally occurring amino acid
  misc_feature (178)..(178): Xaa can be any naturally occurring amino acid
  misc_feature (195)..(195): Xaa can be any naturally occurring amino acid
MWKAAAGHQINISNDNNEDDEWETDPDFVNDVDEQQQRWGSTTVEGSGRTAGAIDMDKLRKETEESDXXXXXXXLEEGEHNPSYGYGGKFGIEKDRMDQNAVGHDYVGKVEKHASQKDYSTGFGGKFGIQSDRIDKSAVTWDHKEKIEKHASQKDYVSGFGGKFGVQSDRQDKSAVGXDHVEKVEKHESQKDYKXGFGGKFGVQADRQDKSAVG

SEQ ID NO: 28008 - protein, 233 aa, Diabrotica virgifera
  misc_feature: Coding regions on vcDNA: vcDNA=SeqID_7705; Strand=+; Position=3-761
  misc_feature: Homolog annotation: Hit_ID=S08405; Match level="QueryCoverage=97%, HitCoverage=21%, E-value=7e-43, Identity=40%"; Hit description =hypothetical protein 2 - silkworm transposon mag
IFFVSGSLSKAEKNYSQLEREALAIIFCVKKFHKFIYGRSFILVSDHQPLKILFNPDRNISVLSASRITRWNVILSAYSYTIEYRKGSKMYEADMLSRLPLSDVTGIDSSINSFNLTEDLPISYEDVAKVSSKDDGELKPYFLKRNELSIESQCLMVGIRVVIPTVLRESILELIHEGHIGIVRSKMLARAVVWWPGLQQDIETMINSCQVCQITQNNSEKALVSWPKTENVF

SEQ ID NO: 28009 - protein, 245 aa, Diabrotica virgifera
  misc_feature: Coding regions on vcDNA: vcDNA=SeqID_7706; Strand=+; Position=70-804
  misc_feature: Homolog annotation: Hit_ID=CAG02360.1; Match level="QueryCoverage =96%, HitCoverage=67%, E-value=7e-58, Identity=55%"; Hit description =unnamed protein product [Tetraodon nigroviridis]
  misc_feature: Gene Ontology Annotation: Molecular function=electron transporter activity; Cellular component=mitochondrion; Biological process =steroid metabolism
  misc_feature: Pfam annotation: Pfam_ID=adh_short; Match level="Score=34.1, E-value =3.7e-08, Copies=1"; Pfam description=short chain dehydrogenase
  misc_feature (49)..(56): Xaa can be any naturally occurring amino acid
  misc_feature (173)..(173): Xaa can be any naturally occurring amino acid
MGIIFSAKCTSTNRLDGKTAIITGANTGIGKETAKDFYERGAKVILACXXXXXXXXAVADIQKQCTVKSNLGELKVVELDLCSLESVRKCAKELLESEERINLLINNAGVMMCPYSKTKDGFETQFGTNHLAHFLFTLLLLPKICKSMPARIVNVSSIAHTAPFGPMDFTDLXFEKRKYNPVHAYQQSKLANILFTKELARRLTEKDITDVHVYSLHPGVIRTELGRHYDSMFPGLTWGVRQYLR

SEQ ID NO: 28010 - protein, 78 aa, Diabrotica virgifera
  misc_feature: Coding regions on vcDNA: vcDNA=SeqID_7707; Strand=-; Position=130-366
  misc_feature (2)..(19): Xaa can be any naturally occurring amino acid
  misc_feature (32)..(37): Xaa can be any naturally occurring amino acid
PXXXXXXXXXXXXXXXXXXPGPPPRFKTQIQXXXXXXRPDLKNITASPNYKLYSQHGGSASFLFDLNSPNKNTLLSLR

SEQ ID NO: 28011 - protein, 260 aa, Diabrotica virgifera
  misc_feature: Coding regions on vcDNA: vcDNA=SeqID_7708; Strand=+; Position=41-820
  misc_feature (203)..(209): Xaa can be any naturally occurring amino acid
KLSSLFLIIYYSAIMAKDYNSSGDQGSPYSNQEDTEQSFVGKVKSIISNTPLRRWFGRQDDSVKPTIRRREEDDSEDDTEQFRPPAKRAKFVVSREDVSVSHIKSSDSIKDKLLINRNYSFLEPVAGPSGLQTRNLLNNVNSSINSDINVQLFSSDFLNGHKDSDSEESTSGYSSVARIGSKEHVCQSEGSSKQPSPRQTTSXXXXXXXETPTVNMANRSLFVDRTASPQLSTSMSLRDPNFTHQLLVRQTFSIKRYPQK

SEQ ID NO: 28012 - protein, 110 aa, Diabrotica virgifera
  misc_feature: Coding regions on vcDNA: vcDNA=SeqID_7709; Strand=+; Position=7-339
  misc_feature: Pfam annotation: Pfam_ID=Kazal_1; Match level="Score=-1.9, E-value =0.056, Copies=1"; Pfam description=Kazal-type serine protease inhibitor d
  misc_feature (10)..(17): Xaa can be any naturally occurring amino acid
LNKSISATPXXXXXXXXWSSREPVLTNDSLDMQHRICVLFVFLIGFSFVKMAPSPALVLECLNEDCDMDSGPVCAIDESGLPQTFDNRCSARLAFCRFGSFYAEVKPGEC

SEQ ID NO: 28013 - protein, 220 aa, Diabrotica virgifera
  misc_feature: Coding regions on vcDNA: vcDNA=SeqID_7710; Strand=+; Position=1-663
SPFNLLTINDLYFTLTFCFGCSSNFSSSGSSVNAINPVSSVSILGLSLTSRLYVSSTSMLLSLTSILCENFAQAVLLDAETMPRLLVQHLIDQAVLYTVPIICVTNLKETLKSVTGINSVGVAFSKEITSDNSVNLLIEKISHIFKTLPTPEDHINYNRSLEPYVTEHESEEKEAPKKEIVKVDVVQIRKKVYLIRRDPKSKAFYIQSLKETKFFPQMES

SEQ ID NO: 28014 - protein, 254 aa, Diabrotica virgifera
  misc_feature: Coding regions on vcDNA: vcDNA=SeqID_7711; Strand=-; Position=2-763
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(248): Xaa can be any naturally occurring amino acid
  misc_feature (250)..(254): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXX

SEQ ID NO: 28015 - protein, 57 aa, Diabrotica virgifera
  misc_feature: Coding regions on vcDNA: vcDNA=SeqID_7712; Strand=-; Position=3-173
  misc_feature (14)..(14): Xaa can be any naturally occurring amino acid
  misc_feature (20)..(20): Xaa can be any naturally occurring amino acid
  misc_feature (24)..(37): Xaa can be any naturally occurring amino acid
  misc_feature (44)..(56): Xaa can be any naturally occurring amino acid
IKDRNQPGFPRVNXRSCKIXKVEXXXXXXXXXXXXXXSNIEVAXXXXXXXXXXXXXC

SEQ ID NO: 28016 - protein, 66 aa, Diabrotica virgifera
  misc_feature: Coding regions on vcDNA: vcDNA=SeqID_7713; Strand=-; Position=387-587
IFLLSIHLLDSDSVFITIFTELGVDMLLKNIFKVEIVIYKNESYRILNYDIWDSSWIFKYCIIIKL

SEQ ID NO: 28017 - protein, 166 aa, Diabrotica virgifera
  misc_feature: Coding regions on vcDNA: vcDNA=SeqID_7714; Strand=-; Position=22-522
  misc_feature: Homolog annotation: Hit_ID=BAA88337.1; Match level="QueryCoverage =96%, HitCoverage=16%, E-value=1e-20, Identity=36%"; Hit description =ORF2 [Platemys spixii]
GWLDNYAKAFDCVNHDILIKKLNFYGIRGISLNWFQSYLNNRKQLVRANDTDSSLKNIVCGVPQGSVLGPLLFFIFINDITNLKINGKFFLFADDTSITWSNSTIASLHETITSDLLTIKTWPDSNLLSFTVDKTVALSYKGAIQPLPLNNSQISTVDSVKFLGIF

SEQ ID NO: 28018 - protein, 132 aa, Diabrotica virgifera
  misc_feature: Coding regions on vcDNA: vcDNA=SeqID_7715; Strand=+; Position=80-478
  misc_feature: Homolog annotation: Hit_ID=XP_394113.1; Match level="QueryCoverage =99%, HitCoverage=96%, E-value=8e-50, Identity=65%"; Hit description =similar to ENSANGP00000017620 [Apis mellifera]
  misc_feature: Gene Ontology Annotation: Cellular component=extracellular space
MLAYLVKEALPNYLSNLPIPDTIGGWFSLGLKDIVALVPPAAVVAGVGYMSYKAFCPKGRCGSKPSCSVVNPGILKKSDKVVDSVDIEDIADKAVFCRCWRSKNWPYCDGSHNSHNKEQGDNVGPLIVSKKK

SEQ ID NO: 28019 - protein, 196 aa, Diabrotica virgifera
  misc_feature: Coding regions on vcDNA: vcDNA=SeqID_7716; Strand=-; Position=2-589
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(184): Xaa can be any naturally occurring amino acid
  misc_feature (187)..(196): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWAXXXXXXXXXX

SEQ ID NO: 28020 - protein, 143 aa, Diabrotica virgifera
  misc_feature: Coding regions on vcDNA: vcDNA=SeqID_7717; Strand=+; Position=81-512
  misc_feature: Homolog annotation: Hit_ID=XP_396907.1; Match level="QueryCoverage =90%, HitCoverage=94%, E-value=6e-61, Identity=88%"; Hit description =similar to Hoip-prov protein [Apis mellifera]
  misc_feature: Gene Ontology Annotation: Molecular function=pre-mRNA splicing factor activity; Cellular component=small nucleolar ribonucleoprotein complex; Biological process=neurogenesis
  misc_feature: Pfam annotation: Pfam_ID=Ribosomal_L7Ae; Match level="Score=111.1, E -value=2.8e-30, Copies=1"; Pfam description=Ribosomal protein L7Ae/L30e/S12e/Gadd4
IVFDYYSVKKNYLYIKMAEEINPKAYPLADATLTTKILNLVQQAMNYKQLRKGANEVTKTLNRGIAEFIVMAADAEPLEILLHLPLLCEDKNVPYVFIRSKQALGRACGVSRSVIACSVTINEGSQLKPQIQTIQQEIERLLV

SEQ ID NO: 28021 - protein, 99 aa, Diabrotica virgifera
  misc_feature: Coding regions on vcDNA: vcDNA=SeqID_7718; Strand=-; Position=78-377
TGSIHMRSIPKFANKSPTISRTYFHVSQDAPIPLAIPPVKIVTSFQLLFLVSLQYLKAMLVIRMSFEDSNFNIRCDDGSVVSKYGNIYFLSNYNTNIQL

SEQ ID NO: 28022 - protein, 73 aa, Diabrotica virgifera
  misc_feature: Coding regions on vcDNA: vcDNA=SeqID_7719; Strand=-; Position=552-773
VKSLNLKIIINYIFFLHFILMIFLVCKCIFLSKRLKTNQMKFKNKCTNDFWVLFFLLYHLQLRTSNTTKAHYK

SEQ ID NO: 28023 - protein, 100 aa, Diabrotica virgifera
  misc_feature: Coding regions on vcDNA: vcDNA=SeqID_7720; Strand=-; Position=48-350
  misc_feature (42)..(56): Xaa can be any naturally occurring amino acid
SDVRCCQVLEQIHNNYQNSLDCRIDVAKSLTEHVRILKLTIXXXXXXXXXXXXXXXRESFIYRYCIVRKIVWNYHEHYHRDETERVKARFVVLNDSTGRR

SEQ ID NO: 28024 - protein, 22 aa, Diabrotica virgifera
  misc_feature: Coding regions on vcDNA: vcDNA=SeqID_7721; Strand=+; Position=1-66
  misc_feature (9)..(17): Xaa can be any naturally occurring amino acid
HGKKSFEKXXXXXXXXXPMDEP

SEQ ID NO: 28025 - protein, 277 aa, Diabrotica virgifera
  misc_feature: Coding regions on vcDNA: vcDNA=SeqID_7722; Strand=+; Position=1-834
  misc_feature: Homolog annotation: Hit_ID=XP_308137.1; Match level="QueryCoverage =99%, HitCoverage=44%, E-value=1e-68, Identity=48%"; Hit description =ENSANGP00000017177 [Anopheles gambiae]
  misc_feature: Gene Ontology Annotation: Cellular component=mitochondrion; Biological process=establishment and/or maintenance of chromatin architecture
  misc_feature: Pfam annotation: Pfam_ID=Pyr_redox; Match level="Score=-33.3, E-value= 3.7e-05, Copies=1"; Pfam description=Pyridine nucleotide-disulphide oxidor
  misc_feature (40)..(40): Xaa can be any naturally occurring amino acid
  misc_feature (100)..(105): Xaa can be any naturally occurring amino acid
  misc_feature (113)..(113): Xaa can be any naturally occurring amino acid
  misc_feature (177)..(177): Xaa can be any naturally occurring amino acid
VISALGSKCTHYGAPLVNGALGNGRIRCPRHGACFKLSTXGDIEEFPGLDSLPCYQVTIEDENVKVRAKKSDLISNKRIKPMGGKLATTEESIVIIGGGXXXXXXAETLRQEXFGGSITMICKENFVPYDRARLSKEMGLDINTAVFRNEDFYRKYNIDILKDIDATKVDTNKKIVXLRNNTKVPLTKLFIATGNRPRRPCTSGCHLKNVIVLRTYEEAKETNAILSKDQEVVIIGSSFIAMEVAEYCRDKVKKISVVMRDDVPFKPVLGPMIGEAV

SEQ ID NO: 28026 - protein, 182 aa, Diabrotica virgifera
  misc_feature: Coding regions on vcDNA: vcDNA=SeqID_7723; Strand=+; Position=3-551
  misc_feature: Homolog annotation: Hit_ID=AAF67724.2; Match level="QueryCoverage =99%, HitCoverage=36%, E-value=4e-96, Identity=91%"; Hit description =insecticide resistance-associated cytochrome P450 [Diabrotica virgifera virgifera]
  misc_feature: Gene Ontology Annotation: Molecular function=fatty acid (omega-1) -hydroxylase activity; Cellular component=microsome; Biological process=prostaglandin metabolism
  misc_feature: Pfam annotation: Pfam_ID=p450; Match level="Score=-179.5, E-value =0.0055, Copies=1"; Pfam description=Cytochrome P450
WVLRQLAIHSEYQDQIYEEIISVLGDTQKQPDLNDLNELKVMERFIKETLRLFPAVPLIARSLDEDIELNGYLVPKEATVDVLIYDIHRNPKYWPEPEKFDPDRFLPENCVNRHPFAYVPFSAGPRNCIGQRFAMFEMKAIICGIMQNFSVKLADKNEKVEIITDLVLRSAHEINLNFLPRN

SEQ ID NO: 28027 - protein, 41 aa, Diabrotica virgifera
  misc_feature: Coding regions on vcDNA: vcDNA=SeqID_7724; Strand=-; Position=0-122
  misc_feature (2)..(35): Xaa can be any naturally occurring amino acid
AXXXXXXXXXXXXXXXXXXXXXXXXXXXXXXXXXXRGREKP

SEQ ID NO: 28028 - protein, 26 aa, Diabrotica virgifera
  misc_feature: Coding regions on vcDNA: vcDNA=SeqID_7725; Strand=+; Position=2-79
DSYREAGRCRTVGSGRHARLCVALFK

SEQ ID NO: 28029 - protein, 88 aa, Diabrotica virgifera
  misc_feature: Coding regions on vcDNA: vcDNA=SeqID_7726; Strand=-; Position=2-265
LYNFIVSTCKIRYFNYTLAATATSTATAAAATATTTATAATATTASATATPRNGRRCRGYSLNYQKDDAEECHNCRHNPHLEIDFKIN

SEQ ID NO: 28030 - protein, 260 aa, Diabrotica virgifera
  misc_feature: Coding regions on vcDNA: vcDNA=SeqID_7727; Strand=+; Position=101-878
  misc_feature: Homolog annotation: Hit_ID=XP_318878.1; Match level="QueryCoverage =100%, HitCoverage=56%, E-value=2e-76, Identity=57%"; Hit description= ENSANGP00000015771 [Anopheles gambiae]
  misc_feature: Gene Ontology Annotation: Molecular function=acyl-CoA dehydrogenase activity; Cellular component=mitochondrion; Biological process =energy pathways
  misc_feature: Pfam annotation: Pfam_ID=Acyl-CoA_dh_M; Match level="Score=112.4, E -value=1.1e-30, Copies=1"; Pfam description=Acyl-CoA dehydrogenase, middle domain
  misc_feature (71)..(78): Xaa can be any naturally occurring amino acid
  misc_feature (197)..(203): Xaa can be any naturally occurring amino acid
  misc_feature (242)..(242): Xaa can be any naturally occurring amino acid
  misc_feature (254)..(254): Xaa can be any naturally occurring amino acid
MNSLTRQLFRTAKKAGARNLSVSGVRRQEPQPAELGAQFARAPLTHLTEDEQVMKDTVARLAQDQIAPLVXXXXXXXXVKDSVLKMLFENGLMGIEIDSDYGGAGCNFMTTVLTVEEISKVDPAVAALVDIHNTLVNTVIIKLGNKQQKEQYLPRLATDMVASFALSEPSSGSDAFALKTTAKKDGSDYILNGSKMXXXXXXXAGVFLIMANANPSAGYKGITCFIVDRDTPGFSVAKPENXLWIVASGTCMVXMDNVRV

SEQ ID NO: 28031 - protein, 132 aa, Diabrotica virgifera
  misc_feature: Coding regions on vcDNA: vcDNA=SeqID_7728; Strand=-; Position=318-716
  misc_feature (7)..(13): Xaa can be any naturally occurring amino acid
  misc_feature (18)..(28): Xaa can be any naturally occurring amino acid
  misc_feature (32)..(38): Xaa can be any naturally occurring amino acid
  misc_feature (47)..(73): Xaa can be any naturally occurring amino acid
  misc_feature (75)..(97): Xaa can be any naturally occurring amino acid
  misc_feature (109)..(122): Xaa can be any naturally occurring amino acid
  misc_feature (124)..(130): Xaa can be any naturally occurring amino acid
HPPFHSXXXXXXXICSLXXXXXXXXXXXSVGXXXXXXXPKDVFLITXXXXXXXXXXXXXXXXXXXXXXXXXXXLXXXXXXXXXXXXXXXXXXXXXXXVKVNDYVILKDXXXXXXXXXXXXXXEXXXXXXXDP

SEQ ID NO: 28032 - protein, 291 aa, Diabrotica virgifera
  misc_feature: Coding regions on vcDNA: vcDNA=SeqID_7729; Strand=+; Position=90-962
  misc_feature: Homolog annotation: Hit_ID=AAL69686.1; Match level="QueryCoverage =76%, HitCoverage=56%, E-value=9e-24, Identity=30%"; Hit description =transcription factor IIIA [Mus musculus]
  misc_feature: Gene Ontology Annotation: Molecular function=DNA binding; Cellular component=nucleus; Biological process=regulation of transcription, DNA-dependent
  misc_feature: Pfam annotation: Pfam_ID=zf-C2H2; Match level="Score=98.1, E-value =2.2e-26, Copies=5"; Pfam description=Zinc finger, C2H2 type
  misc_feature (29)..(29): Xaa can be any naturally occurring amino acid
  misc_feature (121)..(126): Xaa can be any naturally occurring amino acid
  misc_feature (183)..(207): Xaa can be any naturally occurring amino acid
  misc_feature (251)..(251): Xaa can be any naturally occurring amino acid
  misc_feature (255)..(267): Xaa can be any naturally occurring amino acid
METTTEELGKTSPIKNDLNKDSLELDTSXQFENCDVAYRKKWLLEEHIRKHNKERPFVCTSPDCNKTFTKDSHLKRHKVMVHEKSCEQICDFEDCGKIFNNKYSLKKHKTKVHNKNYSFIXXXXXXGFLKRCHLTQHMFVHTGEPPFKCHTCNLGFLLSRDLAKHNRNHKTYTCECGEIFDRXXXXXXXXXXXXXXXXXXXXXXXXXFSDKKNLHAHYKICSSKFRKTFQCPYLNCTKVYQYNRNLKDHIXSNHXXXXXXXXXXXXXNCERAFSHQCLFNRHIKNMAKKTA

SEQ ID NO: 28033 - protein, 241 aa, Diabrotica virgifera
  misc_feature: Coding regions on vcDNA: vcDNA=SeqID_7730; Strand=+; Position=59-781
  misc_feature: Homolog annotation: Hit_ID=XP_309434.1; Match level="QueryCoverage =93%, HitCoverage=46%, E-value=4e-77, Identity=65%"; Hit description =ENSANGP00000011244 [Anopheles gambiae]
  misc_feature: Gene Ontology Annotation: Molecular function=hexokinase activity; Cellular component=soluble fraction; Biological process=glycolysis
  misc_feature: Pfam annotation: Pfam_ID=Hexokinase_1; Match level="Score=329.4, E -value=5.2e-96, Copies=1"; Pfam description=Hexokinase
  misc_feature (207)..(207): Xaa can be any naturally occurring amino acid
IRDKRRELILTNEKLHKSMKVFSENVHRGLKKETHPTSIVKRFPTYVQDLPNGTENGKFLALDLGGTNFRVLLIELSGEHFEMKSKIFAIPQHIMLGSGEQLFDHIAECLAIFVKEEQVADQKLPLGFTFSFPLSQKGLTVGYLERWTKGFNCSNVVGNDVVQMLNEAIERRGDVQIEICAILNDTTGTLMSCAWKNHSTRIGSNGXVRLQHLVYVEKQANAETWERRGHGLWERADNPGM

SEQ ID NO: 28034 - protein, 95 aa, Diabrotica virgifera
  misc_feature: Coding regions on vcDNA: vcDNA=SeqID_7731; Strand=+; Position=2-289
NKGCLELVIVSNSEFILDVFFFTPEKKNFTPYFPICVKWRGCRVVKFFLYNDRQFQLPIVKFSSFLYFFGGFRKILRSLIGLFLIGSRVNKDFWL

SEQ ID NO: 28035 - protein, 84 aa, Diabrotica virgifera
  misc_feature: Coding regions on vcDNA: vcDNA=SeqID_7732; Strand=-; Position=94-348
KANPEKTEKEEEAEADRDEGVNGVKIDFSVSCELLGGSKGRSARFLESVRDEECLFGENRRAPYVAICDFRPFRRGFLIYYFVC

SEQ ID NO: 28036 - protein, 60 aa, Diabrotica virgifera
  misc_feature: Coding regions on vcDNA: vcDNA=SeqID_7733; Strand=+; Position=290-472
FKVYVKIADLSTCQVIQFFYNLKYLETTVRNQLRPLHILHKTSTKYYMYYCNIFFAGYFL

SEQ ID NO: 28037 - protein, 267 aa, Diabrotica virgifera
  misc_feature: Coding regions on vcDNA: vcDNA=SeqID_7734; Strand=+; Position=92-895
  misc_feature: Homolog annotation: Hit_ID=NP_998458.1; Match level="QueryCoverage =100%, HitCoverage=86%, E-value=1e-138, Identity=87%"; Hit description=protein phosphatase 2A, catalytic subunit, beta isoform [Danio rerio] gb|AAH65680.1| Protein
  misc_feature: Gene Ontology Annotation: Molecular function=protein phosphatase type 2A, intrinsic catalyst activity; Cellular component=cytoplasm; Biological process=R7 cell fate commitment
  misc_feature: Pfam annotation: Pfam_ID=Metallophos; Match level="Score=129.7, E -value=7e-36, Copies=1"; Pfam description=Calcineurin-like phosphoesterase
  misc_feature (182)..(182): Xaa can be any naturally occurring amino acid
  misc_feature (230)..(230): Xaa can be any naturally occurring amino acid
  misc_feature (237)..(237): Xaa can be any naturally occurring amino acid
MDDKASCKELDGWIEQLNECKQLTENQVKTLCDKAKEILSKESNVQEVKCPVTVCGDVHGQFHDLMELFRIGGRSPDTNYLFMGDYVDRGYYSVETVTLLVALKVRYKERITILRGNHESRQITQVYGFYDECLRKYGNANVWKFFTDLFDYLPLTALVDSQIFCLHGGLSPSIDTLDHIRXLDRLQEVPHEGPMCDLLWSDPATAGGLGHLPPGGAGYTFGQDISETFXHTNGLSXVSRAHHSSLKGNNWCHEKNVVTIFSAPHYC

SEQ ID NO: 28038 - protein, 68 aa, Diabrotica virgifera
  misc_feature: Coding regions on vcDNA: vcDNA=SeqID_7735; Strand=+; Position=218-424
  misc_feature (22)..(41): Xaa can be any naturally occurring amino acid
ATTSLTHGTMTYTVSSSFILLXXXXXXXXXXXXXXXXXXXXACYNRLELENCGPYPIIATEFDILVYH

SEQ ID NO: 28039 - protein, 77 aa, Diabrotica virgifera
  misc_feature: Coding regions on vcDNA: vcDNA=SeqID_7736; Strand=-; Position=0-230
  misc_feature (2)..(13): Xaa can be any naturally occurring amino acid
  misc_feature (17)..(61): Xaa can be any naturally occurring amino acid
  misc_feature (63)..(74): Xaa can be any naturally occurring amino acid
PXXXXXXXXXXXXWFFXXXXXXXXXXXXXXXXXXXXXXXXXXXXXXXXXXXXXXXXXXXXXGXXXXXXXXXXXXGGG

SEQ ID NO: 28040 - protein, 170 aa, Diabrotica virgifera
  misc_feature: Coding regions on vcDNA: vcDNA=SeqID_7737; Strand=+; Position=3-510
  misc_feature: Homolog annotation: Hit_ID=XP_395785.1; Match level="QueryCoverage =98%, HitCoverage=61%, E-value=8e-75, Identity=81%"; Hit description =similar to ENSANGP00000018652 [Apis mellifera]
  misc_feature: Gene Ontology Annotation: Biological process=synaptic vesicle endocytosis
  misc_feature: Pfam annotation: Pfam_ID=ANTH; Match level="Score=19.5, E-value=1.1e -09, Copies=1"; Pfam description=ANTH domain
  misc_feature (110)..(110): Xaa can be any naturally occurring amino acid
  misc_feature (124)..(124): Xaa can be any naturally occurring amino acid
  misc_feature (131)..(131): Xaa can be any naturally occurring amino acid
  misc_feature (139)..(140): Xaa can be any naturally occurring amino acid
  misc_feature (144)..(144): Xaa can be any naturally occurring amino acid
  misc_feature (146)..(147): Xaa can be any naturally occurring amino acid
  misc_feature (151)..(151): Xaa can be any naturally occurring amino acid
LVHCTNEPNVSIPQLANLLIERSQNTNWVVVYKALVTVHHMMCYGNERFTQYLASSNSTFQLSNFLDKGGLQGYDMSPFIRKYSRYLNEKALSYRTTAFDFCKVKRGKDXDGMLRTMNADKLLXTLPTLQXQLDILLEXXCSAXDXXNGVXNMCFMLLFRDLYAYFCCIM

SEQ ID NO: 28041 - protein, 85 aa, Diabrotica virgifera
  misc_feature: Coding regions on vcDNA: vcDNA=SeqID_7738; Strand=-; Position=219-476
  misc_feature (18)..(28): Xaa can be any naturally occurring amino acid
TIRHIFDTLLTMNFDVYXXXXXXXXXXXCAFGLHLYATLPKLYFRLPIFFYFHNIMFFSSKYGCYLVNSNILIIFYRFHRLLKKQ

SEQ ID NO: 28042 - protein, 70 aa, Diabrotica virgifera
  misc_feature: Coding regions on vcDNA: vcDNA=SeqID_7739; Strand=+; Position=1-213
RILNTKNTKASNLFDFLHYLLIICYLLVLLLLLLLKIRKNRLLYGKIKYYIITESYLYKNLGIIYQLNHI

SEQ ID NO: 28043 - protein, 23 aa, Diabrotica virgifera
  misc_feature: Coding regions on vcDNA: vcDNA=SeqID_7740; Strand=-; Position=0-68
  misc_feature (3)..(13): Xaa can be any naturally occurring amino acid
PFXXXXXXXXXXXTNLAHTGLNS

SEQ ID NO: 28044 - protein, 165 aa, Diabrotica virgifera
  misc_feature: Coding regions on vcDNA: vcDNA=SeqID_7741; Strand=-; Position=2-496
  misc_feature: Homolog annotation: Hit_ID=EAL32848.1; Match level="QueryCoverage =55%, HitCoverage=40%, E-value=1e-15, Identity=35%"; Hit description =GA10923-PA [Drosophila pseudoobscura]
SFQLGQVLRKWIKNGYFINKNPYVYLGPRLILEFTAYLKTHLPDSICNLCSELVFWGKSCESCYKTFHIYCLKRYLENQHNCPCCLTEWMSTIEDHSTVEDNNEIEHAANNQTAESDVSDSMDTDDIISSTQTRNRNRNARKNISNISSDEDINEPGPSTRKRHG

SEQ ID NO: 28045 - protein, 326 aa, Diabrotica virgifera
  misc_feature: Coding regions on vcDNA: vcDNA=SeqID_7742; Strand=+; Position=1-978
  misc_feature (2)..(24): Xaa can be any naturally occurring amino acid
  misc_feature (33)..(40): Xaa can be any naturally occurring amino acid
  misc_feature (47)..(67): Xaa can be any naturally occurring amino acid
  misc_feature (69)..(79): Xaa can be any naturally occurring amino acid
  misc_feature (83)..(274): Xaa can be any naturally occurring amino acid
  misc_feature (276)..(304): Xaa can be any naturally occurring amino acid
  misc_feature (308)..(322): Xaa can be any naturally occurring amino acid
IXXXXXXXXXXXXXXXXXXXXXXXIVREILFLXXXXXXXXTSRIRDXXXXXXXXXXXXXXXXXXXXXHXXXXXXXXXXXMKRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXXXXXXXXXXXXXXXXXXGDYXXXXXXXXXXXXXXXIHFF

SEQ ID NO: 28046 - protein, 259 aa, Diabrotica virgifera
  misc_feature: Coding regions on vcDNA: vcDNA=SeqID_7743; Strand=+; Position=1-780
  misc_feature: Homolog annotation: Hit_ID=AAF87760.1; Match level="QueryCoverage =95%, HitCoverage=56%, E-value=1e-91, Identity=73%"; Hit description =cytochrome oxidase subunit I [Diabrotica virgifera zeae]
  misc_feature: Pfam annotation: Pfam_ID=COX1; Match level="Score=-150.6, E-value=4e -06, Copies=1"; Pfam description=Cytochrome C and Quinol oxidase polyp
  misc_feature (9)..(9): Xaa can be any naturally occurring amino acid
  misc_feature (22)..(22): Xaa can be any naturally occurring amino acid
  misc_feature (57)..(57): Xaa can be any naturally occurring amino acid
  misc_feature (74)..(74): Xaa can be any naturally occurring amino acid
  misc_feature (77)..(83): Xaa can be any naturally occurring amino acid
  misc_feature (110)..(116): Xaa can be any naturally occurring amino acid
  misc_feature (130)..(130): Xaa can be any naturally occurring amino acid
  misc_feature (138)..(153): Xaa can be any naturally occurring amino acid
  misc_feature (183)..(183): Xaa can be any naturally occurring amino acid
  misc_feature (199)..(206): Xaa can be any naturally occurring amino acid
  misc_feature (227)..(227): Xaa can be any naturally occurring amino acid
  misc_feature (248)..(248): Xaa can be any naturally occurring amino acid
FGTLGIIYXAIIAIGLLGFIRXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXVNLTFFPQHFLGLIGIPRRYSDYPDVFILXNIVSSIGSLISLIGVXXXXXXXXEAFSFQRKRLRPLRITSSIEXLQFNPPAEHRYSELPILSSNXKKKDTIQLPLE

SEQ ID NO: 28047 - protein, 214 aa, Diabrotica virgifera
  misc_feature: Coding regions on vcDNA: vcDNA=SeqID_7744; Strand=+; Position=2-643
  misc_feature (4)..(49): Xaa can be any naturally occurring amino acid
  misc_feature (55)..(74): Xaa can be any naturally occurring amino acid
  misc_feature (80)..(120): Xaa can be any naturally occurring amino acid
  misc_feature (126)..(136): Xaa can be any naturally occurring amino acid
  misc_feature (148)..(154): Xaa can be any naturally occurring amino acid
  misc_feature (156)..(162): Xaa can be any naturally occurring amino acid
  misc_feature (166)..(177): Xaa can be any naturally occurring amino acid
  misc_feature (185)..(193): Xaa can be any naturally occurring amino acid
  misc_feature (201)..(210): Xaa can be any naturally occurring amino acid
LPSXXXXXXXXXXXXXXXXXXXXXXXXXXXXXXXXXXXXXXXXXXXXXXNTRTQXXXXXXXXXXXXXXXXXXXXRRVFYXXXXXXXXXXXXXXXXXXXXXXXXXXXXXXXXXXXXXXXXXPLSSLXXXXXXXXXXXPPTPLFSLPAVXXXXXXXAXXXXXXXKREXXXXXXXXXXXXPHPPPPKXXXXXXXXXPTPPQAKXXXXXXXXXXTPPA

SEQ ID NO: 28048 - protein, 66 aa, Diabrotica virgifera; identical to SEQ ID NO: 26808
  misc_feature: Coding regions on vcDNA: vcDNA=SeqID_7745; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28049 - protein, 66 aa, Diabrotica virgifera; identical to SEQ ID NO: 26808
  misc_feature: Coding regions on vcDNA: vcDNA=SeqID_7746; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28050 - protein, 45 aa, Diabrotica virgifera
  misc_feature: Coding regions on vcDNA: vcDNA=SeqID_7747; Strand=-; Position=38-175
  misc_feature: Homolog annotation: Hit_ID=XP_392912.1; Match level="QueryCoverage =86%, HitCoverage=21%, E-value=2e-13, Identity=84%"; Hit description =similar to ENSANGP00000013674 [Apis mellifera]
ISSVECRARGFLPYVGMVTILMNEYPKFKYTVLACLGLYVLVHRE

SEQ ID NO: 28051 - protein, 37 aa, Diabrotica virgifera
  misc_feature: Coding regions on vcDNA: vcDNA=SeqID_7748; Strand=+; Position=2-115
  misc_feature (27)..(27): Xaa can be any naturally occurring amino acid
  misc_feature (31)..(31): Xaa can be any naturally occurring amino acid
  misc_feature (36)..(36): Xaa can be any naturally occurring amino acid
NEMGCGIAAKIRVPANQIKEIDMSLVXDMPXISFPXP

SEQ ID NO: 28052 - protein, 176 aa, Diabrotica virgifera
  misc_feature: Coding regions on vcDNA: vcDNA=SeqID_7749; Strand=+; Position=113-640
  misc_feature: Homolog annotation: Hit_ID=NP_996148.1; Match level="QueryCoverage =95%, HitCoverage=19%, E-value=4e-41, Identity=53%"; Hit description =CG1106-PH, isoform H [Drosophila melanogaster] gb|AAN13333.2| CG1106- PH, isoform H [Drosophila
  misc_feature: Gene Ontology Annotation: Molecular function=structural molecule activity; Cellular component=actin cytoskeleton; Biological process =actin filament polymerization
  misc_feature: Pfam annotation: Pfam_ID=Gelsolin; Match level="Score=74.5, E-value =3e-19, Copies=1"; Pfam description=Gelsolin repeat
MSKMWGNGAFSRGTLVCLALLVYLKDSSCVTTNRREHFSQLPQRTGFSTNRNNQRTGVKVMDPSFENAGQVDGLEIWRIEDFKPVPYPKNQYGKFYTGDSYIILNTKTTRSGAKVHDLHFWLGAETSQDEQGSAAIYTVQLDEHLNGEPVQHRENQNHETQLFLSYFKSGGYSIPS

SEQ ID NO: 28053 - protein, 187 aa, Diabrotica virgifera
  misc_feature: Coding regions on vcDNA: vcDNA=SeqID_7750; Strand=+; Position=2-565
  misc_feature: Homolog annotation: Hit_ID=NP_722800.1; Match level="QueryCoverage =100%, HitCoverage=22%, E-value=1e-37, Identity=43%"; Hit description= CG4272-PB, isoform B [Drosophila melanogaster] ref|NP_608673.1| CG4272-PA, isoform A [Drosophila
SVAEHALEKRNRREVVQKHRSHKRNGTRGKKICNEKTNVKDAPYEGSDKDNSDVLQRLHLSQRRALLRAAGVTRIDMTESDECRNIRTSRMLCGCGCKENCDPDTCSCSQSGIECQVDADHFPCKCSRENCRNLKGRIEFSKDRVRIHYTRTLMRTNLNKQEDWMARLDGEDITPVLQQNQSFAFNP

SEQ ID NO: 28054 - protein, 244 aa, Diabrotica virgifera
  misc_feature: Coding regions on vcDNA: vcDNA=SeqID_7751; Strand=+; Position=1-735
  misc_feature: Homolog annotation: Hit_ID=XP_307274.1; Match level="QueryCoverage =97%, HitCoverage=47%, E-value=2e-42, Identity=41%"; Hit description =ENSANGP00000023005 [Anopheles gambiae]
  misc_feature: Pfam annotation: Pfam_ID=RVT_1; Match level="Score=73.3, E-value=6.7e- 19, Copies=1"; Pfam description=Reverse transcriptase (RNA-dependent
EVNKIIGEYQGGFRPGRSTTDQICLLKLIQNNSYEQNLGLHMLFIDFKQAYDSVDRDMLYEAMRSLGISGKLVKLVRMTLNNTKNRITLEGNFSKQFTVNKGLKQGDPLSTDLFNLVLEHIVRRIKINTSGTIFNNRQQFIAYADDLVILTRTKEHLQKIFQKFEAEAKRYGLRINQGKTQYMVMKGDINKEDNYIKMKGEGDEYKFKEVAEFEYLGVTVTSTGREEKEIDKRLLKGSRVWGVS

SEQ ID NO: 28055 - protein, 71 aa, Diabrotica virgifera
  misc_feature: Coding regions on vcDNA: vcDNA=SeqID_7752; Strand=-; Position=267-482
RYILFRTLLTMRSIYTLDFNVTRPHILCKRSSLRNIRYIGNGAPSSQLMTHVFHVAIQHLLAVGCLLSTIH

SEQ ID NO: 28056 - protein, 172 aa, Diabrotica virgifera
  misc_feature: Coding regions on vcDNA: vcDNA=SeqID_7753; Strand=+; Position=204-719
  misc_feature (1)..(21): Xaa can be any naturally occurring amino acid
  misc_feature (34)..(62): Xaa can be any naturally occurring amino acid
  misc_feature (65)..(151): Xaa can be any naturally occurring amino acid
  misc_feature (153)..(170): Xaa can be any naturally occurring amino acid
XXXXXXXXXXXXXXXXXXXXXKSLFVFKYHLIFXXXXXXXXXXXXXXXXXXXXXXXXXXXXXRAXXXXXXXXXXXXXXXXXXXXXXXXXXXXXXXXXXXXXXXXXXXXXXXXXXXXXXXXXXXXXXXXXXXXXXXXXXXXXXXXXXXXXXXHXXXXXXXXXXXXXXXXXXAA

SEQ ID NO: 28057 - protein, 82 aa, Diabrotica virgifera
  misc_feature: Coding regions on vcDNA: vcDNA=SeqID_7754; Strand=-; Position=264-512
  misc_feature: Homolog annotation: Hit_ID=NP_886144.1; Match level="QueryCoverage =93%, HitCoverage=34%, E-value=7e-28, Identity=80%"; Hit description =two-component response regulator [Bordetella parapertussis 12822] ref|NP_891005.1| two-component
  misc_feature: Pfam annotation: Pfam_ID=Trans_reg_C; Match level="Score=14.6, E -value=0.0019, Copies=1"; Pfam description=Transcriptional regulatory protein, C
  misc_feature (46)..(56): Xaa can be any naturally occurring amino acid
LDLTAKEFNLLALLLRRQGQVLSRTTLAEQVWDMNFDSDTNVIDVXXXXXXXXXXXPFEAKLLHTVRGMGYVLESRPEPARE

SEQ ID NO: 28058 - protein, 292 aa, Diabrotica virgifera
  misc_feature: Coding regions on vcDNA: vcDNA=SeqID_7755; Strand=+; Position=3-881
  misc_feature: Homolog annotation: Hit_ID=AAP94045.1; Match level="QueryCoverage =80%, HitCoverage=25%, E-value=2e-36, Identity=33%"; Hit description =membrane alanyl aminopeptidase [Tenebrio molitor]
  misc_feature: Gene Ontology Annotation: Molecular function=receptor activity; Cellular component=integral to plasma membrane; Biological process =pathogenesis
FNGFQFLFNRLQNQSNLTETVTSNVLSLMDKLYKSTPFDVIDDDNQVFTLKKMLTLSWACQLGHPECLVMSRASFLSYKLSGVKPQKNLRSTIYCTALQTSSERENWDFLLKVHNEADLDSERPLLLKSLACTQNKELLQELLLLTIADDSPIAREDCITVLGSVAANSNGAEQAFDFVINNYDNITQRYQATNTIANILEIIGGAITTEEQVDKFRSFINGGQLPKDYVNDGERALEIAQKNLNWSEKHEKDLINHYYPESKEPDETSPYTRGSFYRFEWDHWFYSIIFYE

SEQ ID NO: 28059 - protein, 274 aa, Diabrotica virgifera
  misc_feature: Coding regions on vcDNA: vcDNA=SeqID_7756; Strand=+; Position=1-822
  misc_feature (3)..(234): Xaa can be any naturally occurring amino acid
  misc_feature (236)..(249): Xaa can be any naturally occurring amino acid
  misc_feature (255)..(266): Xaa can be any naturally occurring amino acid
LIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXRPRCWXXXXXXXXXXXXKSGPTLKF

SEQ ID NO: 28060 - protein, 303 aa, Diabrotica virgifera
  misc_feature: Coding regions on vcDNA: vcDNA=SeqID_7757; Strand=-; Position=0-908
  misc_feature (21)..(30): Xaa can be any naturally occurring amino acid
  misc_feature (41)..(54): Xaa can be any naturally occurring amino acid
  misc_feature (70)..(83): Xaa can be any naturally occurring amino acid
  misc_feature (89)..(96): Xaa can be any naturally occurring amino acid
  misc_feature (98)..(172): Xaa can be any naturally occurring amino acid
  misc_feature (177)..(186): Xaa can be any naturally occurring amino acid
  misc_feature (207)..(220): Xaa can be any naturally occurring amino acid
  misc_feature (222)..(248): Xaa can be any naturally occurring amino acid
  misc_feature (253)..(301): Xaa can be any naturally occurring amino acid
PPPPPPPPPPLPPPPPLSPFXXXXXXXXXXRKRGQKGGPVXXXXXXXXXXXXXXHPHKKRKRKKEGGLHXXXXXXXXXXXXXXPPLSPXXXXXXXXGXXXXXXXXXXXXXXXXXXXXXXXXXXXXXXXXXXXXXXXXXXXXXXXXXXXXXXXXXXXXXXXXXXXXXXXXXXXFLIFXXXXXXXXXXSTLSPISYNYSSSSNINHFIXXXXXXXXXXXXXXPXXXXXXXXXXXXXXXXXXXXXXXXXXXTEKEXXXXXXXXXXXXXXXXXXXXXXXXXXXXXXXXXXXXXXXXXXXXXXXXXVT

SEQ ID NO: 28061 - protein, 190 aa, Diabrotica virgifera
  misc_feature: Coding regions on vcDNA: vcDNA=SeqID_7758; Strand=+; Position=107-679
  misc_feature: Homolog annotation: Hit_ID=XP_308809.1; Match level="QueryCoverage =92%, HitCoverage=32%, E-value=3e-09, Identity=26%"; Hit description =ENSANGP00000021678 [Anopheles gambiae]
  misc_feature (76)..(86): Xaa can be any naturally occurring amino acid
MNISSPVHRILPCNNSSILERSIVINKTKHSVKQDFLWFTINIAFLSAILYDLHTACYTYSNYIYFAECLLATVLXXXXXXXXXXXLRTSLPFREPLIINEEQKKLLGVKDSDPNYRVVKTPSKSPTPQDSSTSTPINITFKKSSISQFEPDSLNYSTSSPSWIYFKGTPDRSSGHFSPTSSPNFSGIPK

SEQ ID NO: 28062 - protein, 138 aa, Diabrotica virgifera
  misc_feature: Coding regions on vcDNA: vcDNA=SeqID_7759; Strand=+; Position=497-910
  misc_feature (21)..(30): Xaa can be any naturally occurring amino acid
  misc_feature (96)..(96): Xaa can be any naturally occurring amino acid
  misc_feature (98)..(98): Xaa can be any naturally occurring amino acid
  misc_feature (101)..(101): Xaa can be any naturally occurring amino acid
  misc_feature (114)..(114): Xaa can be any naturally occurring amino acid
  misc_feature (118)..(118): Xaa can be any naturally occurring amino acid
  misc_feature (123)..(123): Xaa can be any naturally occurring amino acid
  misc_feature (132)..(132): Xaa can be any naturally occurring amino acid
FYLISDQNMVLTSSVFKRLSXXXXXXXXXXITTNLETNNTLRFVMSKTKPNNTQERSKNCIYKIPCECNNFYVGETSRPLSVMRNEHETYIKNKRXWXNHXISKHAWKHDHRVXWKYXLIVMXETQQKEKNXRCSSHL

SEQ ID NO: 28063 - protein, 281 aa, Diabrotica virgifera
  misc_feature: Coding regions on vcDNA: vcDNA=SeqID_7760; Strand=+; Position=1-846
  misc_feature (1)..(234): Xaa can be any naturally occurring amino acid
  misc_feature (237)..(238): Xaa can be any naturally occurring amino acid
  misc_feature (245)..(245): Xaa can be any naturally occurring amino acid
  misc_feature (264)..(264): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTLXXNSVNFIXRVKSIIKIATSMLDKVYIXCSTIFIKSVRLLKFTLI

SEQ ID NO: 28064 - protein, 92 aa, Diabrotica virgifera
  misc_feature: Coding regions on vcDNA: vcDNA=SeqID_7761; Strand=+; Position=128-406
FCRSTFFVIFLVVKLSLPFAIHRHSYSSRNFRSLILFPSLYFMPQVHILFYIFNVSMIKSATISPTFCYILVLILLTFLYEILEECSTRGCL

SEQ ID NO: 28065 - protein, 219 aa, Diabrotica virgifera
  misc_feature: Coding regions on vcDNA: vcDNA=SeqID_7762; Strand=-; Position=0-656
  misc_feature (13)..(119): Xaa can be any naturally occurring amino acid
  misc_feature (123)..(132): Xaa can be any naturally occurring amino acid
  misc_feature (150)..(175): Xaa can be any naturally occurring amino acid
  misc_feature (177)..(195): Xaa can be any naturally occurring amino acid
  misc_feature (197)..(213): Xaa can be any naturally occurring amino acid
NKKEEEERKEREXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLGEXXXXXXXXXXGGWWGPPFSSPRREGRGXXXXXXXXXXXXXXXXXXXXXXXXXXGXXXXXXXXXXXXXXXXXXXSXXXXXXXXXXXXXXXXXFSPPGG

SEQ ID NO: 28066 - protein, 58 aa, Diabrotica virgifera
  misc_feature: Coding regions on vcDNA: vcDNA=SeqID_7763; Strand=-; Position=2-175
  misc_feature (18)..(32): Xaa can be any naturally occurring amino acid
QHVHNVLSDMDTDRAIDXXXXXXXXXXXXXXXIMILTQAIFELVEIIANTSQNTLTAR

SEQ ID NO: 28067 - protein, 251 aa, Diabrotica virgifera
  misc_feature: Coding regions on vcDNA: vcDNA=SeqID_7764; Strand=+; Position=74-828
  misc_feature: Homolog annotation: Hit_ID=NP_001004624.1; Match level="QueryCoverage= 72%, HitCoverage=83%, E-value=6e-36, Identity=45%"; Hit description =si:rp71-1f1.7 [Danio rerio] gb|AAH81402.1| Si:rp71-1f1.7 [Danio rerio]
  misc_feature (53)..(53): Xaa can be any naturally occurring amino acid
MPGLPEQIYCAEQITIPPSFPYLLRQYAKAAIRSQPNDLLQWSTAYFRCLSLXPPPVKPRLEYPIPRDHYGITPGWLKALLYQLTNNKTIHFKILWDRWIGACLPHYTLIQILCLGGFDNPKEIPWLRFIGLCAAHLTDSLTESMKLICEIMTEEPEGASAMIPFATFMDLYKFLANIDASKPQWLKNMYFTDSLLSLYREVSEKEVKEEVKEEVVIEEESEKSQLLEKSESEELEKELIRGSILSKFRKR

SEQ ID NO: 28068 - protein, 50 aa, Diabrotica virgifera
  misc_feature: Coding regions on vcDNA: vcDNA=SeqID_7765; Strand=+; Position=2-151
  misc_feature: Homolog annotation: Hit_ID=XP_315269.1; Match level="QueryCoverage =100%, HitCoverage=12%, E-value=9e-10, Identity=62%"; Hit description= ENSANGP00000022308 [Anopheles gambiae]
  misc_feature: Gene Ontology Annotation: Biological process=reproduction
  misc_feature (18)..(29): Xaa can be any naturally occurring amino acid
STTKDNMCDDDVAALVVXXXXXXXXXXXXGDDAPRAVFPLIVGRPRHQGV

SEQ ID NO: 28069 - protein, 117 aa, Diabrotica virgifera
  misc_feature: Coding regions on vcDNA: vcDNA=SeqID_7766; Strand=-; Position=98-451
DRIDSAAIQSSSRCTMSPLITSPRLAARHHVITFSPTQSIPQREDGRCAMCAFLLFTQTLKEFRHFVFAIFFSLSPIPRPRGRKINGFLGYGALEWSNGIWSIIENIARFQEAILGM

SEQ ID NO: 28070 - protein, 51 aa, Diabrotica virgifera
  misc_feature: Coding regions on vcDNA: vcDNA=SeqID_7767; Strand=+; Position=322-477
NTLQKLLFVDKLFDDTSHRQLPFIVAVNIFIFFVIDMSLWSYTFYIRIDLT

SEQ ID NO: 28071 - protein, 208 aa, Diabrotica virgifera
  misc_feature: Coding regions on vcDNA: vcDNA=SeqID_7768; Strand=+; Position=52-675
  misc_feature: Homolog annotation: Hit_ID=XP_313866.1; Match level="QueryCoverage =100%, HitCoverage=31%, E-value=3e-61, Identity=54%"; Hit description= ENSANGP00000003998 [Anopheles gambiae]
  misc_feature: Gene Ontology Annotation: Molecular function=guanylate cyclase activity; Cellular component=guanylate cyclase complex, soluble
  misc_feature: Pfam annotation: Pfam_ID=HNOB; Match level="Score=207.4, E-value=2.8e- 59, Copies=1"; Pfam description=Heme NO binding
MYGMLLESVQHFVQLEYGEDVWQQLLIETDYKFTVFNTHQTYLDNIMSSLAAALAKVTSLSVDDTMMFFGRCFVRFFSNYGYDVTIKATGRYFTDFLSSMDNLHAQFRVSYPKMKSPSMYLTDVDNEGCVLVYRSTRKGFTQYIRGQLYQIATDFFNLSLETRVIDTVNKVTSDARNLTIVTFRLDFDNSQNILQQHAEKVTHIKCRP

SEQ ID NO: 28072 - protein, 101 aa, Diabrotica virgifera
  misc_feature: Coding regions on vcDNA: vcDNA=SeqID_7769; Strand=+; Position=270-572
  misc_feature (29)..(35): Xaa can be any naturally occurring amino acid
  misc_feature (80)..(93): Xaa can be any naturally occurring amino acid
KFTFNNRTIGPVALPIIPSCDGKFDATMXXXXXXXLFSCGILMQFTIFIGNKVPSNYWIYPFYKGSWINLTNWVIRMALXXXXXXXXXXXXXXIRHSLFER

SEQ ID NO: 28073 - protein, 75 aa, Diabrotica virgifera
  misc_feature: Coding regions on vcDNA: vcDNA=SeqID_7770; Strand=-; Position=42-269
LMFSRHLISAVFRNVPSCISSIIFQTGRYCTYTRGWNLSPSIFMVDWVCLSENYYRFFVTRARLIDKLLPLMIKK

SEQ ID NO: 28074 - protein, 169 aa, Diabrotica virgifera
  misc_feature: Coding regions on vcDNA: vcDNA=SeqID_7771; Strand=-; Position=1-507
  misc_feature (1)..(25): Xaa can be any naturally occurring amino acid
  misc_feature (31)..(66): Xaa can be any naturally occurring amino acid
  misc_feature (71)..(101): Xaa can be any naturally occurring amino acid
  misc_feature (105)..(116): Xaa can be any naturally occurring amino acid
  misc_feature (126)..(137): Xaa can be any naturally occurring amino acid
  misc_feature (145)..(152): Xaa can be any naturally occurring amino acid
  misc_feature (163)..(169): Xaa can be any naturally occurring amino acid
XXXXXXXXXXXXXXXXXXXXXXXXXRRGGRXXXXXXXXXXXXXXXXXXXXXXXXXXXXXXXXXXXXLHQKXXXXXXXXXXXXXXXXXXXXXXXXXXXXXXXCGVXXXXXXXXXXXXPLFFGWGGRXXXXXXXXXXXXGPRTPGGXXXXXXXXFTQNKNTPLPXXXXXXX

SEQ ID NO: 28075 - protein, 96 aa, Diabrotica virgifera
  misc_feature: Coding regions on vcDNA: vcDNA=SeqID_7772; Strand=+; Position=59-348
  misc_feature: Homolog annotation: Hit_ID=BAB41209.1; Match level="QueryCoverage =100%, HitCoverage=12%, E-value=4e-21, Identity=61%"; Hit description= 90-kDa heat shock protein [Bombyx mori]
  misc_feature: Gene Ontology Annotation: Molecular function=chaperonin ATPase activity; Cellular component=centrosome; Biological process =regulation of sleep
  misc_feature (21)..(21): Xaa can be any naturally occurring amino acid
  misc_feature (26)..(26): Xaa can be any naturally occurring amino acid
  misc_feature (54)..(54): Xaa can be any naturally occurring amino acid
  misc_feature (60)..(60): Xaa can be any naturally occurring amino acid
  misc_feature (75)..(75): Xaa can be any naturally occurring amino acid
INPDHSIIENLTHNTELDKNXSKAVXNLVILLFYTALLSSGFTLYEPPLHASRXIYKMIXLALSIEEQESMLTEXTPSGEAPADDAGDAEDASRME

SEQ ID NO: 28076 - protein, 173 aa, Diabrotica virgifera
  misc_feature: Coding regions on vcDNA: vcDNA=SeqID_7773; Strand=-; Position=1-519
  misc_feature (10)..(106): Xaa can be any naturally occurring amino acid
  misc_feature (110)..(124): Xaa can be any naturally occurring amino acid
  misc_feature (126)..(169): Xaa can be any naturally occurring amino acid
GGGGGRAHQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAGPXXXXXXXXXXXXXXXPXXXXXXXXXXXXXXXXXXXXXXXXXXXXXXXXXXXXXXXXXXXXRVVK

SEQ ID NO: 28077 - protein, 276 aa, Diabrotica virgifera
  misc_feature: Coding regions on vcDNA: vcDNA=SeqID_7774; Strand=-; Position=0-827
  misc_feature (3)..(17): Xaa can be any naturally occurring amino acid
  misc_feature (32)..(72): Xaa can be any naturally occurring amino acid
  misc_feature (74)..(111): Xaa can be any naturally occurring amino acid
  misc_feature (125)..(139): Xaa can be any naturally occurring amino acid
  misc_feature (143)..(170): Xaa can be any naturally occurring amino acid
  misc_feature (173)..(181): Xaa can be any naturally occurring amino acid
  misc_feature (185)..(228): Xaa can be any naturally occurring amino acid
  misc_feature (233)..(270): Xaa can be any naturally occurring amino acid
GGXXXXXXXXXXXXXXXAFLLLFFVGWGRGRXXXXXXXXXXXXXXXXXXXXXXXXXXXXXXXXXXXXXXXXXRXXXXXXXXXXXXXXXXXXXXXXXXXXXXXXXXXXXXXXQRRGRRGGEEKKEXXXXXXXXXXXXXXXFGGXXXXXXXXXXXXXXXXXXXXXXXXXXXXGWXXXXXXXXXNPPXXXXXXXXXXXXXXXXXXXXXXXXXXXXXXXXXXXXXXXXXXXXGRRRXXXXXXXXXXXXXXXXXXXXXXXXXXXXXXXXXXXXXXCFSSPP

SEQ ID NO: 28078 - protein, 137 aa, Diabrotica virgifera
  misc_feature: Coding regions on vcDNA: vcDNA=SeqID_7775; Strand=+; Position=1-415
  misc_feature: Homolog annotation: Hit_ID=CAF95410.1; Match level="QueryCoverage =88%, HitCoverage=11%, E-value=3e-14, Identity=30%"; Hit description =unnamed protein product [Tetraodon nigroviridis]
  misc_feature (25)..(25): Xaa can be any naturally occurring amino acid
PTRPEKWWTIVSVVLEKAILCSYLXANVQDYILLAFEILGVNINTPLNEKRKIYDNLIRILKKQIPFGDPKLTQNILQGAIILWQSFVTEKSLKISLDVTNITTCLTVKGRFMKKTYEVDQKIIGGAFYKVYMVHFQ

SEQ ID NO: 28079 - protein, 116 aa, Diabrotica virgifera
  misc_feature: Coding regions on vcDNA: vcDNA=SeqID_7776; Strand=-; Position=256-606
EQRHHNWVYLVCNTFQLGYILLHQLSNCNGISLQCRRFFIRSHLVLGTDSLSPKVSLILGRRSVSILMIYLITLTIWMVDGLSILSQNDLNGVARMNIFCNTASRVLQYAMYSVPL

SEQ ID NO: 28080 - protein, 149 aa, Diabrotica virgifera
  misc_feature: Coding regions on vcDNA: vcDNA=SeqID_7777; Strand=+; Position=65-514
MNNLCQQKYMKDQKISKNQKYSPKEVTPAYMKWKIPRDHTEGQDYSRLRNLYKENTYTRLLLKIQGPILLSPGAIKNCRESKKEHESEDLQSYIPERHQILSNEFLEKTRAQKRTMRTIIHFLDIMKRKKIFKTLTAQTWTYITNDKII

SEQ ID NO: 28081 - protein, 91 aa, Diabrotica virgifera
  misc_feature: Coding regions on vcDNA: vcDNA=SeqID_7778; Strand=-; Position=593-868
  misc_feature (25)..(25): Xaa can be any naturally occurring amino acid
SFPRNPGSDFVIARSLQPLSTAICXIILSSIPKSFFDMGTSVRSMHHGRAGCQFILCRIKVHRYEVGCLVTMWAEARGRERTTSLVRQSQG

SEQ ID NO: 28082 - protein, 65 aa, Diabrotica virgifera
  misc_feature: Coding regions on vcDNA: vcDNA=SeqID_7779; Strand=-; Position=1-195
ANYKFEELNDYLDISPYSNKKKGGKGTEEFKEVNSRVGKDRRAAYVVVEGEGRHLELLRDTQIQD

SEQ ID NO: 28083 - protein, 220 aa, Diabrotica virgifera
  misc_feature: Coding regions on vcDNA: vcDNA=SeqID_7780; Strand=+; Position=49-708
  misc_feature (46)..(54): Xaa can be any naturally occurring amino acid
  misc_feature (82)..(220): Xaa can be any naturally occurring amino acid
RHKFSLQRIVHSVTAREHFSFSKEKFSLRTPRTRDLFIQKSIISSXXXXXXXXXLKSFHRKINLLNQSFFVTKRYFVFKSYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 28084 - protein, 140 aa, Diabrotica virgifera
  misc_feature: Coding regions on vcDNA: vcDNA=SeqID_7781; Strand=-; Position=205-627
  misc_feature: Homolog annotation: Hit_ID=EAL32000.1; Match level="QueryCoverage =98%, HitCoverage=43%, E-value=3e-36, Identity=55%"; Hit description =GA21887-PA [Drosophila pseudoobscura]
  misc_feature: Gene Ontology Annotation: Molecular function=enoyl-CoA hydratase activity; Cellular component=peroxisome; Biological process=energy pathways
  misc_feature (92)..(99): Xaa can be any naturally occurring amino acid
AQKDAFFQVKEVEVGLAADVGSLQRFPKVIGFDSLTRELCYTARKMHADEAFSCGFVSRVFGYQGEFIQGAFGVAEDIAKKSPVAVQATKQXXXXXXXXRVQEGFDHIKFLNQLNFQREGIVKAASAQLTKDPNVVFSQL

SEQ ID NO: 28085 - protein, 74 aa, Diabrotica virgifera
  misc_feature: Coding regions on vcDNA: vcDNA=SeqID_7782; Strand=-; Position=452-676
GWLVPSVGRKARGREKEFVNRSPKSRSTMLRVFVSGFKPRPHFYVVCCVYVYFYIILCNRDYLRSFYLIRIYGT

SEQ ID NO: 28086 - protein, 291 aa, Diabrotica virgifera
  misc_feature: Coding regions on vcDNA: vcDNA=SeqID_7783; Strand=+; Position=20-895
  misc_feature: Homolog annotation: Hit_ID=NP_609186.1; Match level="QueryCoverage =91%, HitCoverage=57%, E-value=1e-53, Identity=37%"; Hit description =CG8506-PA [Drosophila melanogaster] gb|AAF52609.1| CG8506-PA [Drosophila melanogaster]
  misc_feature: Gene Ontology Annotation: Molecular function=zinc ion binding; Cellular component=endosome; Biological process=endosome transport
  misc_feature: Pfam annotation: Pfam_ID=FYVE; Match level="Score=55.4, E-value=1.6e -13, Copies=1"; Pfam description=FYVE zinc finger
  misc_feature (13)..(17): Xaa can be any naturally occurring amino acid
  misc_feature (158)..(165): Xaa can be any naturally occurring amino acid
VGVNLYISQINKXXXXXAEATIQEGFLCPICHKDLRSANNLISHFQDLHSEEKDLLSSIKGIYGKVKKKILTVDDQEFEHLRKEISLQEKYYLEYSEPQDPGPTVSHTDYFKSIRRDRLDHKTAETNKLIIRLDRLLRVYAPDRKQHEQELVAWLDGXXXXXXXXCASSFNITRRQHHCRLCGSIMCNSCSYFLPYDTAQTIVTPLNSGNSKEQNSNKESDTLRICYHCLDMIESRRRLQIEQVLQPIICQLYTHLQKMKSQIETSVEMYLKMYNSIISGETHIFYKIFSL

SEQ ID NO: 28087 - protein, 224 aa, Diabrotica virgifera
  misc_feature: Coding regions on vcDNA: vcDNA=SeqID_7784; Strand=-; Position=1-672
  misc_feature (1)..(12): Xaa can be any naturally occurring amino acid
  misc_feature (14)..(207): Xaa can be any naturally occurring amino acid
  misc_feature (210)..(224): Xaa can be any naturally occurring amino acid
XXXXXXXXXXXXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 28088 - protein, 210 aa, Diabrotica virgifera
  misc_feature: Coding regions on vcDNA: vcDNA=SeqID_7785; Strand=-; Position=0-629
  misc_feature (7)..(22): Xaa can be any naturally occurring amino acid
  misc_feature (30)..(76): Xaa can be any naturally occurring amino acid
  misc_feature (80)..(87): Xaa can be any naturally occurring amino acid
  misc_feature (90)..(145): Xaa can be any naturally occurring amino acid
  misc_feature (147)..(181): Xaa can be any naturally occurring amino acid
  misc_feature (183)..(208): Xaa can be any naturally occurring amino acid
IILYEVXXXXXXXXXXXXXXXXPSLLLPLXXXXXXXXXXXXXXXXXXXXXXXXXXXXXXXXXXXXXXXXXXXXXXXLFPXXXXXXXXGGXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXGXXXXXXXXXXXXXXXXXXXXXXXXXXFP

SEQ ID NO: 28089 - protein, 92 aa, Diabrotica virgifera
  misc_feature: Coding regions on vcDNA: vcDNA=SeqID_7786; Strand=+; Position=138-420
  misc_feature: Homolog annotation: Hit_ID=CAD44510.1; Match level="QueryCoverage =81%, HitCoverage=36%, E-value=4e-15, Identity=54%"; Hit description =cytochrome oxidase I [Chaoborus crystallinus]
  misc_feature (39)..(39): Xaa can be any naturally occurring amino acid
  misc_feature (44)..(44): Xaa can be any naturally occurring amino acid
  misc_feature (60)..(60): Xaa can be any naturally occurring amino acid
CPNVENNVVSYDSSTYNGTTITYSPREMRALSLNLLFTXGGLTXDIIANSTIDIVLHDTXTVVAHSHYGLSILRCICYYRGKDPMISFTYRV

SEQ ID NO: 28090 - protein, 123 aa, Diabrotica virgifera
  misc_feature: Coding regions on vcDNA: vcDNA=SeqID_7787; Strand=-; Position=291-662
GFSPPFPFFQNSFLKTSFNPQQTRVFFPIKGIPFDERFFPPPKIFHPKKFSAETNPNKNQSPHFPFGKSPKLFIGIRFVLIQTKISKIPPLKLVPPLFIPKIKGGICLPREFLTQKFFTLFNF

SEQ ID NO: 28091 - protein, 66 aa, Diabrotica virgifera; identical to SEQ ID NO: 26808
  misc_feature: Coding regions on vcDNA: vcDNA=SeqID_7788; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28092 - protein, 45 aa, Diabrotica virgifera
  misc_feature: Coding regions on vcDNA: vcDNA=SeqID_7789; Strand=-; Position=122-259
  misc_feature (8)..(14): Xaa can be any naturally occurring amino acid
  misc_feature (16)..(24): Xaa can be any naturally occurring amino acid
KFGKVNHXXXXXXXYXXXXXXXXXLVYVTTQSTDLFKLEKNQVQP

SEQ ID NO: 28093 - protein, 30 aa, Diabrotica virgifera
  misc_feature: Coding regions on vcDNA: vcDNA=SeqID_7790; Strand=+; Position=3-95
GHSDQVIASKVPHNRNEKNVKILNNNNGTL

SEQ ID NO: 28094 - protein, 92 aa, Diabrotica virgifera
  misc_feature: Coding regions on vcDNA: vcDNA=SeqID_7791; Strand=-; Position=2-277
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(92): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXX

SEQ ID NO: 28095 - protein, 256 aa, Diabrotica virgifera
  misc_feature: Coding regions on vcDNA: vcDNA=SeqID_7792; Strand=-; Position=3-770
  misc_feature (9)..(193): Xaa can be any naturally occurring amino acid
  misc_feature (198)..(234): Xaa can be any naturally occurring amino acid
  misc_feature (237)..(256): Xaa can be any naturally occurring amino acid
LVFKKLKLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTISLXXXXXXXXXXXXXXXXXXXXXXXXXXXXXXXXXXXXXEVXXXXXXXXXXXXXXXXXXXX

SEQ ID NO: 28096 - protein, 95 aa, Diabrotica virgifera
  misc_feature: Coding regions on vcDNA: vcDNA=SeqID_7793; Strand=-; Position=268-555
SFVNVTLPNTIAKFWGSEKVIHIYTSFKYRVIDFYYTVNQNNATIRATIRLENITVKNFLLAGTIQSKILQNPNGPHKCVQNVLGPTSPPSVNPK

SEQ ID NO: 28097 - protein, 55 aa, Diabrotica virgifera
  misc_feature: Coding regions on vcDNA: vcDNA=SeqID_7794; Strand=-; Position=1-165
  misc_feature: Homolog annotation: Hit_ID=ZP_00264155.1; Match level="QueryCoverage =100%, HitCoverage=8%, E-value=3e-15, Identity=80%"; Hit description =COG0642: Signal transduction histidine kinase [Pseudomonas fluorescens PfO-1]
  misc_feature (13)..(21): Xaa can be any naturally occurring amino acid
MPLRQRLENLPVXXXXXXXXXVLLTTVLLVANLTFISAAYWISQESMAPQALQAI

SEQ ID NO: 28098 - protein, 202 aa, Diabrotica virgifera
  misc_feature: Coding regions on vcDNA: vcDNA=SeqID_7795; Strand=-; Position=3-608
  misc_feature: Homolog annotation: Hit_ID=CAD22154.1; Match level="QueryCoverage =91%, HitCoverage=53%, E-value=4e-55, Identity=56%"; Hit description =pherophorin-dz1 protein [Volvox carteri f. nagariensis]
  misc_feature: Gene Ontology Annotation: Molecular function=protein binding; Cellular component=extracellular space; Biological process=actin polymerization and/or depolymerization
  misc_feature (44)..(44): Xaa can be any naturally occurring amino acid
  misc_feature (61)..(61): Xaa can be any naturally occurring amino acid
  misc_feature (83)..(83): Xaa can be any naturally occurring amino acid
  misc_feature (97)..(97): Xaa can be any naturally occurring amino acid
  misc_feature (119)..(119): Xaa can be any naturally occurring amino acid
  misc_feature (136)..(136): Xaa can be any naturally occurring amino acid
  misc_feature (158)..(158): Xaa can be any naturally occurring amino acid
PAPPPPPPPNPHPPNPPPPPPPPPCPPRPPRPSPPFSPSPPRPXPPSLPSLRPNTPPTPPXPPFPPRPPRPSLPSSPSPPRLXPPSLPSLPLTTPPXPPCPPRPPWPSPPSPPSPPRPXPPTLSSLLSNTPPTPPXPPFPPRPPRPSPTSSPSPPRPXPLPPPLRPPSPPPYPIGLEGTADIVLNIKRTTQRDATVAGIPFI

SEQ ID NO: 28099 - protein, 74 aa, Diabrotica virgifera
  misc_feature: Coding regions on vcDNA: vcDNA=SeqID_7796; Strand=+; Position=3-227
YLYNKGGKCYFSSRGNHSREEKALYYSHVIHMVFTPSSNNKSFFYFYFIYVTNQQNVLKLKLTSRYNITVNCQI

SEQ ID NO: 28100 - protein, 69 aa, Diabrotica virgifera
  misc_feature: Coding regions on vcDNA: vcDNA=SeqID_7797; Strand=+; Position=91-300
RTSHRVELYWFDVENSIYVQVIFNMVYCYRGLIIWRNVWFWCAGLVGARNGYFLSFLRWNTLCFCIVVK

SEQ ID NO: 28101 - protein, 64 aa, Diabrotica virgifera
  misc_feature: Coding regions on vcDNA: vcDNA=SeqID_7798; Strand=+; Position=82-276
  misc_feature (28)..(34): Xaa can be any naturally occurring amino acid
  misc_feature (36)..(44): Xaa can be any naturally occurring amino acid
KFSLESQHHVNQELLTTNKKFTQLRTAXXXXXXXNXXXXXXXXXLIEMNRYSTNKHMPHIKQRN

SEQ ID NO: 28102 - protein, 114 aa, Diabrotica virgifera
  misc_feature: Coding regions on vcDNA: vcDNA=SeqID_7799; Strand=+; Position=2-346
  misc_feature (1)..(86): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXLGETAEFLLEKSNPKKRMGNPPVGIKGF

SEQ ID NO: 28103 - protein, 254 aa, Diabrotica virgifera
  misc_feature: Coding regions on vcDNA: vcDNA=SeqID_7800; Strand=+; Position=1-762
  misc_feature: Homolog annotation: Hit_ID=NP_610600.1; Match level="QueryCoverage =96%, HitCoverage=34%, E-value=5e-56, Identity=44%"; Hit description =CG11887-PA [Drosophila melanogaster] gb|AAF58765.2| CG11887-PA [Drosophila melanogaster]
  misc_feature: Gene Ontology Annotation: Molecular function=Pol II transcription elongation factor activity; Cellular component=transcription elongation factor complex; Biological process=regulation of transcription from Pol II promoter
  misc_feature: Pfam annotation: Pfam_ID=WD40; Match level="Score=90.5, E-value=4.4e -24, Copies=4"; Pfam description=WD domain, G-beta repeat
IYQPEVLKGHSSNVNIVDGLYRDDSSAVVVSVSMDQTAKIWLRQNYQGDFVLNQTLNFGFHIGLSLRLTYLPNSDELLLACALDDSKIHIFSQSQSDNLHFEEATKLAGHEDWVRGLDFTRDGDDLILASSSQDAFIRLWRISTKNLGIEVLENARLRTKSDTFNVYLESVISGHEGWIYSVQWSPDGKQLLSASIDKSMIIWEYDETSELWLEKIRVGEIGGNTLGFYGGLFGPDGDTVLEHSYHGAFHIWKH

SEQ ID NO: 28104 - protein, 40 aa, Diabrotica virgifera
  misc_feature: Coding regions on vcDNA: vcDNA=SeqID_7801; Strand=+; Position=18-140
  misc_feature (4)..(11): Xaa can be any naturally occurring amino acid
  misc_feature (27)..(37): Xaa can be any naturally occurring amino acid
VKTXXXXXXXXKPLYKFIKFFNKFSYXXXXXXXXXXXNLR

SEQ ID NO: 28105 - protein, 70 aa, Diabrotica virgifera
  misc_feature: Coding regions on vcDNA: vcDNA=SeqID_7802; Strand=-; Position=107-319
YFVSKRNLNFQAFAHPQIRGVSKKTSYTLFCSYAKTSLSSIWPCSFTNTLMGETITWECYTHNLKRFILF

SEQ ID NO: 28106 - protein, 216 aa, Diabrotica virgifera
  misc_feature: Coding regions on vcDNA: vcDNA=SeqID_7803; Strand=-; Position=1-648
  misc_feature (4)..(214): Xaa can be any naturally occurring amino acid
KTVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRY

SEQ ID NO: 28107 - protein, 186 aa, Diabrotica virgifera
  misc_feature: Coding regions on vcDNA: vcDNA=SeqID_7804; Strand=+; Position=234-794
  misc_feature: Pfam annotation: Pfam_ID=zf-C2H2; Match level="Score=34.5, E-value =3.2e-07, Copies=2"; Pfam description=Zinc finger, C2H2 type
  misc_feature (154)..(154): Xaa can be any naturally occurring amino acid
QEIMNSCTPSISTNPEEALCHICSKIFKTRSSLNRHIKKIHKIDEPTNNMNQNHIICPLCEQDTNFNSHEKLRKHLQDLHQVSIELITFEFSSKQEYETWKDMQKIETSYVSHRTIRRKEHKIMYYDCNRSDLQGYKPNYKIRTEKAGGSIKIXRSVPFQAYLQTERPRTSFPSVIGKHMLDIKKN

SEQ ID NO: 28108 - protein, 293 aa, Diabrotica virgifera
  misc_feature: Coding regions on vcDNA: vcDNA=SeqID_7805; Strand=+; Position=2-883
  misc_feature (15)..(273): Xaa can be any naturally occurring amino acid
CDFISRKYQIAALQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLDFKNPHSDKSKWITPDQLS

SEQ ID NO: 28109 - protein, 204 aa, Diabrotica virgifera
  misc_feature: Coding regions on vcDNA: vcDNA=SeqID_7806; Strand=+; Position=45-659
  misc_feature: Homolog annotation: Hit_ID=EAL28093.1; Match level="QueryCoverage =84%, HitCoverage=26%, E-value=2e-25, Identity=38%"; Hit description =GA11381-PA [Drosophila pseudoobscura]
  misc_feature: Gene Ontology Annotation: Cellular component=membrane; Biological process=signal transduction
PRTKLDSNDTDINPLGRKITLDEISWIGSLQYIGAMVGILPFAVLADVIGRKPVLLLLAVPHIISFLSFAFAKTIGWYYVGRFLGGVSLSSVYIILPMYVAEIAEDSYRGMLLMSYSTFASLGDLIPYVLGPYVSVLWFNIILAVFPISFLVIFLIIAPERPYYYVNKKEEKAENILKKLRKTKSKYTDHEWKLNESKRDKVRN

SEQ ID NO: 28110 - protein, 143 aa, Diabrotica virgifera
  misc_feature: Coding regions on vcDNA: vcDNA=SeqID_7807; Strand=-; Position=475-907
  misc_feature: Homolog annotation: Hit_ID=XP_394706.1; Match level="QueryCoverage =81%, HitCoverage=45%, E-value=6e-34, Identity=61%"; Hit description =similar to jerky homolog-like [Apis mellifera]
  misc_feature: Pfam annotation: Pfam_ID=CENP-B_N; Match level="Score=47.8, E-value =3.1e-11, Copies=1"; Pfam description=CENP-B N-terminal DNA-binding domain
  misc_feature (34)..(35): Xaa can be any naturally occurring amino acid
SFVNLFRFLCLRVFLYVNGNKNGKKCVVTMEKKXXALGRIDKGESLKTIAASYGVGTSTVSDWKKNRTKIEDFCFKMITKDSLDNRCKANKAKNETLDDALYVWFCAERERGLPVSGPIIQESALKLIKRNEHTLYSIQLYII

SEQ ID NO: 28111 - protein, 32 aa, Diabrotica virgifera
  misc_feature: Coding regions on vcDNA: vcDNA=SeqID_7808; Strand=+; Position=1-99
WDRDHKISTLGQSITILIFVIYYLCKVRLLYY

SEQ ID NO: 28112 - protein, 30 aa, Diabrotica virgifera
  misc_feature: Coding regions on vcDNA: vcDNA=SeqID_7809; Strand=-; Position=1-90
  misc_feature (8)..(23): Xaa can be any naturally occurring amino acid
  misc_feature (26)..(30): Xaa can be any naturally occurring amino acid
SKKMGSKXXXXXXXXXXXXXXXXNHXXXXX

SEQ ID NO: 28113 - protein, 93 aa, Diabrotica virgifera
  misc_feature: Coding regions on vcDNA: vcDNA=SeqID_7810; Strand=-; Position=1-279
  misc_feature (7)..(51): Xaa can be any naturally occurring amino acid
  misc_feature (54)..(88): Xaa can be any naturally occurring amino acid
GARAPPXXXXXXXXXXXXXXXXXXXXXXXXXXXXXXXXXXXXXXXXXXXXXGRXXXXXXXXXXXXXXXXXXXXXXXXXXXXXXXXXXXPRVFF

SEQ ID NO: 28114 - protein, 81 aa, Diabrotica virgifera
  misc_feature: Coding regions on vcDNA: vcDNA=SeqID_7811; Strand=+; Position=479-724
  misc_feature (59)..(59): Xaa can be any naturally occurring amino acid
RDTYNLLQLIMQEKIQEKKSIDRRRISWRRNLREWYGCTSKELFRAAISKVSIAMMIAXPLSRTWHLKKKDRTEQLYLLYS

SEQ ID NO: 28115 - protein, 33 aa, Diabrotica virgifera
  misc_feature: Coding regions on vcDNA: vcDNA=SeqID_7812; Strand=-; Position=2-100
AGIASSLLPLLSVLESKLKASEALINIIKNWGE

SEQ ID NO: 28116 - protein, 48 aa, Diabrotica virgifera
  misc_feature: Coding regions on vcDNA: vcDNA=SeqID_7813; Strand=-; Position=1-144
  misc_feature (9)..(19): Xaa can be any naturally occurring amino acid
  misc_feature (21)..(29): Xaa can be any naturally occurring amino acid
  misc_feature (32)..(46): Xaa can be any naturally occurring amino acid
YIKTKIPFXXXXXXXXXXXQXXXXXXXXXNSXXXXXXXXXXXXXXXKV

SEQ ID NO: 28117 - protein, 103 aa, Diabrotica virgifera
  misc_feature: Coding regions on vcDNA: vcDNA=SeqID_7814; Strand=+; Position=1-309
  misc_feature (5)..(13): Xaa can be any naturally occurring amino acid
  misc_feature (16)..(29): Xaa can be any naturally occurring amino acid
  misc_feature (31)..(43): Xaa can be any naturally occurring amino acid
  misc_feature (45)..(52): Xaa can be any naturally occurring amino acid
  misc_feature (54)..(67): Xaa can be any naturally occurring amino acid
  misc_feature (76)..(82): Xaa can be any naturally occurring amino acid
  misc_feature (85)..(100): Xaa can be any naturally occurring amino acid
CSPQXXXXXXXXXIRXXXXXXXXXXXXXXGXXXXXXXXXXXXXRXXXXXXXXNXXXXXXXXXXXXXXGGPPAKNTXXXXXXXAAXXXXXXXXXXXXXXXXGGG

SEQ ID NO: 28118 - protein, 80 aa, Diabrotica virgifera
  misc_feature: Coding regions on vcDNA: vcDNA=SeqID_7815; Strand=-; Position=652-894
  misc_feature (7)..(7): Xaa can be any naturally occurring amino acid
  misc_feature (12)..(12): Xaa can be any naturally occurring amino acid
  misc_feature (26)..(26): Xaa can be any naturally occurring amino acid
  misc_feature (37)..(37): Xaa can be any naturally occurring amino acid
  misc_feature (39)..(39): Xaa can be any naturally occurring amino acid
  misc_feature (43)..(43): Xaa can be any naturally occurring amino acid
  misc_feature (47)..(47): Xaa can be any naturally occurring amino acid
MFHFMVXKIHNXLFRMGIVGIAIFYXTVLNHLAHRLXAXTKLXRLSXIYRIRIPSNTTYLPGIEFSLFIYTYGVKIETTI

SEQ ID NO: 28119 - protein, 222 aa, Diabrotica virgifera
  misc_feature: Coding regions on vcDNA: vcDNA=SeqID_7816; Strand=+; Position=78-743
  misc_feature: Homolog annotation: Hit_ID=NP_651307.2; Match level="QueryCoverage =99%, HitCoverage=35%, E-value=1e-69, Identity=61%"; Hit description =CG11069-PA [Drosophila melanogaster] gb|AAF56361.2| CG11069-PA [Drosophila melanogaster]
  misc_feature: Gene Ontology Annotation: Molecular function=molecular_function unknown; Cellular component=cellular_component unknown; Biological process=cholesterol absorption
  misc_feature: Pfam annotation: Pfam_ID=ABC_tran; Match level="Score=21.4, E-value =1.2e-07, Copies=1"; Pfam description=ABC transporter
YHLKMLSGGYILELCNVFYSGQVKKRSVLQRMVGNIKTAVILKDVSMLVHSGEVLAVLGSKGSGKKALLDVISRRAQGPIRGQIYLNNHPVSMGLFQQKCAYVTHKCDFIPGLNVEQTLYYTPTKFTGYLKMSKVKQVIADLALSQVAKKCVEDLTKSEYRRLMIGVQLIKNPVVLLLDEPTWDLDPLNTYLIISILSNAAKKYGTAIILTMEKPRSDVFPF

SEQ ID NO: 28120 - protein, 121 aa, Diabrotica virgifera
  misc_feature: Coding regions on vcDNA: vcDNA=SeqID_7817; Strand=+; Position=419-781
  misc_feature: Homolog annotation: Hit_ID=CAH91753.1; Match level="QueryCoverage =62%, HitCoverage=27%, E-value=7e-23, Identity=61%"; Hit description =hypothetical protein [Pongo pygmaeus]
  misc_feature: Gene Ontology Annotation: Molecular function=molecular_function unknown; Cellular component=cellular_component unknown; Biological process=biological_process unknown
MWSSKISRTSFTTLDIYRRITRGVTNLAKSRQASTSDIHLFKVGEKYHGFEAKRIASIPELKTTALYLLHEKTKAQYLHLYRNDSNNVFSVNLRTTPMNSTGLPHILEHTVLCGSEIFLYV

SEQ ID NO: 28121 - protein, 40 aa, Diabrotica virgifera
  misc_feature: Coding regions on vcDNA: vcDNA=SeqID_7818; Strand=-; Position=18-140
  misc_feature (13)..(14): Xaa can be any naturally occurring amino acid
  misc_feature (23)..(31): Xaa can be any naturally occurring amino acid
IFTLMNLINNSKXXHIYYLTSFXXXXXXXXXINDKHTPHQ

SEQ ID NO: 28122 - protein, 96 aa, Diabrotica virgifera
  misc_feature: Coding regions on vcDNA: vcDNA=SeqID_7819; Strand=-; Position=223-513
VSLADSPAGLIACLYLLPAFSAMYYCYGIPQSQYFHDRSFYRAITEELPPSGWPLCVSGFPTYLRSSLVSLVPSCYANHLLRHFSWVSITSSAFHT

SEQ ID NO: 28123 - protein, 137 aa, Diabrotica virgifera
  misc_feature: Coding regions on vcDNA: vcDNA=SeqID_7820; Strand=+; Position=20-431
  misc_feature: Homolog annotation: Hit_ID=BAB78527.1; Match level="QueryCoverage =91%, HitCoverage=40%, E-value=1e-52, Identity=79%"; Hit description =ribosome-associated protein P40 [Bombyx mori]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_S2; Match level="Score=41.2, E -value=5.1e-10, Copies=1"; Pfam description=Ribosomal protein S2
  misc_feature (70)..(78): Xaa can be any naturally occurring amino acid
  misc_feature (123)..(123): Xaa can be any naturally occurring amino acid
RHSLAPPQFGATPIAGRFTPGAFTNQIQAAFREPRLLIVTDPAFDHQPITEASYVNIPVIALCNTDSPLXXXXXXXXXNNKASHSIGLLWWLLAREVLRLRGIIPRDTKWDVVIDLFFYREPXEAEKVQPAAKEAVA

SEQ ID NO: 28124 - protein, 295 aa, Diabrotica virgifera
  misc_feature: Coding regions on vcDNA: vcDNA=SeqID_7821; Strand=+; Position=1-888
  misc_feature (63)..(77): Xaa can be any naturally occurring amino acid
KQNPSDGSDSQQEKIKVPANMQQQILHLQNIKNVTLLRASPTGNVGLSPLTTASGESPIDQAXXXXXXXXXXXXXXXQSGLQIKTQGNLSQAQQQQILQTIKQKILPNASLLANPQQIILKQKSGLINVQKSGIVPVTTQVVGQQKLSTDLSKQSSSTQGPVVAKVLTNAAGHVISVEGLLPQQKPTSILAQGATLRVSGSKTGQQNLIHLTGTSKANALTQLTVGSQNNILTLTTQPKFVVASQTTTVTSSTTSSKSASRSSNKAQTLTKLNTKGNQQLINTKVIQALDGQSLN

SEQ ID NO: 28125 - protein, 246 aa, Diabrotica virgifera
  misc_feature: Coding regions on vcDNA: vcDNA=SeqID_7822; Strand=+; Position=3-737
  misc_feature: Homolog annotation: Hit_ID=XP_317153.1; Match level="QueryCoverage =100%, HitCoverage=62%, E-value=1e-100, Identity=73%"; Hit description=ENSANGP00000025137 [Anopheles gambiae]
  misc_feature: Gene Ontology Annotation: Molecular function=mRNA binding; Cellular component=snRNP U1; Biological process=mRNA splicing
  misc_feature: Pfam annotation: Pfam_ID=LUC7; Match level="Score=332.3, E-value=7.2e- 97, Copies=1"; Pfam description=LUC7 N_terminus
  misc_feature (61)..(61): Xaa can be any naturally occurring amino acid
  misc_feature (144)..(144): Xaa can be any naturally occurring amino acid
MTAHDQMRAMLYQLMGTGRNGESNKFHVKFNDTRVCKSFLLSCCPHEILSSTKLQLSIIRXRNRCLVLYRMDLGECPKIHDLALRADFDKAQQSKDYFYDLDAMEHLQAFIGDCDRRTESAKQRLAETQEELSAEVAVKANSVXELAEQIGQKLAKAEQLGEEGFVDESMKLMGEVEELRKKKLDAEQEYRNSMPASSYQQQKLRVCEVCSAYLGIHDNDRRLADHCGGKLHLGFIEIREKLADLE

SEQ ID NO: 28126 - protein, 93 aa, Diabrotica virgifera
  misc_feature: Coding regions on vcDNA: vcDNA=SeqID_7823; Strand=+; Position=3-281
SSAWRQATPKASPTYTGQRLPRVTPLEPDDWHNVMYIPHLSKFLPMDSSPGNVLYAMAIFPATILLLATKAVMECECRILHLNLMVSQCHLHS

SEQ ID NO: 28127 - protein, 66 aa, Diabrotica virgifera
  misc_feature: Coding regions on vcDNA: vcDNA=SeqID_7824; Strand=-; Position=199-399
  misc_feature (6)..(19): Xaa can be any naturally occurring amino acid
FLWYSXXXXXXXXXXXXXXFFHCNATSILTILTLTIQLNIRNNSGTQHINYNNNVTLQNIGWKILF

SEQ ID NO: 28128 - protein, 58 aa, Diabrotica virgifera
  misc_feature: Coding regions on vcDNA: vcDNA=SeqID_7825; Strand=-; Position=544-720
  misc_feature (17)..(17): Xaa can be any naturally occurring amino acid
  misc_feature (23)..(23): Xaa can be any naturally occurring amino acid
MMDIRMLRWVSGVTKKXKMKNNXYIRTSLVVTPIEDKMNEHRSGWFGHVQRRDANHPI

SEQ ID NO: 28129 - protein, 322 aa, Diabrotica virgifera
  misc_feature: Coding regions on vcDNA: vcDNA=SeqID_7826; Strand=-; Position=1-966
  misc_feature (5)..(13): Xaa can be any naturally occurring amino acid
  misc_feature (23)..(30): Xaa can be any naturally occurring amino acid
  misc_feature (35)..(46): Xaa can be any naturally occurring amino acid
  misc_feature (53)..(65): Xaa can be any naturally occurring amino acid
  misc_feature (67)..(322): Xaa can be any naturally occurring amino acid
SFRLXXXXXXXXXTHPASHRVKXXXXXXXXVEQTXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 28130 - protein, 290 aa, Diabrotica virgifera
  misc_feature: Coding regions on vcDNA: vcDNA=SeqID_7827; Strand=+; Position=23-892
  misc_feature (15)..(286): Xaa can be any naturally occurring amino acid
FKYLFKNCLQIINYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVPFP

SEQ ID NO: 28131 - protein, 66 aa, Diabrotica virgifera; identical to SEQ ID NO: 26808
  misc_feature: Coding regions on vcDNA: vcDNA=SeqID_7828; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28132 - protein, 278 aa, Diabrotica virgifera
  misc_feature: Coding regions on vcDNA: vcDNA=SeqID_7829; Strand=+; Position=71-902
  misc_feature: Homolog annotation: Hit_ID=BAA95568.1; Match level="QueryCoverage =92%, HitCoverage=53%, E-value=1e-122, Identity=83%"; Hit description= dopa decarboxylase [Tenebrio molitor]
  misc_feature: Gene Ontology Annotation: Molecular function=aromatic-L-amino acid decarboxylase activity; Cellular component=cellular_component unknown; Biological process=dopamine biosynthesis from tyrosine
  misc_feature: Pfam annotation: Pfam_ID=Pyridoxal_deC; Match level="Score=233.0, E -value=5.6e-67, Copies=1"; Pfam description=Pyridoxal-dependent decarboxylase con
  misc_feature (255)..(255): Xaa can be any naturally occurring amino acid
NFFGLILIQFREFGKEMIDYVANYLENIRERRVLPTVEPGYLRPLIPETAPEKPDKWEDIMKDIERVIMPGVTHWHSPRFHAYYPTANSYPAIVADILSGAIACIGFTWIASPACTELEVVTLDWLGKMLGLPEAFLACSGGKGGGVIQGTASEATLVALLGAKARTIDRVKKERPELSETEIVGKLVGYTSSQSHSSVERAGLLGGVKLRSVQPDESNRLSGALLEKAIQEDIEAGLIPFYAVATLGTTSSCTXFDRLDEMGPSLAQQITFGLSRDA

SEQ ID NO: 28133 - protein, 155 aa, Diabrotica virgifera
  misc_feature: Coding regions on vcDNA: vcDNA=SeqID_7830; Strand=+; Position=2-469
KKNKPKRDPEGRTTQGRGLCRGTTKHRRRSAPQSNPQKRQKTGMPKHLNRRTDKNPPENGGEQTGETGTSQSEEEPGVQRKSDRGGRRDRPGEPVRATRQRKMRSWMKSDLRRRDADTEVEAEGALEDIFYEQKCHMSGSRGGTQRRRYARAKLG

SEQ ID NO: 28134 - protein, 206 aa, Diabrotica virgifera
  misc_feature: Coding regions on vcDNA: vcDNA=SeqID_7831; Strand=+; Position=1-618
  misc_feature: Homolog annotation: Hit_ID=AAF87760.1; Match level="QueryCoverage =99%, HitCoverage=46%, E-value=2e-72, Identity=71%"; Hit description =cytochrome oxidase subunit I [Diabrotica virgifera zeae]
  misc_feature: Pfam annotation: Pfam_ID=COX1; Match level="Score=-262.4, E-value =0.024, Copies=1"; Pfam description=Cytochrome C and Quinol oxidase polype
  misc_feature (17)..(17): Xaa can be any naturally occurring amino acid
  misc_feature (34)..(34): Xaa can be any naturally occurring amino acid
  misc_feature (37)..(43): Xaa can be any naturally occurring amino acid
  misc_feature (70)..(76): Xaa can be any naturally occurring amino acid
  misc_feature (90)..(90): Xaa can be any naturally occurring amino acid
  misc_feature (98)..(114): Xaa can be any naturally occurring amino acid
  misc_feature (144)..(144): Xaa can be any naturally occurring amino acid
  misc_feature (160)..(167): Xaa can be any naturally occurring amino acid
  misc_feature (188)..(188): Xaa can be any naturally occurring amino acid
KATVIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFTLXNIVSSIGSLISLIGVXXXXXXXXEAFSFQRKRLRPLRITSSIEXLQFNPPAEHRYSELPILS

SEQ ID NO: 28135 - protein, 297 aa, Diabrotica virgifera
  misc_feature: Coding regions on vcDNA: vcDNA=SeqID_7832; Strand=-; Position=2-892
  misc_feature (7)..(274): Xaa can be any naturally occurring amino acid
DCGLGWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAVTSRPDLISSGAIMELMLLMAV

SEQ ID NO: 28136 - protein, 171 aa, Diabrotica virgifera
  misc_feature: Coding regions on vcDNA: vcDNA=SeqID_7833; Strand=+; Position=62-576
  misc_feature: Homolog annotation: Hit_ID=NP_609040.1; Match level="QueryCoverage =90%, HitCoverage=36%, E-value=3e-28, Identity=45%"; Hit description =CG9547-PA [Drosophila melanogaster] gb|AAF52395.1| CG9547-PA [Drosophila melanogaster]
  misc_feature: Gene Ontology Annotation: Molecular function=glutaryl-CoA dehydrogenase activity; Cellular component=mitochondrion; Biological process=regulation of transcription, DNA-dependent
  misc_feature (29)..(29): Xaa can be any naturally occurring amino acid
  misc_feature (60)..(60): Xaa can be any naturally occurring amino acid
  misc_feature (72)..(72): Xaa can be any naturally occurring amino acid
  misc_feature (142)..(142): Xaa can be any naturally occurring amino acid
  misc_feature (150)..(150): Xaa can be any naturally occurring amino acid
KHNYKIYISIIQIYSGDALNPETQVTDEXNRIRNQFRPYCQIETYAHRYRSKRERIFASXIINERGTLRVLXDCTILQYECSEISNIAYGLITLEIERADTSYRSTSTVQSSLAKDAIYYYVILYEQQQYLSQLAKEKYIGXFGLSEPKXGRDIGQLKNIAIYHSSSTTYI

SEQ ID NO: 28137 - protein, 126 aa, Diabrotica virgifera
  misc_feature: Coding regions on vcDNA: vcDNA=SeqID_7834; Strand=-; Position=2-379
DELCCRLDMYLCYLSLDVHTFACFLVYSATFFGVVVHKIYNLLLIFFCPFFTSLALLFFLLSPYQLRSPFGTIQVHTIFSALPMFLCSSSARPSPFLQYFFMVFIFTFFLFGAPLCSIEPIFFLFF

SEQ ID NO: 28138 - protein, 134 aa, Diabrotica virgifera
  misc_feature: Coding regions on vcDNA: vcDNA=SeqID_7835; Strand=-; Position=0-401
  misc_feature (4)..(43): Xaa can be any naturally occurring amino acid
  misc_feature (46)..(59): Xaa can be any naturally occurring amino acid
  misc_feature (61)..(81): Xaa can be any naturally occurring amino acid
  misc_feature (83)..(96): Xaa can be any naturally occurring amino acid
  misc_feature (104)..(127): Xaa can be any naturally occurring amino acid
KERXXXXXXXXXXXXXXXXXXXXXXXXXXXXXXXXXXXXXXXXSPXXXXXXXXXXXXXXTXXXXXXXXXXXXXXXXXXXXXEXXXXXXXXXXXXXXSLYIRKEXXXXXXXXXXXXXXXXXXXXXXXXTPPHHQP

SEQ ID NO: 28139 - protein, 22 aa, Diabrotica virgifera
  misc_feature: Coding regions on vcDNA: vcDNA=SeqID_7836; Strand=-; Position=1-66
  misc_feature (10)..(10): Xaa can be any naturally occurring amino acid
  misc_feature (14)..(14): Xaa can be any naturally occurring amino acid
LKSSYLLRAXYKIXPPRRLRLG

SEQ ID NO: 28140 - protein, 306 aa, Diabrotica virgifera
  misc_feature: Coding regions on vcDNA: vcDNA=SeqID_7837; Strand=+; Position=3-922
  misc_feature: Homolog annotation: Hit_ID=EAL27864.1; Match level="QueryCoverage =93%, HitCoverage=14%, E-value=1e-20, Identity=25%"; Hit description =GA11665-PA [Drosophila pseudoobscura]
  misc_feature (194)..(194): Xaa can be any naturally occurring amino acid
  misc_feature (200)..(200): Xaa can be any naturally occurring amino acid
  misc_feature (261)..(261): Xaa can be any naturally occurring amino acid
  misc_feature (274)..(274): Xaa can be any naturally occurring amino acid
KFFKKVYDLILPSLNKTLQKPQKVGQHFHEHYQGLVALIKVAMPVENCQQLWEKVQKFDSTEIFHVHLLDAIVTKVLEDSVADKLVNNIIVTFVHLQIYLFKKNVKSEVEIDKAVEVTKVFVQVLKKVKEKCTDVDFKSTANNETVKLYFKFCLKYGVSKQPVFLQALQLLIQLLSKHLEVEDGRLILDMLTSXFGVFGXVLGEYCDTKTEILSLYLELCRKWPEFMERHYVPLLLASYRGLVNKCDRIVLLLLKMYASQXDQTHFYDFKPFLXDKAAATHYSVRQQIENALWEATQNQRRPRYLT

SEQ ID NO: 28141 - protein, 143 aa, Diabrotica virgifera
  misc_feature: Coding regions on vcDNA: vcDNA=SeqID_7838; Strand=+; Position=209-639
  misc_feature: Homolog annotation: Hit_ID=JQ0154; Match level="QueryCoverage=100%, HitCoverage=37%, E-value=1e-23, Identity=45%"; Hit description=actin - Hydra attenuata sp|P17126|ACT_HYDAT ACTIN, NON-MUSCLE 6.2 gb|AAA29205.1| actin
  misc_feature: Gene Ontology Annotation: Molecular function=structural constituent of cytoskeleton; Cellular component=cytoskeleton; Biological process= actin cytoskeleton organization and biogenesis
  misc_feature (46)..(46): Xaa can be any naturally occurring amino acid
  misc_feature (74)..(74): Xaa can be any naturally occurring amino acid
SPCLHKHGKQNKTQVKLQTSNSPATYLHLQAVLSLYASASTTGMVXEAGDGVSKSVPGHEGHALDLGIVVSDVXAEDLRDYLVIILTVPASSCPHHRRILKVLDTSDNHSAITVLDFDQQRSTVASTWSLENSYVLRDAQVLT

SEQ ID NO: 28142 - protein, 191 aa, Diabrotica virgifera
  misc_feature: Coding regions on vcDNA: vcDNA=SeqID_7839; Strand=-; Position=161-735
  misc_feature: Homolog annotation: Hit_ID=AAL26582.1; Match level="QueryCoverage =96%, HitCoverage=73%, E-value=5e-69, Identity=78%"; Hit description =ribosomal protein S6 [Spodoptera frugiperda] sp|Q95V32|RS6_SPOFR 40S ribosomal protein S6
  misc_feature: Gene Ontology Annotation: Cellular component=cytosolic ribosome (sensu Eukarya); Biological process=protein biosynthesis
  misc_feature: Pfam annotation: Pfam_ID=Ribosomal_S6e; Match level="Score=60.5, E -value=4.7e-15, Copies=1"; Pfam description=Ribosomal protein S6e
  misc_feature (72)..(72): Xaa can be any naturally occurring amino acid
QGFPMNQGVLTNGRVRLFLSKGPSCSRPRRSGERKRKSVRGSIVDGNLSVLALVIVRKGEQEIPGLTDTPHXPRPLGPKRASRIRKLFNLSKEDDVRQYVVKSPLAQKEGKKLRTKAPKIQRLIPPVVLQRKRPRLALKKKRALKRKEQEDAYAKLLAQRKKESKARREMLKRGRSPRMRDSKSPPQRGQK

SEQ ID NO: 28143 - protein, 133 aa, Diabrotica virgifera
  misc_feature: Coding regions on vcDNA: vcDNA=SeqID_7840; Strand=+; Position=25-824
  misc_feature: Homolog annotation: Hit_ID=DAA01852.1; Match level="QueryCoverage =100%, HitCoverage=91%, E-value=2e-28, Identity=40%"; Hit description= TPA: zinc finger protein 458 [Mus musculus]
  misc_feature: Gene Ontology Annotation: Molecular function=DNA binding; Cellular component=nucleus; Biological process=regulation of transcription, DNA-dependent
  misc_feature: Pfam annotation: Pfam_ID=zf-C2H2; Match level="Score=63.6, E-value =5.5e-16, Copies=4"; Pfam description=Zinc finger, C2H2 type
  misc_feature (12)..(12): Xaa can be any naturally occurring amino acid
  misc_feature (44)..(44): Xaa can be any naturally occurring amino acid
  misc_feature (55)..(55): Xaa can be any naturally occurring amino acid
  misc_feature (76)..(76): Xaa can be any naturally occurring amino acid
  misc_feature (105)..(105): Xaa can be any naturally occurring amino acid
ICFKQFHLRVHXGEKPYKCEIGSAHFTTSNLKTHLRVHTTENLXKCEICFKEFYXISDSKKHLRVHTGGKPHKCEXCFKQFSRASNLKTHLMTHTGKKPHKENPXKCEICFKEFYYICTVHFDLKKHLILHTG

SEQ ID NO: 28144 - protein, 288 aa, Diabrotica virgifera
  misc_feature: Coding regions on vcDNA: vcDNA=SeqID_7841; Strand=-; Position=1-864
  misc_feature (15)..(285): Xaa can be any naturally occurring amino acid
FIIDLNSPNKITLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTS

SEQ ID NO: 28145 - protein, 85 aa, Diabrotica virgifera
  misc_feature: Coding regions on vcDNA: vcDNA=SeqID_7842; Strand=+; Position=255-512
LRSTKVYNDSRMSLFGQGLSLIRDGKCDNQRTYRKVNDAFSRQVSLFSSSKASQMRSLLRCVYAKDIGAETNLRHVHFRTSTPVK

SEQ ID NO: 28146 - protein, 49 aa, Diabrotica virgifera
  misc_feature: Coding regions on vcDNA: vcDNA=SeqID_7843; Strand=-; Position=121-270
SWYVLLPVYLSTISNTFIFHHFYLIDNFDCFSGFSDPFGFYPVDFFIPN

SEQ ID NO: 28147 - protein, 60 aa, Diabrotica virgifera
  misc_feature: Coding regions on vcDNA: vcDNA=SeqID_7844; Strand=-; Position=166-348
  misc_feature (12)..(17): Xaa can be any naturally occurring amino acid
YLSYCKTCQSNXXXXXXVFKNKARKSCEDVYNTYPYLNDMIFIIVCLCQSNMFKPYCQKS

SEQ ID NO: 28148 - protein, 79 aa, Diabrotica virgifera
  misc_feature: Coding regions on vcDNA: vcDNA=SeqID_7845; Strand=-; Position=325-564
KIQDGCSRVVKLWLALVSVSCRLPYKSNRFFVSTTSILKNVLLIWNITKSVLLRQIILLRNNGRTTSCRLATLCKRVSN

SEQ ID NO: 28149 - protein, 139 aa, Diabrotica virgifera
  misc_feature: Coding regions on vcDNA: vcDNA=SeqID_7846; Strand=+; Position=357-776
  misc_feature (56)..(64): Xaa can be any naturally occurring amino acid
  misc_feature (88)..(97): Xaa can be any naturally occurring amino acid
LYRTKGRYTMNTNTYKEVSSQHYRLLSLCEYSKASFNRNNHEIIGGRPFRITRISXXXXXXXXXLLLLNYIVLERYSCKTSLSEENTXXXXXXXXXXTLNIFIFLNFIVFCLIYLFWLKRFRLAEVLLYIRLWYHHRRH

SEQ ID NO: 28150 - protein, 18 aa, Diabrotica virgifera
  misc_feature: Coding regions on vcDNA: vcDNA=SeqID_7847; Strand=-; Position=0-53
RRQAQIDRIGLRTTVPST

SEQ ID NO: 28151 - protein, 286 aa, Diabrotica virgifera
  misc_feature: Coding regions on vcDNA: vcDNA=SeqID_7848; Strand=+; Position=24-884
  misc_feature: Homolog annotation: Hit_ID=EAA01492.2; Match level="QueryCoverage =93%, HitCoverage=89%, E-value=4e-94, Identity=64%"; Hit description =ENSANGP00000012103 [Anopheles gambiae str. PEST] ref|XP_551709.1| ENSANGP00000012103 [Anopheles gambiae st
  misc_feature: Gene Ontology Annotation: Molecular function=structural constituent of ribosome; Cellular component=cytosolic large ribosomal subunit (sensu Eukarya); Biological process=protein biosynthesis
  misc_feature: Pfam annotation: Pfam_ID=Ribosomal_L19; Match level="Score=87.2, E -value=4.2e-23, Copies=1"; Pfam description=Ribosomal protein L19
  misc_feature (284)..(284): Xaa can be any naturally occurring amino acid
QSRFCISTLSKRHSGIKRYSTVVKAAAPQANRSNKDSIRKEILEYRHMYPEFLPDPKIEFRNMLREKLERNDMLARRGHINIPEFYVGSILAVESSDPHAPGKPHRFVGICIQRTGCGLRAKFILRNIIDHQGIEISYEMYDPTMLKVEVLKLEKRLDDKLLYLRDALPEYCTFDPNMEPEILPEGSQIPVNTTKVKLKPKPWLERWERQNLQGVQDLGLPEKFYKRAEELATPWEKYDLMKEYMRTIPEEEQLEIFGEIDNKLQKLQVQGRKMKKRVFVKPTXVA

SEQ ID NO: 28152 - protein, 70 aa, Diabrotica virgifera
  misc_feature: Coding regions on vcDNA: vcDNA=SeqID_7849; Strand=+; Position=181-390
QRLSTTHDSTSSLKVPSYRKLGTRVSQSILDCDRLHVDYLRTLDSLIVVIVDYVGLLRAEQRKSIVDYPA

SEQ ID NO: 28153 - protein, 146 aa, Diabrotica virgifera
  misc_feature: Coding regions on vcDNA: vcDNA=SeqID_7850; Strand=+; Position=1-438
  misc_feature (2)..(53): Xaa can be any naturally occurring amino acid
  misc_feature (58)..(89): Xaa can be any naturally occurring amino acid
  misc_feature (95)..(114): Xaa can be any naturally occurring amino acid
  misc_feature (119)..(129): Xaa can be any naturally occurring amino acid
  misc_feature (133)..(145): Xaa can be any naturally occurring amino acid
RXXXXXXXXXXXXXXXXXXXXXXXXXXXXXXXXXXXXXXXXXXXXXXXXXXXXRGGCXXXXXXXXXXXXXXXXXXXXXXXXXXXXXXXXWGEKGXXXXXXXXXXXXXXXXXXXXTSKRXXXXXXXXXXXAYIXXXXXXXXXXXXXR

SEQ ID NO: 28154 - protein, 294 aa, Diabrotica virgifera
  misc_feature: Coding regions on vcDNA: vcDNA=SeqID_7851; Strand=+; Position=1-882
  misc_feature (3)..(41): Xaa can be any naturally occurring amino acid
  misc_feature (43)..(132): Xaa can be any naturally occurring amino acid
  misc_feature (139)..(164): Xaa can be any naturally occurring amino acid
  misc_feature (167)..(174): Xaa can be any naturally occurring amino acid
  misc_feature (176)..(191): Xaa can be any naturally occurring amino acid
  misc_feature (194)..(208): Xaa can be any naturally occurring amino acid
  misc_feature (224)..(239): Xaa can be any naturally occurring amino acid
  misc_feature (242)..(261): Xaa can be any naturally occurring amino acid
  misc_feature (267)..(277): Xaa can be any naturally occurring amino acid
  misc_feature (281)..(291): Xaa can be any naturally occurring amino acid
SSXXXXXXXXXXXXXXXXXXXXXXXXXXXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLLPRKXXXXXXXXXXXXXXXXXXXXXXXXXXRGXXXXXXXXGXXXXXXXXXXXXXXXXVGXXXXXXXXXXXXXXXKYKLSGVGCGVWWGGXXXXXXXXXXXXXXXXAKXXXXXXXXXXXXXXXXXXXXKKHQKXXXXXXXXXXXWRLXXXXXXXXXXXSLP

SEQ ID NO: 28155 - protein, 84 aa, Diabrotica virgifera
  misc_feature: Coding regions on vcDNA: vcDNA=SeqID_7852; Strand=+; Position=3-257
  misc_feature: Homolog annotation: Hit_ID=EAL32579.1; Match level="QueryCoverage =92%, HitCoverage=12%, E-value=2e-22, Identity=57%"; Hit description =GA11607-PA [Drosophila pseudoobscura]
PSASSDIPAIFSSLQGTDEDWQYKMEPSDTACLGFKDGICRCPRGKDLGGSSTINAMMYIKGNSRDYDQWAEMGNTGWDWANVK

SEQ ID NO: 28156 - protein, 102 aa, Diabrotica virgifera
  misc_feature: Coding regions on vcDNA: vcDNA=SeqID_7853; Strand=+; Position=25-333
  misc_feature: Homolog annotation: Hit_ID=AAG44630.1; Match level="QueryCoverage =96%, HitCoverage=13%, E-value=1e-26, Identity=60%"; Hit description =90-kDa heat shock protein HSP83 [Spodoptera frugiperda]
  misc_feature: Gene Ontology Annotation: Molecular function=chaperonin ATPase activity; Cellular component=centrosome; Biological process =regulation of sleep
  misc_feature (34)..(34): Xaa can be any naturally occurring amino acid
  misc_feature (45)..(45): Xaa can be any naturally occurring amino acid
  misc_feature (87)..(87): Xaa can be any naturally occurring amino acid
ERWGEKYTLDGERNGSQPVWTTNADDITQEEYGXFYKALTNDWEXHLAGKQFSGEDQVEITAMESVTRHGPFDLLVNKKNDNNIECXVRRGVIMEDCATPCP

SEQ ID NO: 28157 - protein, 94 aa, Diabrotica virgifera
  misc_feature: Coding regions on vcDNA: vcDNA=SeqID_7854; Strand=+; Position=3-287
  misc_feature (9)..(15): Xaa can be any naturally occurring amino acid
AKQKILITXXXXXXXFFFIALPLNPSTGTPNNELPRFLINSLAIPFTVWGLIGSGFLNFLGIPLNDLFFFFKPFLSEGEGSSTILLLQPSRTSL

SEQ ID NO: 28158 - protein, 161 aa, Diabrotica virgifera
  misc_feature: Coding regions on vcDNA: vcDNA=SeqID_7855; Strand=+; Position=2-487
KMGRLEVRGGNSRAAPPAPLHEESGRRCATLIFAGSCLQLCNIGNVKFLVVCMIFAIVSTHTTRKYIKWKKKALHGLRLCHIATYRRRVALEDRVRKNLNSTHFLLYDKMQFLHVPTICKLGIGSETAKSATKNARTDIRSHLQRDHSLCLNVWLRYLTSL

SEQ ID NO: 28159 - protein, 51 aa, Diabrotica virgifera
  misc_feature: Coding regions on vcDNA: vcDNA=SeqID_7856; Strand=+; Position=705-857
  misc_feature (49)..(49): Xaa can be any naturally occurring amino acid
KLVKDTHKNTPFKVDEKTRAEMFKLRQTWNEVFPQMKLYAIDVQISLLXSA

SEQ ID NO: 28160 - protein, 87 aa, Diabrotica virgifera
  misc_feature: Coding regions on vcDNA: vcDNA=SeqID_7857; Strand=+; Position=549-812
  misc_feature (82)..(82): Xaa can be any naturally occurring amino acid
  misc_feature (86)..(86): Xaa can be any naturally occurring amino acid
PCRCVKDTQFLRWSFYLWIQTFSGPRVREKKLSFHYIQIPLHRVNTYSILIGTLTLLQYNIEFHLIWSNFKWFFYFMGPTFXIMIXN

SEQ ID NO: 28161 - protein, 47 aa, Diabrotica virgifera
  misc_feature: Coding regions on vcDNA: vcDNA=SeqID_7858; Strand=-; Position=2-142
FVLSLLIPFLKFDTDLKDAMKRKKARFQTRVKFEERYKQGKNHLFFP

SEQ ID NO: 28162 - protein, 146 aa, Diabrotica virgifera
  misc_feature: Coding regions on vcDNA: vcDNA=SeqID_7859; Strand=-; Position=1-438
  misc_feature (5)..(24): Xaa can be any naturally occurring amino acid
  misc_feature (27)..(34): Xaa can be any naturally occurring amino acid
  misc_feature (57)..(70): Xaa can be any naturally occurring amino acid
  misc_feature (91)..(146): Xaa can be any naturally occurring amino acid
PLDPXXXXXXXXXXXXXXXXXXXXPFXXXXXXXXEIDTHPGSHRLKLRSCKIIRVEXXXXXXXXXXXXXXSNIEVAIFIIDVNSPIKLRCXXXXXXXXXXXXXXXXXXXXXXXXXXXXXXXXXXXXXXXXXXXXXXXXXXXXXXXX

SEQ ID NO: 28163 - protein, 83 aa, Diabrotica virgifera
  misc_feature: Coding regions on vcDNA: vcDNA=SeqID_7860; Strand=-; Position=159-410
  misc_feature: Homolog annotation: Hit_ID=CAD22154.1; Match level="QueryCoverage =92%, HitCoverage=50%, E-value=3e-30, Identity=71%"; Hit description =pherophorin-dz1 protein [Volvox carteri f. nagariensis]
  misc_feature: Gene Ontology Annotation: Molecular function=actin binding; Cellular component=actin cytoskeleton; Biological process=G-protein signaling, coupled to cAMP nucleotide second messenger
  misc_feature (14)..(14): Xaa can be any naturally occurring amino acid
  misc_feature (24)..(24): Xaa can be any naturally occurring amino acid
  misc_feature (48)..(48): Xaa can be any naturally occurring amino acid
  misc_feature (54)..(54): Xaa can be any naturally occurring amino acid
  misc_feature (58)..(58): Xaa can be any naturally occurring amino acid
SLPPPPYPPPPPPXPPPPPPPPPXLLPLPYPPPPPLEPPYPPPCWPPXPPPPPXPPPXPPPWPPLLWPQEPPPPPPPEAGAAA

SEQ ID NO: 28164 - protein, 93 aa, Diabrotica virgifera
  misc_feature: Coding regions on vcDNA: vcDNA=SeqID_7861; Strand=-; Position=142-423
  misc_feature (34)..(45): Xaa can be any naturally occurring amino acid
HFSSSDARFRIRSLYCDPSVPEAAASTMSYSRSXXXXXXXXXXXXSIFIQVATLLALRQPAFQLGSFTVTGLSSLAFVAVDSVVWCGLSTKNP

SEQ ID NO: 28165 - protein, 76 aa, Diabrotica virgifera
  misc_feature: Coding regions on vcDNA: vcDNA=SeqID_7862; Strand=-; Position=71-301
LTITHPFTGRSTFTVSLLDHSMCHMMPIPNRTPCILTTNYTKQSHLFRMVYGCPTPRSNSLRVIYNYLNSQSVNRF

SEQ ID NO: 28166 - protein, 90 aa, Diabrotica virgifera
  misc_feature: Coding regions on vcDNA: vcDNA=SeqID_7863; Strand=-; Position=72-344
SKYESVNGDIKYCSMIASNLILLSINSLRTSIHTFYRALCSLPCVPETFDGKGRYRLAELPVSMNYAIAVMRSYTIRSSGYRRFLAVNKA

SEQ ID NO: 28167 - protein, 87 aa, Diabrotica virgifera
  misc_feature: Coding regions on vcDNA: vcDNA=SeqID_7864; Strand=-; Position=350-613
LIPTISNSNTMSVMLFCIFWTFCYPVSQKPVMLWLFDYLHALGISASFKSFLLNLFKNEPPDSLRLPASYRGYLSTATRGSVPLQSV

SEQ ID NO: 28168 - protein, 35 aa, Diabrotica virgifera
  misc_feature: Coding regions on vcDNA: vcDNA=SeqID_7865; Strand=+; Position=1-105
  misc_feature (3)..(3): Xaa can be any naturally occurring amino acid
  misc_feature (7)..(7): Xaa can be any naturally occurring amino acid
  misc_feature (9)..(35): Xaa can be any naturally occurring amino acid
KAXIFLXTXXXXXXXXXXXXXXXXXXXXXXXXXXX

SEQ ID NO: 28169 - protein, 121 aa, Diabrotica virgifera
  misc_feature: Coding regions on vcDNA: vcDNA=SeqID_7866; Strand=+; Position=440-802
  misc_feature (98)..(98): Xaa can be any naturally occurring amino acid
EAKQSYLIAKTCADYRIISLLNHLLKIFHGRIYNKCEEYLDDTQFGFRNGFGTREALFGMNVLAQRCRDISVDIYCWFIDFIKAFDRVKHSILIEALXDILGTQRYSNNCKFFIGIKQHQF

SEQ ID NO: 28170 - protein, 220 aa, Diabrotica virgifera
  misc_feature: Coding regions on vcDNA: vcDNA=SeqID_7867; Strand=+; Position=306-965
  misc_feature: Homolog annotation: Hit_ID=XP_321046.1; Match level="QueryCoverage =92%, HitCoverage=40%, E-value=4e-48, Identity=49%"; Hit description =ENSANGP00000007850 [Anopheles gambiae]
  misc_feature: Gene Ontology Annotation: Molecular function=transporter activity; Cellular component=integral to membrane; Biological process=transport
  misc_feature: Pfam annotation: Pfam_ID=Ammonium_transp; Match level="Score=-214.5, E-value=0.017, Copies=1"; Pfam description=Ammonium Transporter Family
  misc_feature (93)..(93): Xaa can be any naturally occurring amino acid
  misc_feature (147)..(147): Xaa can be any naturally occurring amino acid
  misc_feature (153)..(153): Xaa can be any naturally occurring amino acid
  misc_feature (158)..(158): Xaa can be any naturally occurring amino acid
TVTIEKLKAKCAAVFQDVHVMIFIGFGFLMTFLKRYGYSSVGFTLLLGSFIIQWAILCQGFFELNADYKIEIGIESIYRADIAAASVLISVGXVLGRTTVLHLLIMGLIEIVVFSANSYLGTKVLQVADAGGSIFVHAFGAYFGLAXVSYVLXGKRRXKEGNSETAASLAEANYTSGLGCHDKVLCSLWIYWASFNAIEIESSQKSTAIVNTYLALACLY

SEQ ID NO: 28171 - protein, 208 aa, Diabrotica virgifera
  misc_feature: Coding regions on vcDNA: vcDNA=SeqID_7868; Strand=+; Position=1-627
  misc_feature: Homolog annotation: Hit_ID=EAL34261.1; Match level="QueryCoverage =95%, HitCoverage=15%, E-value=6e-69, Identity=57%"; Hit description =GA21563-PA [Drosophila pseudoobscura]
  misc_feature: Gene Ontology Annotation: Molecular function=ATP binding; Cellular component=cytoplasm; Biological process='de novo' IMP biosynthesis
AKGWAASILFNKTVREQFDKFFARRDTFSLGVCNGCQLMALIGWVGTPVNEGTKPDIMMEHNLSERFECRWSTIKIEKSKAIMIKGMEGSSFGVWVAHGEGRFTFKSDTIYDQLKSEELVALRYVDDNGKPTEIYPMNPNGSIEGLAGVCSEDGRHLAMMPHPERCVQPFQWPYMPQSWVHYKKSPWEKMFRNAYEWCRSNKFHNVYY

SEQ ID NO: 28172 - protein, 81 aa, Diabrotica virgifera
  misc_feature: Coding regions on vcDNA: vcDNA=SeqID_7869; Strand=+; Position=455-700
  misc_feature (49)..(79): Xaa can be any naturally occurring amino acid
LERVTNPEWMQIMNSHSITDFCLTGKQKVQNIQKSKTYILLLFEIFGIXXXXXXXXXXXXXXXXXXXXXXXXXXXXXXXAR

SEQ ID NO: 28173 - protein, 29 aa, Diabrotica virgifera
  misc_feature: Coding regions on vcDNA: vcDNA=SeqID_7870; Strand=-; Position=1-87
  misc_feature (3)..(25): Xaa can be any naturally occurring amino acid
HEXXXXXXXXXXXXXXXXXXXXXXXSDVK

SEQ ID NO: 28174 - protein, 50 aa, Diabrotica virgifera
  misc_feature: Coding regions on vcDNA: vcDNA=SeqID_7871; Strand=-; Position=68-220
CASTNISSHSLYQLSMIKVAIRKRGVVVIHDNTRFYQSRSKVIRELYKRY

SEQ ID NO: 28175 - protein, 106 aa, Diabrotica virgifera
  misc_feature: Coding regions on vcDNA: vcDNA=SeqID_7872; Strand=-; Position=1-318
SLTADIGFEPVRSSSVHLSWIFKVRGEDPASVASCGALCASNHIFLLEDSMELERLYRRESSSSHICSMSPGLNGFPRRTLLRGHDYLSVTMTGFRNRNRIGGGGG

SEQ ID NO: 28176 - protein, 264 aa, Diabrotica virgifera
  misc_feature: Coding regions on vcDNA: vcDNA=SeqID_7873; Strand=+; Position=64-858
  misc_feature: Homolog annotation: Hit_ID=EAA10900.2; Match level="QueryCoverage =80%, HitCoverage=90%, E-value=3e-28, Identity=32%"; Hit description =ENSANGP00000018758 [Anopheles gambiae str. PEST] ref|XP_556414.1| ENSANGP00000018758 [Anopheles gambiae st
  misc_feature (194)..(201): Xaa can be any naturally occurring amino acid
MDFNDISSQDYVDLLLREGRKIRCDNTSEAFKTQTTLPSYYDKRLFKRGQKFINKHLYAMGLSQTFGLISIYAISSIINVLRTTTRNSTALAMYKRQIPAFFIMDVLYTSDCEPGSKFWKAISFIKHMHNSSSKGSIRAKSNPINQKDMVLSQFLFLGFPLVRGEMCGFHGITKEEREGFIHFWRVIGYLLGIXXXXXXXXFPTHKVIDICDLLIDQAFRPEIEKKLPLMLETSNYICTAVSTVIPELTTTFALNPIYLETILL

SEQ ID NO: 28177 - protein, 65 aa, Diabrotica virgifera
  misc_feature: Coding regions on vcDNA: vcDNA=SeqID_7874; Strand=+; Position=1-198
  misc_feature (10)..(16): Xaa can be any naturally occurring amino acid
EKYCLIHDTXXXXXXXYLGNPHEFNNRSIDRTLTLRISSTQECILYVLLFKVIFLYIDVNYITIM

SEQ ID NO: 28178 - protein, 241 aa, Diabrotica virgifera
  misc_feature: Coding regions on vcDNA: vcDNA=SeqID_7875; Strand=+; Position=33-758
  misc_feature: Homolog annotation: Hit_ID=AAM50570.1; Match level="QueryCoverage =85%, HitCoverage=50%, E-value=3e-22, Identity=27%"; Hit description =AT24407p [Drosophila melanogaster]
  misc_feature: Gene Ontology Annotation: Molecular function=molecular_function unknown
  misc_feature (60)..(68): Xaa can be any naturally occurring amino acid
RSVPLAIKIRNPELFKQEIRPHLNNGLHGSGGFEMALPIIEAILNESQKCAPLVPKIQKXXXXXXXXXEDNEAKEPFATFSHGDPWVNNIMVKYANGVATELKFVDFQVYEYASPVADFLYFMFTSVQNNVLKENIDDFLKFYHSSLLQNLKELGCDLEPFGYDRFLKEFEEHTYISLIWVLTFIPFVVFGKKGDDSTVPSFQDIKFSDSLSVEDARKRLPQVVKDKIHFIVEYSARNNWI

SEQ ID NO: 28179 - protein, 236 aa, Diabrotica virgifera
  misc_feature: Coding regions on vcDNA: vcDNA=SeqID_7876; Strand=-; Position=168-878
  misc_feature: Homolog annotation: Hit_ID=EAA04109.2; Match level="QueryCoverage =97%, HitCoverage=27%, E-value=2e-58, Identity=52%"; Hit description =ENSANGP00000011212 [Anopheles gambiae str. PEST] ref|XP_565075.1| ENSANGP00000011212 [Anopheles gambiae st
  misc_feature: Gene Ontology Annotation: Cellular component=mitochondrion; Biological process=glycine metabolism
  misc_feature: Pfam annotation: Pfam_ID=GCV_T; Match level="Score=-30.7, E-value =7.8e-06, Copies=1"; Pfam description=Glycine cleavage T-protein (aminometh
RIEFSLYKTKKWRILQSITEFPITNEQLPYGMSKILKINGHTCRVLRISYIGELGYEIPIPLASCIPVYNKIMEAGRGFDLKHAGFKALESLSLEKGYHLLNHDLRLDDNPIEAGLGAFCRKDGQYLGKQAVEKFKQGVTKRRVFFTLQEPVAIYGNETIWRDDVIVGILRRGDYGFSLDSTIGTGYVEHPKGKVIDNEFLKNGTYHIEVRNKKYPASLYLRSPFDPKNLRLKGDI

SEQ ID NO: 28180 - protein, 31 aa, Diabrotica virgifera
  misc_feature: Coding regions on vcDNA: vcDNA=SeqID_7877; Strand=+; Position=1-93
  misc_feature (9)..(9): Xaa can be any naturally occurring amino acid
  misc_feature (14)..(14): Xaa can be any naturally occurring amino acid
VLYHILLRXVLPEXNKMSLADPVAFMKDFLA

SEQ ID NO: 28181 - protein, 159 aa, Diabrotica virgifera
  misc_feature: Coding regions on vcDNA: vcDNA=SeqID_7878; Strand=+; Position=2-478
  misc_feature: Homolog annotation: Hit_ID=XP_393388.1; Match level="QueryCoverage =100%, HitCoverage=13%, E-value=2e-38, Identity=49%"; Hit description= similar to ENSANGP00000004277 [Apis mellifera]
  misc_feature: Gene Ontology Annotation: Molecular function=15-hydroxyprostaglandin dehydrogenase (NAD+) activity; Cellular component=cellular_component unknown; Biological process=biological_process unknown
  misc_feature: Pfam annotation: Pfam_ID=ABC_tran; Match level="Score=-45.7, E-value =0.015, Copies=1"; Pfam description=ABC transporter
  misc_feature (98)..(104): Xaa can be any naturally occurring amino acid
VLRVCALEKDLALFPHADRTLVGERGVMLSGGQRARINLARAIYKESDIYLLDDPLSAVDTHVGKQLYTNCITGYLKHKCVILVTHQLQYLRTANCIXXXXXXXIRASGTYQALKNSDSAFTKLLASSKDEEKKDGARRISKAESVESEASEAEHEAIE

SEQ ID NO: 28182 - protein, 120 aa, Diabrotica virgifera
  misc_feature: Coding regions on vcDNA: vcDNA=SeqID_7879; Strand=+; Position=1-362
  misc_feature: Homolog annotation: Hit_ID=AAP76391.1; Match level="QueryCoverage =92%, HitCoverage=26%, E-value=4e-21, Identity=45%"; Hit description =cytochrome P450 CYP6M4 [Anopheles gambiae]
  misc_feature: Gene Ontology Annotation: Molecular function=cytochrome P450 activity; Cellular component=membrane; Biological process=electron transport
  misc_feature (72)..(72): Xaa can be any naturally occurring amino acid
LCPEKGDPLSGNLFNLRDDKWRNMRAKLTPTFTTGKLKMMFQTMMDASSGLEKILENNRTSKEPIDIKDSLXASLVDIITSVAFGIESKSMDNPDSEFKAIANKLLGPPPRALQKRTIFT

SEQ ID NO: 28183 - protein, 150 aa, Diabrotica virgifera
  misc_feature: Coding regions on vcDNA: vcDNA=SeqID_7880; Strand=-; Position=2-451
  misc_feature: Homolog annotation: Hit_ID=NP_507408.1; Match level="QueryCoverage =80%, HitCoverage=7%, E-value=1e-11, Identity=29%"; Hit description =predicted CDS, polyprotein family member (5R896) [Caenorhabditis elegans] pir||T25352 hypothetical
LSFLKSNHKNLLGTKNCNQLCASEVEINAGIRQGDSLSPLLFNLVLDKIIENIKGTGNGYKMAEKQIKILCYADDAILISDNEDNLQRMAQTFNTVAKNYNMKISTANTKSLVVSREPIRCKLVINNELIEQVSKFQYLGIEICSYGDVK

SEQ ID NO: 28184 - protein, 75 aa, Diabrotica virgifera
  misc_feature: Coding regions on vcDNA: vcDNA=SeqID_7881; Strand=+; Position=239-463
NNNWTTRTALDKLLAIQTGLIGYLVLYYQGGITKAIADLLVYVTACYVMMLGMTPLEFLGARHTLTIFVGGGGER

SEQ ID NO: 28185 - protein, 243 aa, Diabrotica virgifera
  misc_feature: Coding regions on vcDNA: vcDNA=SeqID_7882; Strand=+; Position=153-881
  misc_feature: Homolog annotation: Hit_ID=AAH79922.1; Match level="QueryCoverage =80%, HitCoverage=52%, E-value=4e-18, Identity=29%"; Hit description =Fancl-prov protein [Xenopus tropicalis] ref|NP_001007482.1| fancl -prov protein [Xenopus tropicalis]
  misc_feature (217)..(217): Xaa can be any naturally occurring amino acid
  misc_feature (235)..(235): Xaa can be any naturally occurring amino acid
  misc_feature (237)..(237): Xaa can be any naturally occurring amino acid
TSLRSHISLKIPTDKVTNHSDTYRQVLCEYLEFTKFYLNLKSSYLAFDLSKISITMFDESNREHSVVIRVNYNDRNIFEIVDCDLPCEMENFQKSSNLKAVYNQFVEDVERLQLFFNLMEDFDKNCNILDPVPPKKRYNFRRIWLGETLSVIITVDPFSLGRMPTIIFLGPERMVETYRMTMNNNLENWDTNNCIFSEILKLIGLDKFPTKPINEGXQDDLLLEAGDCSICFSYXIXDNARNR

SEQ ID NO: 28186 - protein, 77 aa, Diabrotica virgifera
  misc_feature: Coding regions on vcDNA: vcDNA=SeqID_7883; Strand=-; Position=429-662
FISYMFILNTSASVIILNYLNIMSLKFRILKIAQIKYLVFSFICLVMGNMNIFLKSRINVTPMSVTEFSHVNRAIKQ

SEQ ID NO: 28187 - protein, 81 aa, Diabrotica virgifera
  misc_feature: Coding regions on vcDNA: vcDNA=SeqID_7884; Strand=+; Position=3-245
  misc_feature: Homolog annotation: Hit_ID=XP_321416.1; Match level="QueryCoverage =100%, HitCoverage=11%, E-value=5e-24, Identity=66%"; Hit description= ENSANGP00000022171 [Anopheles gambiae]
  misc_feature: Gene Ontology Annotation: Cellular component=focal adhesion; Biological process=cell-substrate junction assembly
  misc_feature (48)..(48): Xaa can be any naturally occurring amino acid
  misc_feature (57)..(57): Xaa can be any naturally occurring amino acid
  misc_feature (68)..(68): Xaa can be any naturally occurring amino acid
IRHFLIEPTSSGVRLKGCQNEPVFSSLSALIYQHSITQMALPCRLILXNEDLRYSEXNGVQQQSLYTXGAACNVLYLSTID

SEQ ID NO: 28188 - protein, 240 aa, Diabrotica virgifera
  misc_feature: Coding regions on vcDNA: vcDNA=SeqID_7885; Strand=-; Position=0-719
  misc_feature (2)..(3): Xaa can be any naturally occurring amino acid
  misc_feature (5)..(30): Xaa can be any naturally occurring amino acid
  misc_feature (33)..(210): Xaa can be any naturally occurring amino acid
  misc_feature (212)..(239): Xaa can be any naturally occurring amino acid
SXXFXXXXXXXXXXXXXXXXXXXXXXXXXXGGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXG

SEQ ID NO: 28189 - protein, 124 aa, Diabrotica virgifera
  misc_feature: Coding regions on vcDNA: vcDNA=SeqID_7886; Strand=+; Position=330-701
  misc_feature: Homolog annotation: Hit_ID=XP_143000.4; Match level="QueryCoverage =81%, HitCoverage=24%, E-value=1e-10, Identity=34%"; Hit description =similar to zinc finger protein 347; zinc finger 1111 [Mus musculus]
  misc_feature (51)..(51): Xaa can be any naturally occurring amino acid
  misc_feature (67)..(67): Xaa can be any naturally occurring amino acid
  misc_feature (74)..(74): Xaa can be any naturally occurring amino acid
DEFSLKKSTCSASRTSGKFRYIHFSTTRTFYIHLRLRTGEHTYNRDTCFRXFPHKRHLHTRLRVHTXDTPYNSXNYVYAQIDRYISLCTHTKVHTGQAPYYYRRICFTQCRYNISLIAHTKVHT

SEQ ID NO: 28190 - protein, 66 aa, Diabrotica virgifera
  misc_feature: Coding regions on vcDNA: vcDNA=SeqID_7887; Strand=+; Position=180-380
  misc_feature (50)..(55): Xaa can be any naturally occurring amino acid
MSIDVWKKSTTRRYKTDALYIGATSVYSVFAVKGDSWVRLASVVRIHAEXXXXXXSLITPPLCYRR

SEQ ID NO: 28191 - protein, 255 aa, Diabrotica virgifera
  misc_feature: Coding regions on vcDNA: vcDNA=SeqID_7888; Strand=+; Position=1-768
  misc_feature (3)..(40): Xaa can be any naturally occurring amino acid
  misc_feature (44)..(64): Xaa can be any naturally occurring amino acid
  misc_feature (67)..(104): Xaa can be any naturally occurring amino acid
  misc_feature (109)..(115): Xaa can be any naturally occurring amino acid
  misc_feature (124)..(148): Xaa can be any naturally occurring amino acid
  misc_feature (150)..(165): Xaa can be any naturally occurring amino acid
  misc_feature (176)..(183): Xaa can be any naturally occurring amino acid
  misc_feature (191)..(255): Xaa can be any naturally occurring amino acid
VPXXXXXXXXXXXXXXXXXXXXXXXXXXXXXXXXXXXXXXSKRXXXXXXXXXXXXXXXXXXXXXHLXXXXXXXXXXXXXXXXXXXXXXXXXXXXXXXXXXXXXXHFKIXXXXXXXSLLFLLFIXXXXXXXXXXXXXXXXXXXXXXXXXYXXXXXXXXXXXXXXXXLHPVIKNTSFXXXXXXXXRPPINLNXXXXXXXXXXXXXXXXXXXXXXXXXXXXXXXXXXXXXXXXXXXXXXXXXXXXXXXXXXXXXXXXX

SEQ ID NO: 28192 - protein, 220 aa, Diabrotica virgifera
  misc_feature: Coding regions on vcDNA: vcDNA=SeqID_7889; Strand=+; Position=1-660
  misc_feature (10)..(69): Xaa can be any naturally occurring amino acid
  misc_feature (71)..(79): Xaa can be any naturally occurring amino acid
  misc_feature (98)..(115): Xaa can be any naturally occurring amino acid
  misc_feature (120)..(129): Xaa can be any naturally occurring amino acid
  misc_feature (139)..(166): Xaa can be any naturally occurring amino acid
  misc_feature (171)..(213): Xaa can be any naturally occurring amino acid
  misc_feature (216)..(216): Xaa can be any naturally occurring amino acid
KKKKPGEEAXXXXXXXXXXXXXXXXXXXXXXXXXXXXXXXXXXXXXXXXXXXXXXXXXXXXXXXXXXXXNXXXXXXXXXPTTPLLFLRKKPPHPRPTXXXXXXXXXXXXXXXXXXGWAAXXXXXXXXXXGHKHKPHRLXXXXXXXXXXXXXXXXXXXXXXXXXXXXLPPSXXXXXXXXXXXXXXXXXXXXXXXXXXXXXXXXXXXXXXXXXXXLFXVLPS

SEQ ID NO: 28193 - protein, 130 aa, Diabrotica virgifera
  misc_feature: Coding regions on vcDNA: vcDNA=SeqID_7890; Strand=-; Position=419-811
  misc_feature (1)..(1): Xaa can be any naturally occurring amino acid
  misc_feature (29)..(36): Xaa can be any naturally occurring amino acid
XSGFRINLQENDLNIKHLEMVKQSQENMXXXXXXXXNLLPPASLYKQFCLFISEFTPLWKVVTPFCQTICFLYMINKTLHAKRSDKDHWNIFNLKITHNPIKILAQRIFPGESNRGFQKKHVGTQNDKTL

SEQ ID NO: 28194 - protein, 61 aa, Diabrotica virgifera
  misc_feature: Coding regions on vcDNA: vcDNA=SeqID_7891; Strand=+; Position=131-316
  misc_feature (42)..(56): Xaa can be any naturally occurring amino acid
NVKASVIEVAPRNSDLWSAVTVNSKESIYAMRGVPYTCKLIXXXXXXXXXXXXXXXYFIQF

SEQ ID NO: 28195 - protein, 66 aa, Diabrotica virgifera; identical to SEQ ID NO: 26808
  misc_feature: Coding regions on vcDNA: vcDNA=SeqID_7892; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28196 - protein, 101 aa, Diabrotica virgifera
  misc_feature: Coding regions on vcDNA: vcDNA=SeqID_7893; Strand=-; Position=447-752
  misc_feature: Homolog annotation: Hit_ID=NP_996203.1; Match level="QueryCoverage =68%, HitCoverage=38%, E-value=5e-12, Identity=53%"; Hit description =CG16901-PD, isoform D [Drosophila melanogaster] gb|AAS65146.1| CG16901-PD, isoform D [Drosophila
  misc_feature: Gene Ontology Annotation: Cellular component=nuclear speck
MKKTASSTWQIPRQIFWLNKFSGRSLPTRPYGYGQGYGYDGYSQGYDYYGSGYGGYGGYDYSNYGGGNYGGAGGYQSGGAGGGPKQRGAGQRNQRFQPYQK

SEQ ID NO: 28197 - protein, 188 aa, Diabrotica virgifera; identical to SEQ ID NO: 21982
  misc_feature: Coding regions on vcDNA: vcDNA=SeqID_7894; Strand=+; Position=14-580
  misc_feature: Homolog annotation: Hit_ID=XP_392565.1; Match level="QueryCoverage =100%, HitCoverage=100%, E-value=3e-90, Identity=85%"; Hit description=similar to ribosomal protein L18 [Apis mellifera]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_L18e; Match level="Score=428.8, E -value=6.4e-126, Copies=1"; Pfam description=Eukaryotic ribosomal protein L18

SEQ ID NO: 28198 - protein, 150 aa, Diabrotica virgifera
  misc_feature: Coding regions on vcDNA: vcDNA=SeqID_7895; Strand=-; Position=70-520
  misc_feature: Homolog annotation: Hit_ID=CAF88338.1; Match level="QueryCoverage =74%, HitCoverage=47%, E-value=4e-20, Identity=41%"; Hit description =unnamed protein product [Tetraodon nigroviridis]
  misc_feature (57)..(57): Xaa can be any naturally occurring amino acid
  misc_feature (74)..(74): Xaa can be any naturally occurring amino acid
  misc_feature (82)..(82): Xaa can be any naturally occurring amino acid
  misc_feature (112)..(112): Xaa can be any naturally occurring amino acid
SQKGNIIIGNSSKATDTVLQITNTYGYEEFPRGDSHEYTATDDGVDISSTIWKDNKXVVLLSTFAGISPIYKIXRFDKTAKXSTEVDCPFVIKEYNRHMGGVDLVESHIGRXKISIKSRKWYLRLFYHLLDLTVANSWILYKRATVAKNP

SEQ ID NO: 28199 - protein, 132 aa, Diabrotica virgifera
  misc_feature: Coding regions on vcDNA: vcDNA=SeqID_7896; Strand=-; Position=2-397
  misc_feature (129)..(129): Xaa can be any naturally occurring amino acid
NIKHRLLTKQNMIIAINLEYTYSIVIFVKLNIYISNRQPRRLNIMPVTFLNPSNICTGMSIYHGFKYIIFDFNKSTKNTGAILPYNILLLNHLSNLQLAQTRHIVYLDVLQYLCTLFMYTSIFVLIKYXSDD

SEQ ID NO: 28200 - protein, 60 aa, Diabrotica virgifera
  misc_feature: Coding regions on vcDNA: vcDNA=SeqID_7897; Strand=+; Position=93-275
  misc_feature (15)..(19): Xaa can be any naturally occurring amino acid
LQFCNRAFHRLSFSXXXXXVSHNINVSTSYVFGLYHWYIPITYDVDILILCDNMTGARNK

SEQ ID NO: 28201 - protein, 254 aa, Diabrotica virgifera
  misc_feature: Coding regions on vcDNA: vcDNA=SeqID_7898; Strand=+; Position=3-764
  misc_feature: Homolog annotation: Hit_ID=AAF87756.1; Match level="QueryCoverage =100%, HitCoverage=57%, E-value=4e-87, Identity=68%"; Hit description= cytochrome oxidase subunit I [Diabrotica lemniscata]
  misc_feature: Pfam annotation: Pfam_ID=COX1; Match level="Score=-73.7, E-value=9.9e- 09, Copies=1"; Pfam description=Cytochrome C and Quinol oxidase polyp
  misc_feature (8)..(16): Xaa can be any naturally occurring amino acid
  misc_feature (20)..(26): Xaa can be any naturally occurring amino acid
  misc_feature (37)..(44): Xaa can be any naturally occurring amino acid
  misc_feature (65)..(65): Xaa can be any naturally occurring amino acid
  misc_feature (100)..(100): Xaa can be any naturally occurring amino acid
  misc_feature (117)..(117): Xaa can be any naturally occurring amino acid
  misc_feature (120)..(126): Xaa can be any naturally occurring amino acid
  misc_feature (153)..(159): Xaa can be any naturally occurring amino acid
  misc_feature (173)..(173): Xaa can be any naturally occurring amino acid
  misc_feature (181)..(197): Xaa can be any naturally occurring amino acid
  misc_feature (227)..(227): Xaa can be any naturally occurring amino acid
  misc_feature (243)..(250): Xaa can be any naturally occurring amino acid
GGGDPILXXXXXXXXXHPEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFS

SEQ ID NO: 28202 - protein, 60 aa, Diabrotica virgifera
  misc_feature: Coding regions on vcDNA: vcDNA=SeqID_7899; Strand=-; Position=120-302
PRCGEFDNSYRLFTNLSLVHHRLRCPCQVFLTRELCLPLASVRRDANSTRLEGIIVWGII

SEQ ID NO: 28203 - protein, 41 aa, Diabrotica virgifera
  misc_feature: Coding regions on vcDNA: vcDNA=SeqID_7900; Strand=-; Position=1-123
  misc_feature (11)..(41): Xaa can be any naturally occurring amino acid
KKFRLFIPLRXXXXXXXXXXXXXXXXXXXXXXXXXXXXXXX

SEQ ID NO: 28204 - protein, 237 aa, Diabrotica virgifera
  misc_feature: Coding regions on vcDNA: vcDNA=SeqID_7901; Strand=-; Position=3-712
  misc_feature: Homolog annotation: Hit_ID=ZP_00263974.1; Match level="QueryCoverage =98%, HitCoverage=37%, E-value=1e-114, Identity=93%"; Hit description= COG0443: Molecular chaperone [Pseudomonas fluorescens PfO-1]
  misc_feature: Gene Ontology Annotation: Biological process=protein-mitochondrial targeting
  misc_feature: Pfam annotation: Pfam_ID=HSP70; Match level="Score=-152.0, E-value =3.2e-11, Copies=1"; Pfam description=Hsp70 protein
  misc_feature (15)..(15): Xaa can be any naturally occurring amino acid
EAFDSWMESMVARSXEQHCRRSVRDSGVELEDVAAVVMVGGSTRVPRVREAVAEAFGRQPLTEIDPDQVVAIGAAIQADTLAGNKRDGGELLLLDVIPLSLGLETMGGLMEKVIPRNTTIPVARAQDFTTYKDGQTAMMIHVLQGERELISDCRSLARFELRGIPAMVAGAAKIRVTFQVDADGLLSVAARELASGVEASIQVKPSYGLTDGEIAKMLKDSFQYAGDDKVARVCESS

SEQ ID NO: 28205 - protein, 270 aa, Diabrotica virgifera
  misc_feature: Coding regions on vcDNA: vcDNA=SeqID_7902; Strand=+; Position=57-866
  misc_feature: Pfam annotation: Pfam_ID=zf-AD; Match level="Score=43.1, E-value=8.3e- 10, Copies=1"; Pfam description=Zinc-finger associated domain (zf-AD)
  misc_feature (258)..(258): Xaa can be any naturally occurring amino acid
SQTKMDRLEINKKKFCRLCLSETVISHSLLNDDNAVFLEALTAIKIDEDEPFPTIACVKCCCNLKFAFQIQQNILEADRKLHMLEEINIDELDIKNRLVDNVVEVEEKVQSVGECIVDHDYGLSSTDPSTPLSRNSPKSTLSELETEELKIGVQCEAVKSELKSDEDNSVDNLFVTETETEEPVLFANFLSAEANTDDCEKVPCKICGQEFLDKDMLDHVQFHYFSTIKCDECNMNCANIHTYREHLADAHKDILLVXRWTCKFAMDPSL

SEQ ID NO: 28206 - protein, 302 aa, Diabrotica virgifera
  misc_feature: Coding regions on vcDNA: vcDNA=SeqID_7903; Strand=-; Position=15-919
  misc_feature: Homolog annotation: Hit_ID=AAF87760.1; Match level="QueryCoverage =98%, HitCoverage=67%, E-value=1e-122, Identity=77%"; Hit description= cytochrome oxidase subunit I [Diabrotica virgifera zeae]
  misc_feature: Pfam annotation: Pfam_ID=COX1; Match level="Score=95.6, E-value=1.3e -25, Copies=1"; Pfam description=Cytochrome C and Quinol oxidase polyp
  misc_feature (13)..(13): Xaa can be any naturally occurring amino acid
  misc_feature (26)..(32): Xaa can be any naturally occurring amino acid
  misc_feature (64)..(64): Xaa can be any naturally occurring amino acid
  misc_feature (81)..(81): Xaa can be any naturally occurring amino acid
  misc_feature (116)..(116): Xaa can be any naturally occurring amino acid
  misc_feature (133)..(133): Xaa can be any naturally occurring amino acid
  misc_feature (136)..(142): Xaa can be any naturally occurring amino acid
  misc_feature (189)..(189): Xaa can be any naturally occurring amino acid
  misc_feature (196)..(212): Xaa can be any naturally occurring amino acid
  misc_feature (243)..(243): Xaa can be any naturally occurring amino acid
  misc_feature (259)..(266): Xaa can be any naturally occurring amino acid
  misc_feature (287)..(287): Xaa can be any naturally occurring amino acid
  misc_feature (302)..(302): Xaa can be any naturally occurring amino acid
RSDLSRNLNTSFXDPAGEGDPILYQXXXXXXXHPEVYILILPGFGLISHIVRQERRKKEAFGTXGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAHFHYVLSIGAVFAIIAGFIQXFPLFTGXXXXXXXXXXXXXXXXXGVNLTFFPQHFLGLIGIPRRYSDYPDVFILXNIVSSIGSLISLIGVXXXXXXXXEAFSFQRKRLRPLRITSSIEXLQFNPPAEHRYSELX

SEQ ID NO: 28207 - protein, 62 aa, Diabrotica virgifera
  misc_feature: Coding regions on vcDNA: vcDNA=SeqID_7904; Strand=-; Position=383-571
WTRRITTLEVLPEALHKEERARLTRKVSSLSEVRLYNIIREYLLMQSFCVMRHVCCKCIFQS

SEQ ID NO: 28208 - protein, 92 aa, Diabrotica virgifera
  misc_feature: Coding regions on vcDNA: vcDNA=SeqID_7905; Strand=+; Position=500-778
  misc_feature (9)..(20): Xaa can be any naturally occurring amino acid
  misc_feature (67)..(67): Xaa can be any naturally occurring amino acid
LVVGFDFSXXXXXXXXXXXXNQKVNILVNSMLNRQHVSNVSIIPLSTILNIFVVLLVLLCLVALQPXDGVLTDCTIRFHLERSSMMVELSSD

SEQ ID NO: 28209 - protein, 231 aa, Diabrotica virgifera
  misc_feature: Coding regions on vcDNA: vcDNA=SeqID_7906; Strand=-; Position=1-693
  misc_feature (1)..(31): Xaa can be any naturally occurring amino acid
  misc_feature (43)..(75): Xaa can be any naturally occurring amino acid
  misc_feature (77)..(169): Xaa can be any naturally occurring amino acid
  misc_feature (173)..(183): Xaa can be any naturally occurring amino acid
  misc_feature (206)..(221): Xaa can be any naturally occurring amino acid
  misc_feature (223)..(231): Xaa can be any naturally occurring amino acid
XXXXXXXXXXXXXXXXXXXXXXXXXXXXXXXFGGGRKRRRGGXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNPPXXXXXXXXXXXGGCFFFARQTSPREKKKTAYYFXXXXXXXXXXXXXXXXYXXXXXXXXX

SEQ ID NO: 28210 - protein, 214 aa, Diabrotica virgifera
  misc_feature: Coding regions on vcDNA: vcDNA=SeqID_7907; Strand=-; Position=266-911
  misc_feature: Homolog annotation: Hit_ID=AAM51140.1; Match level="QueryCoverage =94%, HitCoverage=19%, E-value=2e-49, Identity=47%"; Hit description =SD27140p [Drosophila melanogaster]
  misc_feature (32)..(32): Xaa can be any naturally occurring amino acid
MYDLVQNRPEINSFLTVESIKWQFIPARSPHXGGIWEAAVKSFKFHLKRIVGNHIFSVDNFGTLTTQIEACLNSRPLTPLSSNPSDFQPLTPGHFLIFSPLTTFPEPDIRRISNLNTFQHMTQVLQHFWARWSTEYLTQLQSRSKWRTVSNQEVKIDQLVCLREDNLPPLQWRLGRISMVHRGRDNRIRVVTIKTNNGEVTRALSRVCILPTDI

SEQ ID NO: 28211 - protein, 75 aa, Diabrotica virgifera
  misc_feature: Coding regions on vcDNA: vcDNA=SeqID_7908; Strand=-; Position=245-472
WSSFHHRRNISRSSSIVKGIRISVNMMTYTLTLRTTFDDTLVFYVQALFEVFSRHHTVNMFPGCNIKHQIGQWGH

SEQ ID NO: 28212 - protein, 24 aa, Diabrotica virgifera
  misc_feature: Coding regions on vcDNA: vcDNA=SeqID_7909; Strand=-; Position=1-72
  misc_feature (2)..(24): Xaa can be any naturally occurring amino acid
KXXXXXXXXXXXXXXXXXXXXXXX

SEQ ID NO: 28213 - protein, 119 aa, Diabrotica virgifera
  misc_feature: Coding regions on vcDNA: vcDNA=SeqID_7910; Strand=+; Position=1-359
  misc_feature: Homolog annotation: Hit_ID=CAB62280.1; Match level="QueryCoverage =97%, HitCoverage=85%, E-value=1e-15, Identity=42%"; Hit description =hydroxyproline-rich glycoprotein DZ-HRGP [Volvox carteri f. nagariensis]
  misc_feature: Gene Ontology Annotation: Molecular function=single-stranded DNA binding; Cellular component=nucleus; Biological process=actin polymerization and/or depolymerization
  misc_feature (89)..(89): Xaa can be any naturally occurring amino acid
PSTFADVLRPPGPPPMTHPRAPGPPPGTRPGPPWASTNMTSYTPGPPRSKRPRPPGPPPCLPPNAPSPPPFRRPLSLWPPPSLLLSTTXSPPPLVRPKPPGSLPIRRAMPPVPPLSISI

SEQ ID NO: 28214 - protein, 111 aa, Diabrotica virgifera
  misc_feature: Coding regions on vcDNA: vcDNA=SeqID_7911; Strand=+; Position=176-511
  misc_feature (58)..(64): Xaa can be any naturally occurring amino acid
IWQHRSGRSFCVSRRSHILRIKTRYIGSESLAKDTLIVTPILITSRHASFVRGVYTAXXXXXXXYADVGGRSMSSYVWSDSRQDFTKFGKKRVEWIQQKTSLSFLKILKIG

SEQ ID NO: 28215 - protein, 56 aa, Diabrotica virgifera
  misc_feature: Coding regions on vcDNA: vcDNA=SeqID_7912; Strand=-; Position=27-197
  misc_feature (4)..(13): Xaa can be any naturally occurring amino acid
GGHXXXXXXXXXXPQFFGGTKNRKTKNAQKRGNKREPGEKVEISIISIFSNIMRTF

SEQ ID NO: 28216 - protein, 213 aa, Diabrotica virgifera
  misc_feature: Coding regions on vcDNA: vcDNA=SeqID_7913; Strand=+; Position=104-742
  misc_feature: Homolog annotation: Hit_ID=NP_001003728.1; Match level="QueryCoverage= 95%, HitCoverage=81%, E-value=1e-46, Identity=52%"; Hit description =zgc:92237 [Danio rerio] gb|AAH75953.1| Zgc:92237 [Danio rerio]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_S6e; Match level="Score=113.2, E -value=6.6e-31, Copies=1"; Pfam description=Ribosomal protein S6e
  misc_feature (24)..(24): Xaa can be any naturally occurring amino acid
  misc_feature (61)..(61): Xaa can be any naturally occurring amino acid
  misc_feature (104)..(110): Xaa can be any naturally occurring amino acid
  misc_feature (120)..(120): Xaa can be any naturally occurring amino acid
  misc_feature (151)..(151): Xaa can be any naturally occurring amino acid
  misc_feature (160)..(160): Xaa can be any naturally occurring amino acid
MKLNESYPRTGCLELFEVVDVNKXRIFYDKRMGLEVEADALGDEWKVYFLKISEGNVSARXFHLILGVLTIGRVTLLLSIGHSCYRPRRTRECKKKSVNESLEXXXXXXXDLDFVGKGLXKIPGLTDYSIPPHMGHKRASLVRLFFYPNLXDDVQQYVAXRALVLKEGRKTRTKCPIFQRIITPRSFANKTSIDMLRRTRGALNVKNNRMHML

SEQ ID NO: 28217 - protein, 77 aa, Diabrotica virgifera
  misc_feature: Coding regions on vcDNA: vcDNA=SeqID_7914; Strand=-; Position=236-469
  misc_feature (22)..(28): Xaa can be any naturally occurring amino acid
  misc_feature (36)..(42): Xaa can be any naturally occurring amino acid
  misc_feature (49)..(54): Xaa can be any naturally occurring amino acid
CHYSFGFASYTIRNIHLSTFFXXXXXXXAVVYNLQXXXXXXXHFCLSWXXXXXXTLFFRMSHINIAYVKRVNLEEEC

SEQ ID NO: 28218 - protein, 82 aa, Diabrotica virgifera
  misc_feature: Coding regions on vcDNA: vcDNA=SeqID_7915; Strand=+; Position=2-250
KIVTRRLKEVGLNPKRPARVPLLLPRHKTHRLHFARAPVNWNEHQWGRGLFTYETRIQLWKPDGRDRVYRGSGERFVEWNLV

SEQ ID NO: 28219 - protein, 211 aa, Diabrotica virgifera
  misc_feature: Coding regions on vcDNA: vcDNA=SeqID_7916; Strand=-; Position=1-633
MPEHGDEVDRLKQELEKATEEVCKLQGARQRVAQNELNYLRKEMEELRMAESRRVEMIGAREVKEWCGSEGEMSVEEFLETVEMLQQINGWTEQNTADLVRRRMIGKAAEFLGNATSQKKEGWTWKEIKGLLLQQFGMKKDRVNEMAKLMNIRRKEGENYRRFADRCRTAARYVVKEYEKEEEKPSTRTEIREEMILGVFMEGLTSEVRRV

SEQ ID NO: 28220 - protein, 166 aa, Diabrotica virgifera
  misc_feature: Coding regions on vcDNA: vcDNA=SeqID_7917; Strand=+; Position=91-591
SLNRSVLEVGAEQIVAGEVDRELSVVFALRALGTGRTEQGLFVAWMQVASQDGIGAVLSQVQEGDEWRHRGCFCRTLGKAEGSSARVAERGVIGSRRSSGTLPFVPLSAEDSWRELDHSALQWLLNFGTPGGRIGRWLERLQTCDFEIRHGAGRSRGNDLFKLLNC

SEQ ID NO: 28221 - protein, 67 aa, Diabrotica virgifera
  misc_feature: Coding regions on vcDNA: vcDNA=SeqID_7918; Strand=-; Position=55-258
LLKQTFSQNTLSLPTRLPCSSSYQSGATDTDTATVFTIQQFSNDCIKVTHVANIRYWPGAEGVKCCT

SEQ ID NO: 28222 - protein, 80 aa, Diabrotica virgifera
  misc_feature: Coding regions on vcDNA: vcDNA=SeqID_7919; Strand=+; Position=651-890
  misc_feature (63)..(69): Xaa can be any naturally occurring amino acid
FEDLFPCLNLFHSSHSYIFILLFLYPTIFILCETHCIQRAKKWRMNSVLREPTTFEEDPEQGXXXXXXXIFWALYQASDV

SEQ ID NO: 28223 - protein, 226 aa, Diabrotica virgifera
  misc_feature: Coding regions on vcDNA: vcDNA=SeqID_7920; Strand=-; Position=1-678
  misc_feature (27)..(68): Xaa can be any naturally occurring amino acid
  misc_feature (72)..(81): Xaa can be any naturally occurring amino acid
  misc_feature (88)..(94): Xaa can be any naturally occurring amino acid
  misc_feature (103)..(130): Xaa can be any naturally occurring amino acid
  misc_feature (137)..(144): Xaa can be any naturally occurring amino acid
  misc_feature (147)..(147): Xaa can be any naturally occurring amino acid
  misc_feature (149)..(156): Xaa can be any naturally occurring amino acid
  misc_feature (159)..(184): Xaa can be any naturally occurring amino acid
  misc_feature (192)..(220): Xaa can be any naturally occurring amino acid
SPPPLSPTKTLPPSFLFIFPQPLLPPXXXXXXXXXXXXXXXXXXXXXXXXXXXXXXXXXXXXXXXXXXFHIXXXXXXXXXXFLYIEKXXXXXXXRLPPLSSPXXXXXXXXXXXXXXXXXXXXXXXXXXXXGGVGQMXXXXXXXXINXLXXXXXXXXPKXXXXXXXXXXXXXXXXXXXXXXXXXXQQHTQKRXXXXXXXXXXXXXXXXXXXXXXXXXXXXXPGAGGA

SEQ ID NO: 28224 - protein, 133 aa, Diabrotica virgifera
  misc_feature: Coding regions on vcDNA: vcDNA=SeqID_7921; Strand=+; Position=1-399
  misc_feature (4)..(16): Xaa can be any naturally occurring amino acid
  misc_feature (21)..(56): Xaa can be any naturally occurring amino acid
  misc_feature (60)..(87): Xaa can be any naturally occurring amino acid
  misc_feature (91)..(121): Xaa can be any naturally occurring amino acid
  misc_feature (125)..(130): Xaa can be any naturally occurring amino acid
FLEXXXXXXXXXXXXXPLPPXXXXXXXXXXXXXXXXXXXXXXXXXXXXXXXXXXXXGVGXXXXXXXXXXXXXXXXXXXXXXXXXXXXGVRXXXXXXXXXXXXXXXXXXXXXXXXXXXXXXXVSEXXXXXXEET

SEQ ID NO: 28225 - protein, 220 aa, Diabrotica virgifera
  misc_feature: Coding regions on vcDNA: vcDNA=SeqID_7922; Strand=-; Position=146-808
  misc_feature (3)..(41): Xaa can be any naturally occurring amino acid
  misc_feature (51)..(60): Xaa can be any naturally occurring amino acid
  misc_feature (72)..(125): Xaa can be any naturally occurring amino acid
  misc_feature (130)..(178): Xaa can be any naturally occurring amino acid
GGXXXXXXXXXXXXXXXXXXXXXXXXXXXXXXXXXXXXXXXPQTKLKTQTXXXXXXXXXXLQTKKKSVGVFXXXXXXXXXXXXXXXXXXXXXXXXXXXXXXXXXXXXXXXXXXXXXXXXXXXXXXKLFGXXXXXXXXXXXXXXXXXXXXXXXXXXXXXXXXXXXXXXXXXXXXXXXXXKPGYISPGPLNFIRGQGGIYILNQKNMFLNKRGKKIVPDFFY

SEQ ID NO: 28226 - protein, 268 aa, Diabrotica virgifera
  misc_feature: Coding regions on vcDNA: vcDNA=SeqID_7923; Strand=+; Position=1-804
  misc_feature (5)..(30): Xaa can be any naturally occurring amino acid
  misc_feature (36)..(45): Xaa can be any naturally occurring amino acid
  misc_feature (48)..(64): Xaa can be any naturally occurring amino acid
  misc_feature (68)..(140): Xaa can be any naturally occurring amino acid
  misc_feature (147)..(166): Xaa can be any naturally occurring amino acid
  misc_feature (170)..(190): Xaa can be any naturally occurring amino acid
  misc_feature (192)..(244): Xaa can be any naturally occurring amino acid
  misc_feature (249)..(260): Xaa can be any naturally occurring amino acid
KKLSXXXXXXXXXXXXXXXXXXXXXXXXXXGVVAAXXXXXXXXXXLLXXXXXXXXXXXXXXXXXWVPXXXXXXXXXXXXXXXXXXXXXXXXXXXXXXXXXXXXXXXXXXXXXXXXXXXXXXXXXXXXXXXXXXXXXXXXXPPSFLLXXXXXXXXXXXXXXXXXXXXFPPXXXXXXXXXXXXXXXXXXXXXCXXXXXXXXXXXXXXXXXXXXXXXXXXXXXXXXXXXXXXXXXXXXXXXXXXXXXPMAAXXXXXXXXXXXXFRGGARGG

SEQ ID NO: 28227 - protein, 277 aa, Diabrotica virgifera
  misc_feature: Coding regions on vcDNA: vcDNA=SeqID_7924; Strand=+; Position=70-900
  misc_feature: Homolog annotation: Hit_ID=XP_396143.1; Match level="QueryCoverage =95%, HitCoverage=47%, E-value=7e-60, Identity=44%"; Hit description =similar to Hypothetical protein CG1785 [Apis mellifera]
  misc_feature: Gene Ontology Annotation: Molecular function=molecular_function unknown; Cellular component=intracellular; Biological process =biological_process unknown
  misc_feature: Pfam annotation: Pfam_ID=P60; Match level="Score=-63.8, E-value=2.6e -05, Copies=1"; Pfam description=p60-like protein
MAISSSIKKKRVSKKLKSSWRKHVNINEVEEFLEEQRLEERLGPSLELVPDSELFKVDSKPSTELLSSRERRKLKAAKPLKCFSALQPHTNVPDPISRRNRVRTKEERKSRLVTLKEQRNEAKGIVKRKSLQAAENRKLDDLKRKSKPKRGDVSSDLWQDSDKQAIIEEWVDKNAKKHNLRGVGVAVKKTRSSKLATNIPAIEPPHPGMSYNPSYADHQDLLQKVAEKEQKLIKEENHLRRVTSGMFSKVTESKRDEDWLISMSEGLPSKSNIVSDN

SEQ ID NO: 28228 - protein, 66 aa, Diabrotica virgifera
  misc_feature: Coding regions on vcDNA: vcDNA=SeqID_7925; Strand=+; Position=334-534
LSILWLEGPWHKMRRFNLEHLDEMWFLIELQGVLSESLKTVFAQSFQTVRRVLFILGRKCRCCTDY

SEQ ID NO: 28229 - protein, 72 aa, Diabrotica virgifera
  misc_feature: Coding regions on vcDNA: vcDNA=SeqID_7926; Strand=-; Position=3-218
  misc_feature (52)..(65): Xaa can be any naturally occurring amino acid
PPSFLTASFRPSLLVENLIYLDRLYPLIYPHHNAHLIFPRSVFVSFSKQPPXXXXXXXXXXXXXXHAPLKKG

SEQ ID NO: 28230 - protein, 240 aa, Diabrotica virgifera
  misc_feature: Coding regions on vcDNA: vcDNA=SeqID_7927; Strand=-; Position=88-808
  misc_feature: Homolog annotation: Hit_ID=XP_319403.1; Match level="QueryCoverage =97%, HitCoverage=77%, E-value=3e-41, Identity=44%"; Hit description =ENSANGP00000006196 [Anopheles gambiae]
  misc_feature: Gene Ontology Annotation: Molecular function=electron transporter activity; Cellular component=endoplasmic reticulum; Biological process=protein folding
  misc_feature: Pfam annotation: Pfam_ID=Thioredoxin; Match level="Score=198.2, E -value=1.7e-56, Copies=2"; Pfam description=Thioredoxin
  misc_feature (38)..(38): Xaa can be any naturally occurring amino acid
  misc_feature (140)..(145): Xaa can be any naturally occurring amino acid
GSSLTEETFKPFLKKKKHSLVMFYAPWCGHCKKAKPEXYTQAATEFKDDPRVEFTAVDCTVYPSVCSANDVTGYPTFKYFSYYKKEMKDYKGGRTAPDFIDFMREPDKVVNVPAPPPAEPAEWIMDPAVVKLTDKTFQNXXXXXXVLVMFYAPWCGYCKKMKPEYSVAAHQLSDEGHKSCLAMIDCAENPSIAEEYHISGFPTLKLFKNGKFVADYNGKRTADDIKTFLLKYMNNPKEEL

SEQ ID NO: 28231 - protein, 275 aa, Diabrotica virgifera
  misc_feature: Coding regions on vcDNA: vcDNA=SeqID_7928; Strand=+; Position=48-875
  misc_feature: Homolog annotation: Hit_ID=EAL30817.1; Match level="QueryCoverage =89%, HitCoverage=42%, E-value=2e-52, Identity=42%"; Hit description =GA14335-PA [Drosophila pseudoobscura]
  misc_feature (43)..(48): Xaa can be any naturally occurring amino acid
MAKGKGKKGKKAKKPVEIDPNALTEVDKTFYELTITDLNRKLXXXXXXNQELEQKNEELVQEKEKLDEDRNDIIMYLKRTLQEKTSEIAELEERITAMKQEQEDTTQMYEEKIVEMTNEYNTMHDQLTSENKLLEGKLNSLEEFRSQRDELMKKFETQENDMEAQEKRHKREMYEIERKFIIAKDRLKKDMEAKLRQLSTEFHDATELRIAATTHRVIRENIAVNNELDVLLNNQQKLFNENGKLKDKDSNLHRKVELLEAEKTKALAKVRVQEN

SEQ ID NO: 28232 - protein, 315 aa, Diabrotica virgifera
  misc_feature: Coding regions on vcDNA: vcDNA=SeqID_7929; Strand=+; Position=2-947
  misc_feature: Homolog annotation: Hit_ID=S27163; Match level="QueryCoverage=99%, HitCoverage=56%, E-value=7e-94, Identity=52%"; Hit description =alpha,alpha-trehalase (EC 3.2.1.28) - yellow mealworm dbj|BAA01951.1| trehalase precursor
  misc_feature: Gene Ontology Annotation: Molecular function=alpha,alpha-trehalase activity; Cellular component=extrinsic to plasma membrane, GPI -anchored; Biological process=trehalose catabolism
  misc_feature: Pfam annotation: Pfam_ID=Trehalase; Match level="Score=163.7, E-value= 4.1e-46, Copies=1"; Pfam description=Trehalase
  misc_feature (267)..(267): Xaa can be any naturally occurring amino acid
  misc_feature (292)..(292): Xaa can be any naturally occurring amino acid
EHADQHSLIDIPNGFIIPGGRFKEIYYWDSYWIVEGLLVSEMTETVRGVLENFLSIVERFGFIPNGARVYYLNRSQPPLLAMMMGKYIDQTGNKTWLEKHVDTLEKEMNWWWSERKVTVKKDGANYDMFMYAVKSDTPRPESYYEDIITCQNFTESEQKACYRNLKSGAESGWDFSSRWLYNDDRNPSTNLSQIDIIDVIPVDLNAILCRAFEELSRFYQLVGNNEKAEAWSHKHLNLRSAIQAVNYNDEDGIWYDFDVKHSSHRKXFYPSNFAPLWADAYDTTKKETFGIXAATPYKKDESNTYAGGIPSSLLQ

SEQ ID NO: 28233 - protein, 66 aa, Diabrotica virgifera
  misc_feature: Coding regions on vcDNA: vcDNA=SeqID_7930; Strand=-; Position=2-199
  misc_feature (2)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
LXXXXXXXXXXXXPTWAHTGLNXXXXXXXXSNXXXXXXXXXXXXXXPTSRSXXXXXXXXXXXXXXV

SEQ ID NO: 28234 - protein, 213 aa, Diabrotica virgifera
  misc_feature: Coding regions on vcDNA: vcDNA=SeqID_7931; Strand=+; Position=305-943
  misc_feature: Homolog annotation: Hit_ID=XP_394430.1; Match level="QueryCoverage =80%, HitCoverage=17%, E-value=2e-38, Identity=49%"; Hit description =similar to CG7915-PA [Apis mellifera]
  misc_feature (177)..(177): Xaa can be any naturally occurring amino acid
  misc_feature (181)..(181): Xaa can be any naturally occurring amino acid
MSAPWPVKEGALKNKIMDSDQEKQVKTRMHLPSKLNLQLIDDEARSLKAGDLSQQESKNLAQTNMKVTTDKFSSERTAMESQQQRQTVTASGFYNQEKHSSSTSHIYTSSSSKGLSTSAKINATRQFHLLNGTPEEAILNTSLEDLDSLSATSDVHDIERAKHKYSTYLDESIRCLXKLDXNKDAPLVLDKINDVMRKAWAVPTYGHELGYAL

SEQ ID NO: 28235 - protein, 30 aa, Diabrotica virgifera
  misc_feature: Coding regions on vcDNA: vcDNA=SeqID_7932; Strand=+; Position=17-106
  misc_feature (14)..(14): Xaa can be any naturally occurring amino acid
KYYFIAVEIRFLYXHEVYFYKYPNMKYRIY

SEQ ID NO: 28236 - protein, 158 aa, Diabrotica virgifera
  misc_feature: Coding regions on vcDNA: vcDNA=SeqID_7933; Strand=+; Position=2-475
  misc_feature: Homolog annotation: Hit_ID=XP_315675.1; Match level="QueryCoverage =96%, HitCoverage=28%, E-value=1e-27, Identity=37%"; Hit description =ENSANGP00000021702 [Anopheles gambiae]
  misc_feature: Gene Ontology Annotation: Cellular component=extracellular space
  misc_feature (143)..(149): Xaa can be any naturally occurring amino acid
  misc_feature (154)..(154): Xaa can be any naturally occurring amino acid
MWFSVVLVIVVIAFYLFSLTIKPKNYPPGPSWYPIVGTVLEVKNLSKKFKGQHLAQQYLSRKYKSDVIGLRNGKENVVVVFNQAAVKAIFKREEFLARPQNFFLYLRNMGLIRGITIVSGRLWQIQRRFVVSHLKYLGLGKRXXXXXXXDESTXILNL

SEQ ID NO: 28237 - protein, 259 aa, Diabrotica virgifera
  misc_feature: Coding regions on vcDNA: vcDNA=SeqID_7934; Strand=+; Position=118-897
  misc_feature: Pfam annotation: Pfam_ID=THAP; Match level="Score=30.2, E-value=6.1e -06, Copies=1"; Pfam description=THAP domain
  misc_feature (229)..(229): Xaa can be any naturally occurring amino acid
  misc_feature (234)..(234): Xaa can be any naturally occurring amino acid
  misc_feature (244)..(244): Xaa can be any naturally occurring amino acid
MSSSSKSENDPDESYTRPRRAKTKMKCVVEDCPTIGCPPNSTHCLTRERYIPWMKAIKQSPENVKTPNYDSYICQKHFALSQRVGPNLKPNAIPTLNLPTSSNSKVCTKEEIEQEFFLVKAIITVEKNVPADEVPFMNHYYSKLILFNDLIPTKKELAWRLNLLGVKYKEDEEVEVKDSVVDVFSKQSEPVFIQTPTYLETTLIEEVDDEFVEDVPSFISPSNLLELMXEEEVXPSPNENRMEXYDDNPDDSRMRVRIE

SEQ ID NO: 28238 - protein, 89 aa, Diabrotica virgifera
  misc_feature: Coding regions on vcDNA: vcDNA=SeqID_7935; Strand=-; Position=309-578
  misc_feature (41)..(47): Xaa can be any naturally occurring amino acid
  misc_feature (67)..(74): Xaa can be any naturally occurring amino acid
AWITTFIKIMYILEKYIKDTKNRGIYVFMYSQLQYLFQYHXXXXXXXKCLTLQTLHVAGLNTGNRPXXXXXXXXATIFKILGLHQKLFY

SEQ ID NO: 28239 - protein, 17 aa, Diabrotica virgifera
  misc_feature: Coding regions on vcDNA: vcDNA=SeqID_7936; Strand=-; Position=1-51
PHSSKLCQKTLLFSFLS

SEQ ID NO: 28240 - protein, 222 aa, Diabrotica virgifera
  misc_feature: Coding regions on vcDNA: vcDNA=SeqID_7937; Strand=-; Position=0-665
  misc_feature (34)..(40): Xaa can be any naturally occurring amino acid
  misc_feature (71)..(96): Xaa can be any naturally occurring amino acid
  misc_feature (102)..(114): Xaa can be any naturally occurring amino acid
  misc_feature (121)..(128): Xaa can be any naturally occurring amino acid
  misc_feature (130)..(139): Xaa can be any naturally occurring amino acid
  misc_feature (162)..(174): Xaa can be any naturally occurring amino acid
  misc_feature (176)..(221): Xaa can be any naturally occurring amino acid
GAPLIFRPWGRMKNFSNVHPKPLFLDPDFPPKGXXXXXXXIEKFFPCFPGFKPFLGDPLIPTGFFFTLFNXXXXXXXXXXXXXXXXXXXXXXXXXXGLVSKXXXXXXXXXXXXXNGIFVSXXXXXXXXPXXXXXXXXXXNQITLKRFFKGTNSPMFPFWGPXXXXXXXXXXXXXPXXXXXXXXXXXXXXXXXXXXXXXXXXXXXXXXXXXXXXXXXXXXXXP

SEQ ID NO: 28241 - protein, 30 aa, Diabrotica virgifera
  misc_feature: Coding regions on vcDNA: vcDNA=SeqID_7938; Strand=-; Position=0-89
VPLGWSRPPKGAPRVPARRTPRRPPLPIGV

SEQ ID NO: 28242 - protein, 77 aa, Diabrotica virgifera
  misc_feature: Coding regions on vcDNA: vcDNA=SeqID_7939; Strand=-; Position=283-516
  misc_feature (38)..(44): Xaa can be any naturally occurring amino acid
HCTLNTQDDNKLNRRRFDLPRIMLIFIDFFMNRLTDSXXXXXXXGFLFGIYTVGQMLSQTFFWAYEKDGRKDMFSLC

SEQ ID NO: 28243 - protein, 187 aa, Diabrotica virgifera
  misc_feature: Coding regions on vcDNA: vcDNA=SeqID_7940; Strand=-; Position=0-560
  misc_feature (7)..(38): Xaa can be any naturally occurring amino acid
  misc_feature (42)..(71): Xaa can be any naturally occurring amino acid
  misc_feature (75)..(128): Xaa can be any naturally occurring amino acid
  misc_feature (130)..(186): Xaa can be any naturally occurring amino acid
GACCRLXXXXXXXXXXXXXXXXXXXXXXXXXXXXXXXXGGLXXXXXXXXXXXXXXXXXXXXXXXXXXXXXXGGGXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXP

SEQ ID NO: 28244 - protein, 33 aa, Diabrotica virgifera
  misc_feature: Coding regions on vcDNA: vcDNA=SeqID_7941; Strand=-; Position=0-98
  misc_feature (1)..(19): Xaa can be any naturally occurring amino acid
XXXXXXXXXXXXXXXXXXXLGLPQSKCIKLSNT

SEQ ID NO: 28245 - protein, 165 aa, Diabrotica virgifera
  misc_feature: Coding regions on vcDNA: vcDNA=SeqID_7942; Strand=-; Position=1-495
  misc_feature (3)..(28): Xaa can be any naturally occurring amino acid
  misc_feature (30)..(58): Xaa can be any naturally occurring amino acid
  misc_feature (65)..(121): Xaa can be any naturally occurring amino acid
  misc_feature (123)..(143): Xaa can be any naturally occurring amino acid
  misc_feature (154)..(162): Xaa can be any naturally occurring amino acid
KKXXXXXXXXXXXXXXXXXXXXXXXXXXVXXXXXXXXXXXXXXXXXXXXXXXXXXXXXPFPSPLXXXXXXXXXXXXXXXXXXXXXXXXXXXXXXXXXXXXXXXXXXXXXXXXXXXXXXXXXPXXXXXXXXXXXXXXXXXXXXXHPPLPPTKRRXXXXXXXXXFYL

SEQ ID NO: 28246 - protein, 206 aa, Diabrotica virgifera
  misc_feature: Coding regions on vcDNA: vcDNA=SeqID_7943; Strand=+; Position=1-618
  misc_feature (2)..(11): Xaa can be any naturally occurring amino acid
  misc_feature (18)..(49): Xaa can be any naturally occurring amino acid
  misc_feature (51)..(80): Xaa can be any naturally occurring amino acid
  misc_feature (83)..(142): Xaa can be any naturally occurring amino acid
  misc_feature (148)..(166): Xaa can be any naturally occurring amino acid
  misc_feature (174)..(204): Xaa can be any naturally occurring amino acid
PXXXXXXXXXXLHKKKRXXXXXXXXXXXXXXXXXXXXXXXXXXXXXXXXGXXXXXXXXXXXXXXXXXXXXXXXXXXXXXXCGXXXXXXXXXXXXXXXXXXXXXXXXXXXXXXXXXXXXXXXXXXXXXXXXXXXXXXXXXXXXPPPTTXXXXXXXXXXXXXXXXXXXKKTNPARXXXXXXXXXXXXXXXXXXXXXXXXXXXXXXXWV

SEQ ID NO: 28247 - protein, 20 aa, Diabrotica virgifera
  misc_feature: Coding regions on vcDNA: vcDNA=SeqID_7944; Strand=-; Position=0-59
ALLLLAKHNLITLKDPTNIL

SEQ ID NO: 28248 - protein, 42 aa, Diabrotica virgifera
  misc_feature: Coding regions on vcDNA: vcDNA=SeqID_7945; Strand=-; Position=1-126
NFKSGPDLNNKAATPINKLFIQTSRFAIFIIDLNSSIKITLL

SEQ ID NO: 28249 - protein, 177 aa, Diabrotica virgifera
  misc_feature: Coding regions on vcDNA: vcDNA=SeqID_7946; Strand=+; Position=279-813
  misc_feature: Homolog annotation: Hit_ID=AAC97621.1; Match level="QueryCoverage =83%, HitCoverage=27%, E-value=7e-21, Identity=34%"; Hit description =ORF MSV061 putative LINE reverse transcriptase, similar to Caenorhabditis elegans GB:U00063 [Melanoplus sa
  misc_feature (81)..(81): Xaa can be any naturally occurring amino acid
  misc_feature (151)..(151): Xaa can be any naturally occurring amino acid
  misc_feature (170)..(170): Xaa can be any naturally occurring amino acid
MTIYRTLIRPVVTYGTDKLQEQPRKLFQNCLNGAEFPKEWKLSIMSTIHKKGSKDQCENYRGIAVNSTISRMYGTLIKNKXKMTRDYEAEEQAGFRAGRSTVDHLYSITYVIEKKTAVNKEVHLVYVDLQKAYDSVPLSKLWSILHQTNIXHGLVKAVQSLYNGTTAKIXLDVLGGF

SEQ ID NO: 28250 - protein, 118 aa, Diabrotica virgifera
  misc_feature: Coding regions on vcDNA: vcDNA=SeqID_7947; Strand=+; Position=51-404
  misc_feature (75)..(100): Xaa can be any naturally occurring amino acid
EHFNILDLGGWSSRTSFSGQHGPCVHPNASFLRFHLFVCDVYSPELPKYGINPGLTNYAAAYVTGLLLARVILKXXXXXXXXXXXXXXXXXXXXXXXXXXLPKSFLAILGPHGYSTLE

SEQ ID NO: 28251 - protein, 94 aa, Diabrotica virgifera
  misc_feature: Coding regions on vcDNA: vcDNA=SeqID_7948; Strand=-; Position=2-283
DHKCRRDLTRYSGSGPQSMKANRSTIIQILFSSPRASKTHMNELHANCSRTRHSPLLNMSILFSRCSENMSRVCPLEHHRWASRRGGSPGESRP

SEQ ID NO: 28252 - protein, 297 aa, Diabrotica virgifera
  misc_feature: Coding regions on vcDNA: vcDNA=SeqID_7949; Strand=+; Position=2-892
  misc_feature: Homolog annotation: Hit_ID=EAA14182.2; Match level="QueryCoverage =100%, HitCoverage=39%, E-value=3e-60, Identity=41%"; Hit description= ENSANGP00000010160 [Anopheles gambiae str. PEST] ref|XP_553590.1| ENSANGP00000010160 [Anopheles gambiae s
  misc_feature: Gene Ontology Annotation: Molecular function=3' tRNA processing endoribonuclease activity; Cellular component=cellular_component unknown; Biological process=removal of tRNA 3'-trailer sequence
  misc_feature (134)..(141): Xaa can be any naturally occurring amino acid
PDDPGLVFIVLDCPTVDYLDSLENSQIITNHQKYNKDETQIASLIVHFTPKDVVENPRYKAWMEHFPASTTHLMLNEYNTCMGSEAVHRIQYKLNLLSNDIFPLLGEKGTLLPKGEVEGESDRKKQKMEDLVEXXXXXXXXAKLSESPSLYITPDTFCAYHLRPKRGLDRSLELRLNPTEYLEETYNVADFKTVLETLKSNLNSKTVSRDEFPKIIFLGTGSCIPNKTRNTSGILLALNENQNIIMDCGEGTYGQLIRFFGPELSSQVLANIDAIYVSHLHADHHIGLIGLLQGRKR

SEQ ID NO: 28253 - protein, 277 aa, Diabrotica virgifera
  misc_feature: Coding regions on vcDNA: vcDNA=SeqID_7950; Strand=+; Position=88-920
  misc_feature: Homolog annotation: Hit_ID=EAL41267.1; Match level="QueryCoverage =97%, HitCoverage=68%, E-value=1e-115, Identity=71%"; Hit description= ENSANGP00000029654 [Anopheles gambiae str. PEST] ref|XP_566222.1| ENSANGP00000029654 [Anopheles gambiae s
  misc_feature: Gene Ontology Annotation: Biological process=purine nucleotide metabolism
  misc_feature: Pfam annotation: Pfam_ID=SAICAR_synt; Match level="Score=310.3, E -value=3e-90, Copies=1"; Pfam description=SAICAR synthetase
  misc_feature (265)..(265): Xaa can be any naturally occurring amino acid
MASVKEIGGYKLGNLIIEGKTKQVFDVPSVPGHCILLSKDRITAGDGVKAHDLAGKSVISNKTNGKVFEILRKVGMKTAYVKSVSDNAFLSKKCEMIPIEWVTRRLATGSFLRRHPGVKEGFRFTPVKHETFFKDDANHDPQWSEEQIISAEFKVNGVVIGKHEVDLMTKTSIIVFEILEKVWATRNCALIDMKIEFGVDDQGNLLVADVIDSDSWRLWPSGDKRLMVDKQVYRNLTTVTDKDLDTVKRNFEWIADQLDHLIPPXNHLVVISWAACR

SEQ ID NO: 28254 - protein, 313 aa, Diabrotica virgifera
  misc_feature: Coding regions on vcDNA: vcDNA=SeqID_7951; Strand=+; Position=133-1073
  misc_feature: Homolog annotation: Hit_ID=XP_316621.1; Match level="QueryCoverage =93%, HitCoverage=54%, E-value=3e-79, Identity=48%"; Hit description =ENSANGP00000010934 [Anopheles gambiae]
  misc_feature: Gene Ontology Annotation: Molecular function=sodium-dependent phosphate transporter activity; Cellular component=integral to membrane; Biological process=phosphate transport
  misc_feature: Pfam annotation: Pfam_ID=MFS_1; Match level="Score=73.8, E-value=4.7e- 19, Copies=1"; Pfam description=Major Facilitator Superfamily
  misc_feature (252)..(252): Xaa can be any naturally occurring amino acid
  misc_feature (281)..(281): Xaa can be any naturally occurring amino acid
  misc_feature (301)..(308): Xaa can be any naturally occurring amino acid
MVPQRYLVSILAFFGFMNIYALRSNLSIAIVDMTQLKNVSLKNGTNVFEREFEWNSTLQGYVLSSFFYGYIFTQIAGGFLAAKLGGARIFGLGIVSTSLLTLVTPWIAKTSVYFLIAIRILEGALEGVTYPAMQELWSHWAPPSEKSRLVSIAGSGSYFGAVVAMPICSLLATSFGWESIFYTFGVIGFIWYAIWLLVVADTPSSDRYIKEKEVKYINDAVSSIKSDEKITPPWCTIFKSRAVLASTVCLSXNLGIYTLLTFLPQMMKSLLGFDLNPVGFXSQLPYLSMPIMVKSGGVSLXXXXXXXXTLTTN

SEQ ID NO: 28255 - protein, 145 aa, Diabrotica virgifera
  misc_feature: Coding regions on vcDNA: vcDNA=SeqID_7952; Strand=+; Position=23-457
KDARPSRKRTKNSPPGEHQRESRKQNKKKNEEKGRTRGTKETDERKRQKTPPTTTQQTRHRGAEPHGKDRENPEGAQRRRQEEHPPSANRGQSEEARAERPARQRGSQKEEGEAPSSGTTSAGSGRATRRETATPANAQGAARDA

SEQ ID NO: 28256 - protein, 116 aa, Diabrotica virgifera
  misc_feature: Coding regions on vcDNA: vcDNA=SeqID_7953; Strand=+; Position=176-526
QNTDFRLYRFFFCLRFNLAVITRQKKQVFGKTGFRFLKLYFFTRDMRVNFYMLKPTIPAHAHYNFVLIGCSNDMSKIIQYGSCSAAVDWTADRLVVYECGIVIPVRCDMTGSPSLL

SEQ ID NO: 28257 - protein, 109 aa, Diabrotica virgifera
  misc_feature: Coding regions on vcDNA: vcDNA=SeqID_7954; Strand=+; Position=2-331
  misc_feature (27)..(32): Xaa can be any naturally occurring amino acid
GVRKNEIIWKVPKNKKKRDLSGKMQKXXXXXXYSPLWGTKNCYRPPKKPLGVVLVFRGAFQISSTYVGVGETFTGNNLQPLQMSFVPESVEQNRTASFFTKKMNEHRIG

SEQ ID NO: 28258 - protein, 213 aa, Diabrotica virgifera
  misc_feature: Coding regions on vcDNA: vcDNA=SeqID_7955; Strand=-; Position=188-829
  misc_feature: Homolog annotation: Hit_ID=XP_312613.1; Match level="QueryCoverage =97%, HitCoverage=57%, E-value=9e-87, Identity=75%"; Hit description =ENSANGP00000024163 [Anopheles gambiae]
  misc_feature: Pfam annotation: Pfam_ID=Troponin; Match level="Score=50.3, E-value =5.5e-12, Copies=1"; Pfam description=Troponin
TNGRRKRKFSLSIRIKPLVLDGLSVDKLRERATELWDCIVKLETEKYDLEERQKRQDYDLKELKERQKQQLRHKALKKGLDPEALTGKYPPKIQVASKYERRVDTRSYSDKKHLFEGGFENIVKDLNEKSWKEKFGQFDSRQKTRLPKWFGERPGKKSGDPETPEGEEEGKQAADDDEDLKEPVIEPEPEEEEEEEEVEVDEEEEDDEEEEEE

SEQ ID NO: 28259 - protein, 233 aa, Diabrotica virgifera
  misc_feature: Coding regions on vcDNA: vcDNA=SeqID_7956; Strand=+; Position=1-699
  misc_feature (5)..(29): Xaa can be any naturally occurring amino acid
  misc_feature (47)..(56): Xaa can be any naturally occurring amino acid
  misc_feature (58)..(83): Xaa can be any naturally occurring amino acid
  misc_feature (86)..(103): Xaa can be any naturally occurring amino acid
  misc_feature (114)..(157): Xaa can be any naturally occurring amino acid
  misc_feature (181)..(195): Xaa can be any naturally occurring amino acid
  misc_feature (201)..(231): Xaa can be any naturally occurring amino acid
LSPWXXXXXXXXXXXXXXXXXXXXXXXXXSQKNLPPPFVCFLFLFPXXXXXXXXXXPXXXXXXXXXXXXXXXXXXXXXXXXXXGDXXXXXXXXXXXXXXXXXXTHPPLPPPPPXXXXXXXXXXXXXXXXXXXXXXXXXXXXXXXXXXXXXXXXXXXXFVFFKSNHNKKEGGGVGEWFLGGXXXXXXXXXXXXXXXRGRARXXXXXXXXXXXXXXXXXXXXXXXXXXXXXXXPP

SEQ ID NO: 28260 - protein, 265 aa, Diabrotica virgifera
  misc_feature: Coding regions on vcDNA: vcDNA=SeqID_7957; Strand=+; Position=3-800
  misc_feature: Homolog annotation: Hit_ID=AAF87760.1; Match level="QueryCoverage =99%, HitCoverage=60%, E-value=7e-96, Identity=70%"; Hit description =cytochrome oxidase subunit I [Diabrotica virgifera zeae]
  misc_feature: Pfam annotation: Pfam_ID=COX1; Match level="Score=-84.9, E-value=2.4e- 08, Copies=1"; Pfam description=Cytochrome C and Quinol oxidase polyp
  misc_feature (4)..(10): Xaa can be any naturally occurring amino acid
  misc_feature (21)..(28): Xaa can be any naturally occurring amino acid
  misc_feature (49)..(49): Xaa can be any naturally occurring amino acid
  misc_feature (84)..(84): Xaa can be any naturally occurring amino acid
  misc_feature (101)..(101): Xaa can be any naturally occurring amino acid
  misc_feature (104)..(110): Xaa can be any naturally occurring amino acid
  misc_feature (137)..(143): Xaa can be any naturally occurring amino acid
  misc_feature (157)..(157): Xaa can be any naturally occurring amino acid
  misc_feature (165)..(181): Xaa can be any naturally occurring amino acid
  misc_feature (211)..(211): Xaa can be any naturally occurring amino acid
  misc_feature (227)..(234): Xaa can be any naturally occurring amino acid
  misc_feature (255)..(255): Xaa can be any naturally occurring amino acid
HPEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFSFQRKRLRPLRITSSIEXLQFNPPAEHR

SEQ ID NO: 28261 - protein, 38 aa, Diabrotica virgifera
  misc_feature: Coding regions on vcDNA: vcDNA=SeqID_7958; Strand=-; Position=96-212
ATLAGINKMCSIRISMYFWTIKINPGRDNLQLRLGYLK

SEQ ID NO: 28262 - protein, 72 aa, Diabrotica virgifera
  misc_feature: Coding regions on vcDNA: vcDNA=SeqID_7959; Strand=-; Position=675-893
RTQRKPRADTAKTQRPTGNRRNESLTKNNKTKLLKDRVRSEEIRARCGIEEINMCTKRRKIEWNQHKKTDRK

SEQ ID NO: 28263 - protein, 245 aa, Diabrotica virgifera
  misc_feature: Coding regions on vcDNA: vcDNA=SeqID_7960; Strand=-; Position=1-735
  misc_feature (3)..(3): Xaa can be any naturally occurring amino acid
  misc_feature (6)..(18): Xaa can be any naturally occurring amino acid
  misc_feature (21)..(21): Xaa can be any naturally occurring amino acid
  misc_feature (24)..(33): Xaa can be any naturally occurring amino acid
  misc_feature (35)..(228): Xaa can be any naturally occurring amino acid
  misc_feature (231)..(245): Xaa can be any naturally occurring amino acid
LFXLKXXXXXXXXXXXXXSSXPFXXXXXXXXXXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 28264 - protein, 167 aa, Diabrotica virgifera
  misc_feature: Coding regions on vcDNA: vcDNA=SeqID_7961; Strand=+; Position=29-532
  misc_feature: Homolog annotation: Hit_ID=DAA01876.1; Match level="QueryCoverage =89%, HitCoverage=99%, E-value=9e-57, Identity=75%"; Hit description =TPA: troponin C type IIa [Apis mellifera]
  misc_feature: Pfam annotation: Pfam_ID=efhand; Match level="Score=78.2, E-value =2.3e-20, Copies=4"; Pfam description=EF hand
MSGDDDQKMEIIKKAFTMFDTGKTGFIETIKIATILNTIGQLFDEVALNDLITKNDPDRTGQVNFDGFYEIIYPFLEEDLDEAETQNELKEAFRLYDREGNGYITTGSLKEILAALDDNLTSRDLDGIIAEIDTDGSGTVDFDEFMEMMTGDELWTGSLFGLILGKL

SEQ ID NO: 28265 - protein, 168 aa, Diabrotica virgifera
  misc_feature: Coding regions on vcDNA: vcDNA=SeqID_7962; Strand=+; Position=183-689
  misc_feature: Homolog annotation: Hit_ID=EAL29441.1; Match level="QueryCoverage =98%, HitCoverage=84%, E-value=4e-71, Identity=77%"; Hit description =GA11315-PA [Drosophila pseudoobscura]
  misc_feature: Gene Ontology Annotation: Molecular function=N-acetyltransferase activity; Cellular component=nucleus; Biological process=chromosome organization and biogenesis (sensu Eukarya)
  misc_feature: Pfam annotation: Pfam_ID=Acetyltransf_1; Match level="Score=70.6, E -value=4.3e-18, Copies=1"; Pfam description=Acetyltransferase (GNAT) family
  misc_feature (57)..(68): Xaa can be any naturally occurring amino acid
MNIRCAKPEDLMNMQHCNLLCLPENYQMKYYFYHGLSWPQLSYVAEDEKGNIVGYVXXXXXXXXXXXXHGHITSLAVKRSHRRLGLAQKLMDQASEAMVECFDAKYVSLHVRKSNRAALNLYKNSLKFETVEIEPKYYADGEDAYSMRRDLSEFAKKVKPKSETKNEE

SEQ ID NO: 28266 - protein, 134 aa, Diabrotica virgifera
  misc_feature: Coding regions on vcDNA: vcDNA=SeqID_7963; Strand=+; Position=148-552
  misc_feature: Homolog annotation: Hit_ID=XP_392881.1; Match level="QueryCoverage =69%, HitCoverage=47%, E-value=3e-16, Identity=45%"; Hit description =similar to ENSANGP00000021507 [Apis mellifera]
  misc_feature: Pfam annotation: Pfam_ID=BRICHOS; Match level="Score=-3.3, E-value =0.02, Copies=1"; Pfam description=BRICHOS domain
  misc_feature (62)..(62): Xaa can be any naturally occurring amino acid
  misc_feature (84)..(90): Xaa can be any naturally occurring amino acid
KYETIDMPDFKHALIDRFIHDFTTNTTDIFHITGHKCFDMSLNQDNVLPPYTMFDLIPHMRXGHYTEYTDLATKNMKAIIPPLXXXXXXXGYIARECDALTIYTSQKYRRRSCKEDCLFSLSPIRPARCTEMHP

SEQ ID NO: 28267 - protein, 62 aa, Diabrotica virgifera
  misc_feature: Coding regions on vcDNA: vcDNA=SeqID_7964; Strand=+; Position=507-695
  misc_feature (37)..(45): Xaa can be any naturally occurring amino acid
QFAIAITRSVLKPGHFEIVVISLFFLYFGKCVNYLPXXXXXXXXXERILSGPSGNRAPRPPL

SEQ ID NO: 28268 - protein, 251 aa, Diabrotica virgifera
  misc_feature: Coding regions on vcDNA: vcDNA=SeqID_7965; Strand=+; Position=1-753
  misc_feature (1)..(250): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 28269 - protein, 73 aa, Diabrotica virgifera
  misc_feature: Coding regions on vcDNA: vcDNA=SeqID_7966; Strand=+; Position=76-297
TEMRECDLRPCWTNRRGLRRGLMTVALPDSMSKTHRHDIEIMKDCVDNVVSVASRFFGIKGEDKSLTYRRWRC

SEQ ID NO: 28270 - protein, 140 aa, Diabrotica virgifera
  misc_feature: Coding regions on vcDNA: vcDNA=SeqID_7967; Strand=-; Position=90-512
SRVRTCLERFGSLHHPTLHDFMFFFSIRLDHSLSELSDLESELASNFLLFGSNPALFYASLRLLENTSHYICSAVSQLFAVWVQPCIILCFSSVVREYFALYMFGCIVLMNLLLRLCHVLSSKNIFPASISFQSAEPRKW

SEQ ID NO: 28271 - protein, 37 aa, Diabrotica virgifera
  misc_feature: Coding regions on vcDNA: vcDNA=SeqID_7968; Strand=-; Position=17-130
  misc_feature (25)..(31): Xaa can be any naturally occurring amino acid
NKNETVLTPPVNNNTLYIINSLKGXXXXXXXIIIMQI

SEQ ID NO: 28272 - protein, 109 aa, Diabrotica virgifera
  misc_feature: Coding regions on vcDNA: vcDNA=SeqID_7969; Strand=-; Position=8-337
CISSTAGTVSRILISNVFCRSNFQFLNPWQSLHLRHLLSRTVVIYIVFFFWVKSIFLSFLAMYSDFLCRYPYQFSLLASIVSIMYKSISMSLLIFVPHAVSLVSRQHRL

SEQ ID NO: 28273 - protein, 64 aa, Diabrotica virgifera
  misc_feature: Coding regions on vcDNA: vcDNA=SeqID_7970; Strand=+; Position=214-408
AELRDMICVEYVNGYGTLMFPKFLSRTVQSIRYSESQEYIRESFLRDLRRQIRFPLHFHDCATS

SEQ ID NO: 28274 - protein, 109 aa, Diabrotica virgifera
  misc_feature: Coding regions on vcDNA: vcDNA=SeqID_7971; Strand=+; Position=363-692
TLYKSLPRVNRLSCESPLIHWPERENRGRVVARNMFERFFFAVNQNNIDVYICFLKQLLLNRFFTKTPHCVSTFLMTLIPYIHRIRAEDNIFIYVLLTGKSKYWKVCDC

SEQ ID NO: 28275 - protein, 194 aa, Diabrotica virgifera
  misc_feature: Coding regions on vcDNA: vcDNA=SeqID_7972; Strand=-; Position=0-581
  misc_feature (1)..(40): Xaa can be any naturally occurring amino acid
  misc_feature (43)..(91): Xaa can be any naturally occurring amino acid
  misc_feature (97)..(114): Xaa can be any naturally occurring amino acid
  misc_feature (116)..(170): Xaa can be any naturally occurring amino acid
  misc_feature (172)..(190): Xaa can be any naturally occurring amino acid
XXXXXXXXXXXXXXXXXXXXXXXXXXXXXXXXXXXXXXXXLLXXXXXXXXXXXXXXXXXXXXXXXXXXXXXXXXXXXXXXXXXXXXXXXXXPGGGGXXXXXXXXXXXXXXXXXXGXXXXXXXXXXXXXXXXXXXXXXXXXXXXXXXXXXXXXXXXXXXXXXXXXXXXXXXGXXXXXXXXXXXXXXXXXXXPFFV

SEQ ID NO: 28276 - protein, 81 aa, Diabrotica virgifera
  misc_feature: Coding regions on vcDNA: vcDNA=SeqID_7973; Strand=-; Position=928-1173
  misc_feature (3)..(18): Xaa can be any naturally occurring amino acid
  misc_feature (20)..(37): Xaa can be any naturally occurring amino acid
  misc_feature (39)..(47): Xaa can be any naturally occurring amino acid
  misc_feature (60)..(68): Xaa can be any naturally occurring amino acid
EVXXXXXXXXXXXXXXXXKXXXXXXXXXXXXXXXXXXNXXXXXXXXXFLPVLKRIPPPFXXXXXXXXXCVTLVSSIKDKLV

SEQ ID NO: 28277 - protein, 90 aa, Diabrotica virgifera
  misc_feature: Coding regions on vcDNA: vcDNA=SeqID_7974; Strand=+; Position=3-275
  misc_feature: Homolog annotation: Hit_ID=AAC79129.1; Match level="QueryCoverage =84%, HitCoverage=24%, E-value=3e-22, Identity=63%"; Hit description =glyceraldehyde-3-phosphate-dehydrogenase [Globodera rostochiensis] sp|O16027|G3P1_GLORO Glyceraldehyde-3-p
  misc_feature: Gene Ontology Annotation: Molecular function=glyceraldehyde 3 -phosphate dehydrogenase (phosphorylating) activity; Cellular component=cytoplasm; Biological process=glycolysis
  misc_feature: Pfam annotation: Pfam_ID=Gp_dh_C; Match level="Score=21.1, E-value =2.2e-10, Copies=1"; Pfam description=Glyceraldehyde 3-phosphate dehydrogena
LMTTIHSVTNSQVLIDGARPHKWRFGRGGIQNIIPATTGAAKAIGKIIPDLNGKITGLAFRVPTPIVSVINVLKKPIFILLDQDHVEDDL

SEQ ID NO: 28278 - protein, 66 aa, Diabrotica virgifera; identical to SEQ ID NO: 26808
  misc_feature: Coding regions on vcDNA: vcDNA=SeqID_7975; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28279 - protein, 186 aa, Diabrotica virgifera
  misc_feature: Coding regions on vcDNA: vcDNA=SeqID_7976; Strand=+; Position=2-562
  misc_feature: Homolog annotation: Hit_ID=XP_319500.1; Match level="QueryCoverage =38%, HitCoverage=77%, E-value=4e-14, Identity=52%"; Hit description =ENSANGP00000022826 [Anopheles gambiae] ref|XP_307247.1| ENSANGP00000023634 [Anopheles gambiae]
TETKVTLYNTIIQPHFDYCASIVYLFSLNKISQLQKLQNRGMRIILRTSRITPILIMLKSLEWLSVRQRLHYLTMVFVYKILNSLAPSYFQKYVSFQRDVHDYNTRGTNNLHIVEFKNSFMMNSLICKGFKEYNELPLVLGTCRNINTFKYENNVLNVFVLPCTYCAYVDRIGILFKCLWLSILTF

SEQ ID NO: 28280 - protein, 328 aa, Diabrotica virgifera
  misc_feature: Coding regions on vcDNA: vcDNA=SeqID_7977; Strand=-; Position=248-1234
  misc_feature (8)..(32): Xaa can be any naturally occurring amino acid
  misc_feature (37)..(51): Xaa can be any naturally occurring amino acid
  misc_feature (63)..(86): Xaa can be any naturally occurring amino acid
  misc_feature (101)..(118): Xaa can be any naturally occurring amino acid
  misc_feature (123)..(148): Xaa can be any naturally occurring amino acid
  misc_feature (151)..(159): Xaa can be any naturally occurring amino acid
  misc_feature (161)..(173): Xaa can be any naturally occurring amino acid
  misc_feature (177)..(229): Xaa can be any naturally occurring amino acid
  misc_feature (235)..(261): Xaa can be any naturally occurring amino acid
  misc_feature (275)..(299): Xaa can be any naturally occurring amino acid
  misc_feature (301)..(307): Xaa can be any naturally occurring amino acid
GGEGGEKXXXXXXXXXXXXXXXXXXXXXXXXXAGGAXXXXXXXXXXXXXXXAAPHIHQKMEGXXXXXXXXXXXXXXXXXXXXXXXXRAAGWCFSSPTYYFXXXXXXXXXXXXXXXXXXCLIYXXXXXXXXXXXXXXXXXXXXXXXXXXGCXXXXXXXXXFXXXXXXXXXXXXXWNPXXXXXXXXXXXXXXXXXXXXXXXXXXXXXXXXXXXXXXXXXXXXXXXXXXXXXPPFCNXXXXXXXXXXXXXXXXXXXXXXXXXXXRVFSFFVGGGRREXXXXXXXXXXXXXXXXXXXXXXXXXLXXXXXXXGAQIFFWEGKPPPFWGNNPHK

SEQ ID NO: 28281 - protein, 101 aa, Diabrotica virgifera
  misc_feature: Coding regions on vcDNA: vcDNA=SeqID_7978; Strand=+; Position=123-428
  misc_feature (37)..(43): Xaa can be any naturally occurring amino acid
  misc_feature (51)..(57): Xaa can be any naturally occurring amino acid
NGLNFLCSTFYMISLSWFWMIPEFAKVIQPPHLPAPXXXXXXXLNHELPLXXXXXXXSHFHLLTLFSLCLHLSTQFGRLFLALLFLCRLLYIFMRYFPSVR

SEQ ID NO: 28282 - protein, 265 aa, Diabrotica virgifera
  misc_feature: Coding regions on vcDNA: vcDNA=SeqID_7979; Strand=+; Position=20-812
  misc_feature: Homolog annotation: Hit_ID=AAS20593.1; Match level="QueryCoverage =100%, HitCoverage=78%, E-value=1e-45, Identity=37%"; Hit description= digestive cysteine proteinase intestain [Leptinotarsa decemlineata]
  misc_feature: Pfam annotation: Pfam_ID=Peptidase_C1; Match level="Score=-73.2, E -value=5.7e-06, Copies=1"; Pfam description=Papain family cysteine protease
  misc_feature (11)..(17): Xaa can be any naturally occurring amino acid
  misc_feature (252)..(252): Xaa can be any naturally occurring amino acid
MKIILVVLVIXXXXXXXTDEEKWRQFKITHNRVYNNIEEHKHRFEIFKKNLIRIKEQNEKYEKGESTFNFGITQFADLTEEEFLSRFKLAGSSKLSKINSNVSSSKSRSKTSGGSDDLPEQYDWVRTGAVTSVRDVADCGDCTAESVVAAVEGAEFIKTGNLIQRSPKQLEDCIPFNPDECWICYEKVLNYTRDFGIMTEKDYPWKFESEDCQIDSITTTDPLIQIIDWIYVSEGDEVELQRTLYLEGPCSXVSIDATINYQLYA

SEQ ID NO: 28283 - protein, 66 aa, Diabrotica virgifera; identical to SEQ ID NO: 26808
  misc_feature: Coding regions on vcDNA: vcDNA=SeqID_7980; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28284 - protein, 136 aa, Diabrotica virgifera
  misc_feature: Coding regions on vcDNA: vcDNA=SeqID_7981; Strand=-; Position=1-408
ANFLSAPPECSSRSVLLAELPPGTSTSNRGDFTAPLGRVVLASCLFLYGWLGRSRWGALRHNSRWMLGHLRSPPGHWCDRMLRGSARAGNQTRQVSPPVGWSTPAKGAPVHVGTSGFNMSPVEVAVHVIFFIWPNN

SEQ ID NO: 28285 - protein, 58 aa, Diabrotica virgifera
  misc_feature: Coding regions on vcDNA: vcDNA=SeqID_7982; Strand=+; Position=136-312
KIRHFWEKLFIRYFSWNLYLNCILLVIFYIIHLILIYQLIFFSITILINFDSKPFMIF

SEQ ID NO: 28286 - protein, 138 aa, Diabrotica virgifera
  misc_feature: Coding regions on vcDNA: vcDNA=SeqID_7983; Strand=+; Position=1-417
  misc_feature: Homolog annotation: Hit_ID=XP_321841.1; Match level="QueryCoverage =100%, HitCoverage=81%, E-value=7e-62, Identity=87%"; Hit description= ENSANGP00000020957 [Anopheles gambiae]
  misc_feature: Gene Ontology Annotation: Molecular function=structural molecule activity; Cellular component=actin filament; Biological process =actin cytoskeleton organization and biogenesis
  misc_feature: Pfam annotation: Pfam_ID=ARPC4; Match level="Score=268.4, E-value =1.2e-77, Copies=1"; Pfam description=ARP2/3 complex 20 kDa subunit (ARPC4)
  misc_feature (27)..(33): Xaa can be any naturally occurring amino acid
ERHNKPEVEVTTSKELLLNPVVISRNXXXXXXXEASVNSIRISIAVKQADEIEKILCKKFMRFMMMRAENFIVLRRKPIEGYDISFLITNFHTEQMYKHKLVDFVIHFMEEIDKEISEMKLAVNARARIVSEEFLKRF

SEQ ID NO: 28287 - protein, 101 aa, Diabrotica virgifera
  misc_feature: Coding regions on vcDNA: vcDNA=SeqID_7984; Strand=+; Position=536-838
  misc_feature (86)..(86): Xaa can be any naturally occurring amino acid
WETKTLKTYHRNKDILVGVKQCKYLGAIFNKRRNSEDEIQHRINKGRSITRSLNSILWDKGIRKETKRRIYESIMKSAAIYGAESXDISARNKKKLLSSEL

SEQ ID NO: 28288 - protein, 88 aa, Diabrotica virgifera
  misc_feature: Coding regions on vcDNA: vcDNA=SeqID_7985; Strand=-; Position=1-264
  misc_feature (10)..(16): Xaa can be any naturally occurring amino acid
  misc_feature (34)..(40): Xaa can be any naturally occurring amino acid
  misc_feature (55)..(86): Xaa can be any naturally occurring amino acid
FLKKVRHPAXXXXXXXVFPAQIKKPFNSPLGGSXXXXXXXLELFPIKIAPVFPIXXXXXXXXXXXXXXXXXXXXXXXXXXXXXXXXPP

SEQ ID NO: 28289 - protein, 77 aa, Diabrotica virgifera
  misc_feature: Coding regions on vcDNA: vcDNA=SeqID_7986; Strand=+; Position=362-595
  misc_feature (31)..(37): Xaa can be any naturally occurring amino acid
VSFCYTLALGFLSTKVFRLFFIYSTVHTTCXXXXXXXPLSRLLYSERLHLHHRQMPTILLILDSQITLSSHITSLLV

SEQ ID NO: 28290 - protein, 100 aa, Diabrotica virgifera
  misc_feature: Coding regions on vcDNA: vcDNA=SeqID_7987; Strand=+; Position=41-343
ENTITARIKIGKRKTVGFVQHTKTTAENGWDNIPRCCLLFFDQRSKNNNQLGFSFRLLYRTRRYKNTFYLIHWRTLYIELYYRHKGTMSIFVNIGIILQL

SEQ ID NO: 28291 - protein, 78 aa, Diabrotica virgifera
  misc_feature: Coding regions on vcDNA: vcDNA=SeqID_7988; Strand=+; Position=40-276
QIRARKGLRKRRRKAVNITTEYPESYKWVPNCKEYRTKKNSGKSTTKNGRYVTAFLGKSVMKKFCIVVKILIVTKSVI

SEQ ID NO: 28292 - protein, 147 aa, Diabrotica virgifera
  misc_feature: Coding regions on vcDNA: vcDNA=SeqID_7989; Strand=-; Position=2-441
  misc_feature: Homolog annotation: Hit_ID=A32713; Match level="QueryCoverage=99%, HitCoverage=17%, E-value=3e-35, Identity=48%"; Hit description =reverse transcriptase homolog - fruit fly (Drosophila melanogaster)
  misc_feature: Pfam annotation: Pfam_ID=RVT_1; Match level="Score=-32.2, E-value =0.016, Copies=1"; Pfam description=Reverse transcriptase (RNA -dependent D
  misc_feature (20)..(20): Xaa can be any naturally occurring amino acid
KEMCAAVFLDVEKALDKVIXGLLYKVKSNMPNEINLILKSYLSERFFEIKVNTSLSKYHPIQSGVPQGRVLGPFLYLLYTADIPADDDITMTTFADDTGILTSDENPDRASNKLQNYLNSLQTWLTKRKIKVNGEKSSQITFTTRRI

SEQ ID NO: 28293 - protein, 248 aa, Diabrotica virgifera
  misc_feature: Coding regions on vcDNA: vcDNA=SeqID_7990; Strand=+; Position=219-960
  misc_feature: Homolog annotation: Hit_ID=NP_996336.1; Match level="QueryCoverage =100%, HitCoverage=42%, E-value=1e-108, Identity=79%"; Hit description=CG2621-PJ, isoform J [Drosophila melanogaster] ref|NP _476714.1| CG2621-PA, isoform A [Drosophila
  misc_feature: Gene Ontology Annotation: Molecular function=glycogen synthase kinase 3 activity; Cellular component=cellular_component unknown; Biological process=mitotic spindle orientation
  misc_feature: Pfam annotation: Pfam_ID=Pkinase; Match level="Score=95.4, E-value =1.5e-25, Copies=1"; Pfam description=Protein kinase domain
  misc_feature (69)..(79): Xaa can be any naturally occurring amino acid
  misc_feature (162)..(162): Xaa can be any naturally occurring amino acid
  misc_feature (196)..(196): Xaa can be any naturally occurring amino acid
  misc_feature (227)..(227): Xaa can be any naturally occurring amino acid
MSGRPRTTSFAEGNKQAKNPPLGGMKISSKDGSKVTTVVATPGQGPDRPQEVSYTDTKVIGNGSFGVVXXXXXXXXXXXVAIKKVLQDKRFKNRELQIMRKLEHCNIVKLKYFFYSSGDKKDEVYLNLVLEYIPETVYKVARHYSKSKQTIPISFIKLYMYXLFRSLAYIHSLGICHRDIKPQNLLLDPETGVLKXCDFGKCKTSRQGEPNVSYICSRYYRAPEVIXFGAIDYTTKIDVWNGWGAVLA

SEQ ID NO: 28294 - protein, 159 aa, Diabrotica virgifera
  misc_feature: Coding regions on vcDNA: vcDNA=SeqID_7991; Strand=+; Position=133-614
  misc_feature: Homolog annotation: Hit_ID=XP_310955.1; Match level="QueryCoverage =98%, HitCoverage=37%, E-value=9e-27, Identity=41%"; Hit description =ENSANGP00000019418 [Anopheles gambiae]
  misc_feature (35)..(35): Xaa can be any naturally occurring amino acid
  misc_feature (100)..(100): Xaa can be any naturally occurring amino acid
  misc_feature (105)..(105): Xaa can be any naturally occurring amino acid
  misc_feature (127)..(127): Xaa can be any naturally occurring amino acid
DVGNRVIHGKTKQDINEPSVPGHCIVGGNNRNTAXHGEKARDMTGKPVISDIIKEVAAQILGKVGIDAGSVDSLSDHVLPSTKREMMPIYWGWRRGATGXIVTSXPGVMERLRFTLILLETFYKDDXTTHPQWPEKQIVSADLRGNGAVIGKLDLDLMT

SEQ ID NO: 28295 - protein, 70 aa, Diabrotica virgifera
  misc_feature: Coding regions on vcDNA: vcDNA=SeqID_7992; Strand=+; Position=204-416
HYVKRTRMSIVYRYTVYILYEHFNVRFLDCLNQIVWNETSILRKADWNNYILDTWIAPYKSSECLTKPFG

SEQ ID NO: 28296 - protein, 286 aa, Diabrotica virgifera
  misc_feature: Coding regions on vcDNA: vcDNA=SeqID_7993; Strand=+; Position=2-857
  misc_feature: Homolog annotation: Hit_ID=EAL30951.1; Match level="QueryCoverage =98%, HitCoverage=52%, E-value=6e-60, Identity=41%"; Hit description =GA19282-PA [Drosophila pseudoobscura]
  misc_feature: Gene Ontology Annotation: Cellular component=integral to membrane; Biological process=spermatogenesis
  misc_feature (276)..(276): Xaa can be any naturally occurring amino acid
PRVRNDRSYGLGATLKLTEKEQRVNNVLMKYKLSEYDAGLEDLDTFLAAQHYFKVKDKIQYSKVFDIIKRIPKGASLHSHDEALVSEDYLFSLTFRDNLYGCIDGDDFKLYFFQKNNISDSCNWKLLSDIRKSDVRFNRFLKTKLTIITDDPEKSYPDINKVWKTFQAIFKSINGLITYKPVFEDYFYMALKELYNDNIKYMELRGFLPTLYDLEGNIYSQEEVVGIYSDVLKRFQRDFPDFFGAKFIYAPSRHCDNSTMDTFVETFRKIKKLYPXDFVVGFDLVG

SEQ ID NO: 28297 - protein, 107 aa, Diabrotica virgifera
  misc_feature: Coding regions on vcDNA: vcDNA=SeqID_7994; Strand=+; Position=50-373
  misc_feature: Homolog annotation: Hit_ID=BAC56715.1; Match level="QueryCoverage =99%, HitCoverage=33%, E-value=8e-48, Identity=84%"; Hit description =receptor for activated protein kinase C homolog [Mamestra brassicae]
  misc_feature: Gene Ontology Annotation: Molecular function=molecular_function unknown; Cellular component=actin filament; Biological process =signal transduction
  misc_feature: Pfam annotation: Pfam_ID=WD40; Match level="Score=87.6, E-value=3.4e -23, Copies=2"; Pfam description=WD domain, G-beta repeat
  misc_feature (94)..(103): Xaa can be any naturally occurring amino acid
MTETLQLKGTLLGHNGWVTQIATNPKYPDMILSSSRDKTLIVWKLTREDTQYGVPQKRLYGHSHFISDVVLSSDGNYALSGSWDKTLRLWDLAXXXXXXXXXXHTKV

SEQ ID NO: 28298 - protein, 38 aa, Diabrotica virgifera
  misc_feature: Coding regions on vcDNA: vcDNA=SeqID_7995; Strand=-; Position=2-115
  misc_feature (16)..(16): Xaa can be any naturally occurring amino acid
  misc_feature (19)..(19): Xaa can be any naturally occurring amino acid
  misc_feature (21)..(21): Xaa can be any naturally occurring amino acid
  misc_feature (23)..(23): Xaa can be any naturally occurring amino acid
  misc_feature (28)..(36): Xaa can be any naturally occurring amino acid
ISSKCNTSWYSTHMKXVSXLXNXEMCQXXXXXXXXXNW

SEQ ID NO: 28299 - protein, 244 aa, Diabrotica virgifera
  misc_feature: Coding regions on vcDNA: vcDNA=SeqID_7996; Strand=-; Position=61-796
  misc_feature: Homolog annotation: Hit_ID=CAA10770.1; Match level="QueryCoverage =75%, HitCoverage=54%, E-value=2e-18, Identity=29%"; Hit description =reverse transcriptase-like [Bos taurus]
  misc_feature (139)..(139): Xaa can be any naturally occurring amino acid
  misc_feature (168)..(168): Xaa can be any naturally occurring amino acid
  misc_feature (205)..(210): Xaa can be any naturally occurring amino acid
QERCRFFPKRQYSGNIREADYSAARWSCYVLITTTFKYGLLLNTKKTKFMMISKNEQQFGRISVNGQQIEKVKTYTYLGMNVNENWDHSIEIKCRTEKARSAFQKMAKLFKCHDLSIRIKVRLLRCYIFPILLYGVESXTLTDATCKKIEASEMWLYRRILKISYTDXTNQGVLLRIQKEKELLIKINTTKIEYLGHIMRNSERXXXXXXILQGKRRKARTGKAKDFLAEKSTYVVQHSYYKYF

SEQ ID NO: 28300 - protein, 264 aa, Diabrotica virgifera
  misc_feature: Coding regions on vcDNA: vcDNA=SeqID_7997; Strand=+; Position=29-822
  misc_feature: Homolog annotation: Hit_ID=CAE62707.1; Match level="QueryCoverage =53%, HitCoverage=35%, E-value=3e-10, Identity=27%"; Hit description =Hypothetical protein CBG06860 [Caenorhabditis briggsae]
  misc_feature: Pfam annotation: Pfam_ID=HRM; Match level="Score=5.7, E-value=0.01, Copies=1"; Pfam description=Hormone receptor domain
  misc_feature (208)..(208): Xaa can be any naturally occurring amino acid
  misc_feature (216)..(216): Xaa can be any naturally occurring amino acid
MWCLMLFRVGLSILFFFHTTLALPDECSSISPVRSCLLRTNYIDIRLWRYYAGYFCYIYTNEARLDIKYNSTSYNITCGGENATIPVARVEENIIASYDYTDKEDVQHIRKSFKTDSCCQGAIRCCNDHMDEENVIPTQSQCPVIWDAWSCFPQTKVNTTAKLPCSSQAYQSPDEVCTLESEKHCIWNGTNQKAQWIQQTDYTTCAIXAGLRTKIXTSILYFWGVCIGFCIPAISIFFFFEKLRKTIRVILHRNLLIAHCSGMS

SEQ ID NO: 28301 - protein, 84 aa, Diabrotica virgifera
  misc_feature: Coding regions on vcDNA: vcDNA=SeqID_7998; Strand=+; Position=395-649
  misc_feature (18)..(26): Xaa can be any naturally occurring amino acid
  misc_feature (78)..(83): Xaa can be any naturally occurring amino acid
EKLFGIKNYVIICNYIFXXXXXXXXXLKLRIPLDFIRISCLKMALEFFAIHHFEVEKMSFFYFTMYILKCTRRKNIMXXXXXXH

SEQ ID NO: 28302 - protein, 75 aa, Diabrotica virgifera
  misc_feature: Coding regions on vcDNA: vcDNA=SeqID_7999; Strand=+; Position=881-1105
  misc_feature (42)..(49): Xaa can be any naturally occurring amino acid
  misc_feature (62)..(69): Xaa can be any naturally occurring amino acid
TQNFKFVCSMISHCTFGPNIYAMVQIIGLGNHLLKALIGILXXXXXXXXKKVEKMVSWWERXXXXXXXXWKYWAI

SEQ ID NO: 28303 - protein, 119 aa, Diabrotica virgifera
  misc_feature: Coding regions on vcDNA: vcDNA=SeqID_8000; Strand=+; Position=13-369
  misc_feature: Homolog annotation: Hit_ID=XP_315269.1; Match level="QueryCoverage =77%, HitCoverage=24%, E-value=4e-09, Identity=37%"; Hit description =ENSANGP00000022308 [Anopheles gambiae]
LERISRTREPLSTTKDNRRDHDGAAHGADNGAGKFPSRTTGEDAPRGDGPTTNGRPRDEGGREERGRKDAHGGHEGQSEGGARAQQHPREHGSHAKGKDEKKGGARATPKGEPRISKST

SEQ ID NO: 28304 - protein, 92 aa, Diabrotica virgifera
  misc_feature: Coding regions on vcDNA: vcDNA=SeqID_8001; Strand=+; Position=258-536
KVCFIDFELQERTATATALTRRLVDVHGTIVSPDTIRRRLNEQNISYVPTAGSLLVAAHRRKRLEPGIASFSCKLGYRRLEKLSVYRRISFY

SEQ ID NO: 28305 - protein, 257 aa, Diabrotica virgifera
  misc_feature: Coding regions on vcDNA: vcDNA=SeqID_8002; Strand=-; Position=1-771
  misc_feature (7)..(26): Xaa can be any naturally occurring amino acid
  misc_feature (47)..(58): Xaa can be any naturally occurring amino acid
  misc_feature (62)..(125): Xaa can be any naturally occurring amino acid
  misc_feature (129)..(137): Xaa can be any naturally occurring amino acid
  misc_feature (143)..(165): Xaa can be any naturally occurring amino acid
  misc_feature (171)..(179): Xaa can be any naturally occurring amino acid
  misc_feature (187)..(194): Xaa can be any naturally occurring amino acid
  misc_feature (199)..(231): Xaa can be any naturally occurring amino acid
  misc_feature (235)..(253): Xaa can be any naturally occurring amino acid
GGGVGGXXXXXXXXXXXXXXXXXXXXGGRGPRLSLFLRCEKKRGEGXXXXXXXXXXXXWAAXXXXXXXXXXXXXXXXXXXXXXXXXXXXXXXXXXXXXXXXXXXXXXXXXXXXXXXXXXXXXXXXGGWXXXXXXXXXKGRVWXXXXXXXXXXXXXXXXXXXXXXXGRTPLXXXXXXXXXGPLFFYPXXXXXXXXLGVFXXXXXXXXXXXXXXXXXXXXXXXXXXXXXXXXXPPLXXXXXXXXXXXXXXXXXXXPPPV

SEQ ID NO: 28306 - protein, 85 aa, Diabrotica virgifera
  misc_feature: Coding regions on vcDNA: vcDNA=SeqID_8003; Strand=-; Position=377-634
  misc_feature (63)..(70): Xaa can be any naturally occurring amino acid
LGGDRIRNVDVRAELEIPSVLEFVENNKLSWWGHLQRMNDSRPVNQVWEARIQHKRGRGRPRXXXXXXXXDALKKRGKRGRKQRF

SEQ ID NO: 28307 - protein, 45 aa, Diabrotica virgifera
  misc_feature: Coding regions on vcDNA: vcDNA=SeqID_8004; Strand=-; Position=1-135
  misc_feature (3)..(17): Xaa can be any naturally occurring amino acid
  misc_feature (22)..(45): Xaa can be any naturally occurring amino acid
KLXXXXXXXXXXXXXXXTGFFXXXXXXXXXXXXXXXXXXXXXXXX

SEQ ID NO: 28308 - protein, 144 aa, Diabrotica virgifera
  misc_feature: Coding regions on vcDNA: vcDNA=SeqID_8005; Strand=+; Position=1-435
  misc_feature (4)..(37): Xaa can be any naturally occurring amino acid
  misc_feature (41)..(96): Xaa can be any naturally occurring amino acid
  misc_feature (99)..(117): Xaa can be any naturally occurring amino acid
  misc_feature (128)..(135): Xaa can be any naturally occurring amino acid
LRPXXXXXXXXXXXXXXXXXXXXXXXXXXXXXXXXXXILTXXXXXXXXXXXXXXXXXXXXXXXXXXXXXXXXXXXXXXXXXXXXXXXXXXXXXXXXLSXXXXXXXXXXXXXXXXXXXRNSTTFKLLYXXXXXXXXLLDYKNKLP

SEQ ID NO: 28309 - protein, 42 aa, Diabrotica virgifera
  misc_feature: Coding regions on vcDNA: vcDNA=SeqID_8006; Strand=+; Position=1-129
FGLFFVSFSLHILSSPYILLIIYHNTSTFPLLDPFKNTQILH

SEQ ID NO: 28310 - protein, 169 aa, Diabrotica virgifera
  misc_feature: Coding regions on vcDNA: vcDNA=SeqID_8007; Strand=-; Position=1-507
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(167): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRS

SEQ ID NO: 28311 - protein, 95 aa, Diabrotica virgifera
  misc_feature: Coding regions on vcDNA: vcDNA=SeqID_8008; Strand=+; Position=448-735
SLVKAYPVNLQLLFHDDTYLPGATGVLLLELTDEGSHEQINIRHRGFHIIFTKTSNNLLTNPNIRTSFAETVKKTRSRCSSHIIYELKTCLISSS

SEQ ID NO: 28312 - protein, 63 aa, Diabrotica virgifera
  misc_feature: Coding regions on vcDNA: vcDNA=SeqID_8009; Strand=-; Position=590-781
KGRIPKTKRKIFNTMNRPNEDWWLLEPVYLLPRHDKGSRKKSEKNNNFFPFIGHCFFLSNALN

SEQ ID NO: 28313 - protein, 134 aa, Diabrotica virgifera
  misc_feature: Coding regions on vcDNA: vcDNA=SeqID_8010; Strand=+; Position=530-934
  misc_feature (66)..(72): Xaa can be any naturally occurring amino acid
  misc_feature (84)..(84): Xaa can be any naturally occurring amino acid
  misc_feature (112)..(112): Xaa can be any naturally occurring amino acid
  misc_feature (115)..(115): Xaa can be any naturally occurring amino acid
CIQHTMVSCSQHSWSSRSNVDKKSAGITFQRLVCKYVNKGMPRISENKMHKSEELLFYKLIIGHIXXXXXXXRISHKLRLFLTXIVNKDNNKRIIICKIKIILLGAFLLMYXFIXQDGRPHAIIVPINGYTDKL

SEQ ID NO: 28314 - protein, 91 aa, Diabrotica virgifera
  misc_feature: Coding regions on vcDNA: vcDNA=SeqID_8011; Strand=+; Position=616-891
  misc_feature (7)..(13): Xaa can be any naturally occurring amino acid
  misc_feature (55)..(55): Xaa can be any naturally occurring amino acid
TKLNIIXXXXXXXKFPILHGKDTYGQLHYPYGKVLFYLSRVCFYKCLRPDLLEIXSSIYQLWFYLLQDTQQQNSFCVPKHQRLSSYTAISF

SEQ ID NO: 28315 - protein, 125 aa, Diabrotica virgifera
  misc_feature: Coding regions on vcDNA: vcDNA=SeqID_8012; Strand=-; Position=58-435
  misc_feature (28)..(35): Xaa can be any naturally occurring amino acid
YASYITLCTLPPPTHGHQKQFPSVCPVXXXXXXXXGVESFFCFPPFDPHGHTPHQQRPSKIYMATATSLLKPPLSLKTHCRNHPYPLASMFLRFSHYLCILCKQNPYKVKDHYSLQKLCPIDSFA

SEQ ID NO: 28316 - protein, 66 aa, Diabrotica virgifera
  misc_feature: Coding regions on vcDNA: vcDNA=SeqID_8013; Strand=+; Position=1-201
EDLTPVVTIPNSVPFYSNVDFELQIILILLPSHMVKQKFRMNMFVIGPFDSVGSAAIANLFPKCEL

SEQ ID NO: 28317 - protein, 189 aa, Diabrotica virgifera
  misc_feature: Coding regions on vcDNA: vcDNA=SeqID_8014; Strand=+; Position=150-719
  misc_feature: Homolog annotation: Hit_ID=AAM53185.1; Match level="QueryCoverage =98%, HitCoverage=40%, E-value=3e-30, Identity=42%"; Hit description =Hsp70 protein [Mitsukurina owstoni]
  misc_feature: Gene Ontology Annotation: Biological process=reproduction
  misc_feature (29)..(29): Xaa can be any naturally occurring amino acid
  misc_feature (82)..(82): Xaa can be any naturally occurring amino acid
  misc_feature (98)..(98): Xaa can be any naturally occurring amino acid
  misc_feature (142)..(142): Xaa can be any naturally occurring amino acid
  misc_feature (160)..(160): Xaa can be any naturally occurring amino acid
LKDDNACYPEKNTALILIIMNDIFKLYLXNNVTKAENPYPAYSPDTRRGVTKHAALIGEILLLLNIIQTTAGVLHNGLDIKXYGDLPILIFDVNDGTXDESILPLAYVISKELSSAEDTTLLGVNYDNKVDNQFVVDLYERXYNDLITIPRALRRLRTNXEIADGNLSSSTQAYIAINSLFERIDFYTS

SEQ ID NO: 28318 - protein, 249 aa, Diabrotica virgifera
  misc_feature: Coding regions on vcDNA: vcDNA=SeqID_8015; Strand=+; Position=96-845
  misc_feature: Homolog annotation: Hit_ID=AAT96002.1; Match level="QueryCoverage =72%, HitCoverage=22%, E-value=2e-13, Identity=30%"; Hit description =transposase [Drosophila willistoni]
NVTPRIKCVNGWKITINGVIHLWNLLQSHGMDYFFTRRMNQNCLENFFGSIRQLGGNCVNPTPVQFTAAFKRYFCLDTMHSGTENCERDAGDILLNLTDICNDESRPETPALVPENTLDDQEYQTSDKLQKNFTRYICGYLIKKCLRKHVCQICEAYGREYDELDDSSLFCYVKAYSGNETNVFGKLYMPSQNFVQYITDLEIIFQENFQNFSHQPKILQNYVSLFEKIPYTHPCSNFQRVISLDYMLE

SEQ ID NO: 28319 - protein, 317 aa, Diabrotica virgifera
  misc_feature: Coding regions on vcDNA: vcDNA=SeqID_8016; Strand=+; Position=51-998
  misc_feature: Homolog annotation: Hit_ID=NP_649847.1; Match level="QueryCoverage =100%, HitCoverage=57%, E-value=2e-90, Identity=54%"; Hit description= CG11964-PA [Drosophila melanogaster] gb|AAF54309.1| CG11964-PA [Drosophila melanogaster]
  misc_feature: Pfam annotation: Pfam_ID=Arm; Match level="Score=18.5, E-value=0.021, Copies=1"; Pfam description=Armadillo/beta-catenin-like repeat
  misc_feature (224)..(230): Xaa can be any naturally occurring amino acid
  misc_feature (253)..(253): Xaa can be any naturally occurring amino acid
  misc_feature (264)..(264): Xaa can be any naturally occurring amino acid
  misc_feature (271)..(271): Xaa can be any naturally occurring amino acid
  misc_feature (276)..(276): Xaa can be any naturally occurring amino acid
  misc_feature (279)..(279): Xaa can be any naturally occurring amino acid
  misc_feature (303)..(303): Xaa can be any naturally occurring amino acid
MDVEELLDYKPPQALKRPVQVDEEEDEAERTRKMRRLARAKASRMARPISPTPSTQPLDHISEEERAEILKFVETEQTQGEIIDETALKKIVLNFEKRSLKNREMRIKFPDSPEKFLESEVELHEILQEMRILATAPDYYPLLIKLQVIPSLLELLSHDNTDIAVATVELLQELTDVDSLNESEEGTEALIESLLDHQIIALLVQNLERLDETVKEEADGVHNXXXXXXXLTELSSEIINEATKQGLLAWLLXRLKLKTPFDPXKLYVCEXCLYYXQIXRKNRLALGDTDGIDTLFAQLGLLXRHDPTSSEEHELME

SEQ ID NO: 28320 - protein, 93 aa, Diabrotica virgifera
  misc_feature: Coding regions on vcDNA: vcDNA=SeqID_8017; Strand=+; Position=425-706
  misc_feature (11)..(17): Xaa can be any naturally occurring amino acid
  misc_feature (28)..(36): Xaa can be any naturally occurring amino acid
LIYISTSFSNXXXXXXXSTAKQKLQEIXXXXXXXXXNSLKAFYVLIVQRSVKLITEISNFYTLLIRFEGPPVFFIIVRSSNIQIYVYKTSKCK

SEQ ID NO: 28321 - protein, 63 aa, Diabrotica virgifera
  misc_feature: Coding regions on vcDNA: vcDNA=SeqID_8018; Strand=+; Position=753-944
PVNSCLDRHIGMAYVYGDIFFHFAFFAPWFIHLTKSIHLSVFLNDNVHPTIFGPSHYFDLSFY

SEQ ID NO: 28322 - protein, 66 aa, Diabrotica virgifera; identical to SEQ ID NO: 26808
  misc_feature: Coding regions on vcDNA: vcDNA=SeqID_8019; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28323 - protein, 204 aa, Diabrotica virgifera
  misc_feature: Coding regions on vcDNA: vcDNA=SeqID_8020; Strand=+; Position=69-680
  misc_feature (140)..(155): Xaa can be any naturally occurring amino acid
HKLIYNVTLDMCSSRSSYILSLVKDVKNRNEDDPDDPLPLAAIMSTSTTTPVVNFDFNNSEEHDNSLVLTQLSPVQLTNFDNNSGSHDLDVQDGLGVGIVQPINLLPESEDHPAENIQPKDTREVTKKGTPIIRKKSVLXXXXXXXXXXXXXXXXHDLYPPCQACRLKCIENIPEVRRKQIISVYCARSWLERTNFMLISTTRC

SEQ ID NO: 28324 - protein, 91 aa, Diabrotica virgifera
  misc_feature: Coding regions on vcDNA: vcDNA=SeqID_8021; Strand=-; Position=426-701
RGLKSMSKATLSSLCRPCPLSGNGWACFAKSRQNLATSNAYDKGDILLGTIVSGAVSLYVPYADELSDYHDGVGYILTFAIRYSVPISEAV

SEQ ID NO: 28325 - protein, 96 aa, Diabrotica virgifera
  misc_feature: Coding regions on vcDNA: vcDNA=SeqID_8022; Strand=+; Position=273-563
DVLSTECRSTGRYRIVVRQQRESEPLVRDLSPDVHTDKDKYKKYLNERSLQKYTIQRMLYQDARNMRRVTESTTLLDEIILLLAPRGCLAYNHLEG

SEQ ID NO: 28326 - protein, 284 aa, Diabrotica virgifera
  misc_feature: Coding regions on vcDNA: vcDNA=SeqID_8023; Strand=+; Position=3-905
  misc_feature: Homolog annotation: Hit_ID=XP_319941.1; Match level="QueryCoverage =93%, HitCoverage=11%, E-value=1e-63, Identity=44%"; Hit description =ENSANGP00000016695 [Anopheles gambiae]
  misc_feature: Gene Ontology Annotation: Molecular function=molecular_function unknown; Cellular component=mitochondrion; Biological process=polar body extrusion after meiotic divisions
  misc_feature: Pfam annotation: Pfam_ID=Ketoacyl-synt_C; Match level="Score=-25.5, E- value=4.7e-05, Copies=1"; Pfam description=Beta-ketoacyl synthase, C -terminal do
  misc_feature (220)..(224): Xaa can be any naturally occurring amino acid
RKTPLMIGSVKANTGHCENTAAIVSVIKILTAFETGIIPGNIHAEPVDETLKGIKDGTLQVVTKHTEWPTGLGAVNSFGIGGSNGHAHRLVQVSGRTQEAVNHFLDGVVKNKDDEEFLALLDEIHKMNMKRHFFRGYTVLGKQPVRNISKYTSERPLVFIYSGLGTQWAGMGKDLLEFPVFRSTFIRCAAAVEPYGLDLMDLILKGSENSVNDIVFVFTXXXXXQISLTDFLYSLDIRPDFYAGHSSGEVGCAYANGDLTPEQAVKKQQLEVGQWPLWVLGQNN

SEQ ID NO: 28327 - protein, 206 aa, Diabrotica virgifera
  misc_feature: Coding regions on vcDNA: vcDNA=SeqID_8024; Strand=+; Position=201-818
  misc_feature: Homolog annotation: Hit_ID=NP_476772.1; Match level="QueryCoverage =98%, HitCoverage=44%, E-value=1e-75, Identity=73%"; Hit description =CG1913-PA [Drosophila melanogaster] gb|EAL28889.1| GA15128-PA [Drosophila
  misc_feature: Gene Ontology Annotation: Molecular function=GTP binding; Cellular component=microtubule; Biological process=microtubule-based process
  misc_feature: Pfam annotation: Pfam_ID=Tubulin; Match level="Score=173.7, E-value =3.9e-49, Copies=1"; Pfam description=Tubulin/FtsZ family, GTPase domain
  misc_feature (41)..(41): Xaa can be any naturally occurring amino acid
  misc_feature (54)..(54): Xaa can be any naturally occurring amino acid
  misc_feature (126)..(126): Xaa can be any naturally occurring amino acid
  misc_feature (144)..(144): Xaa can be any naturally occurring amino acid
  misc_feature (194)..(194): Xaa can be any naturally occurring amino acid
LQHQMQSNKTVVGGDDSYDTLFIETGVVKHVPRAAFADLEXPRGAYEVLTGTYXNLMLPEQLITGEEDVDNNYDRGHYKIGKEIVDLVLNRIRILTDQCPGLQGLVTIHSFGAGTGSGFTSLLMEXLSVDYGIKSKLECAIYPXTLVSTAVRQSYYSVLTTHTTLEHSDCVVMVDNEAIYDISRRNLDIKRPTXTILNRLIVQIVS

SEQ ID NO: 28328 - protein, 113 aa, Diabrotica virgifera
  misc_feature: Coding regions on vcDNA: vcDNA=SeqID_8025; Strand=+; Position=318-659
FVNNRRSYENPKLRIQKTFPLLSSRNNLARSSKPAIDLIASRLPEESKDLSRIGPENHCCRSKTSMQFHSLKKISEIVRNPSWPFEKETFAFFSLASAEKIQIPVNSTKAQKT

SEQ ID NO: 28329 - protein, 69 aa, Diabrotica virgifera
  misc_feature: Coding regions on vcDNA: vcDNA=SeqID_8026; Strand=+; Position=30-239
KTFAASATRIASRLQLQQVRNIVSHLRPTKNKNLLRRKVCPSVFASAVGIVARPSPGTSQHQTLQGRTC

SEQ ID NO: 28330 - protein, 105 aa, Diabrotica virgifera
  misc_feature: Coding regions on vcDNA: vcDNA=SeqID_8027; Strand=-; Position=327-644
  misc_feature (20)..(26): Xaa can be any naturally occurring amino acid
YYLHNIDCFIFCCLLITTSXXXXXXXSDPDLLSRSYQRHYQVIFADLFKQKAKSTVSSAYRKLLMTSPSKIIPSCFSERAISENSFGVNVEKAGVIRGISVVLLF

SEQ ID NO: 28331 - protein, 178 aa, Diabrotica virgifera
  misc_feature: Coding regions on vcDNA: vcDNA=SeqID_8028; Strand=+; Position=9-545
MRHRTTTATTQRHPNHRYEDEHANEVPTSSSSTTFPSNGINIVQPPSLPPKIINEDLLRAQDEKKEVYIEKDVPVSFIPVKDIDLSVGDDKEQDENVPLIVDFPEDLKGVLSDLNMESALKQKTKKHNKSKTKPTQKPTQKPTGEIGDEQLNNLLATLKLLAAQQTSTTTTTTRNSRC

SEQ ID NO: 28332 - protein, 308 aa, Diabrotica virgifera
  misc_feature: Coding regions on vcDNA: vcDNA=SeqID_8029; Strand=-; Position=1-924
  misc_feature (1)..(7): Xaa can be any naturally occurring amino acid
  misc_feature (14)..(58): Xaa can be any naturally occurring amino acid
  misc_feature (72)..(84): Xaa can be any naturally occurring amino acid
  misc_feature (87)..(120): Xaa can be any naturally occurring amino acid
  misc_feature (126)..(149): Xaa can be any naturally occurring amino acid
  misc_feature (152)..(161): Xaa can be any naturally occurring amino acid
  misc_feature (166)..(202): Xaa can be any naturally occurring amino acid
  misc_feature (204)..(210): Xaa can be any naturally occurring amino acid
  misc_feature (220)..(241): Xaa can be any naturally occurring amino acid
  misc_feature (245)..(258): Xaa can be any naturally occurring amino acid
  misc_feature (267)..(308): Xaa can be any naturally occurring amino acid
XXXXXXXLSPLPPXXXXXXXXXXXXXXXXXXXXXXXXXXXXXXXXXXXXXXXXXXXXXRAPPQQQTHPPPPXXXXXXXXXXXXXRAXXXXXXXXXXXXXXXXXXXXXXXXXXXXXXXXXXPAGARXXXXXXXXXXXXXXXXXXXXXXXXEEXXXXXXXXXXFLFCXXXXXXXXXXXXXXXXXXXXXXXXXXXXXXXXXXXXXKXXXXXXXNTALFSLWGXXXXXXXXXXXXXXXXXXXXXXTPRXXXXXXXXXXXXXXARRPPPAAXXXXXXXXXXXXXXXXXXXXXXXXXXXXXXXXXXXXXXXXXX

SEQ ID NO: 28333 - protein, 255 aa, Diabrotica virgifera
  misc_feature: Coding regions on vcDNA: vcDNA=SeqID_8030; Strand=+; Position=43-807
  misc_feature (26)..(34): Xaa can be any naturally occurring amino acid
  misc_feature (40)..(64): Xaa can be any naturally occurring amino acid
  misc_feature (68)..(254): Xaa can be any naturally occurring amino acid
VKFSIRRDESLSPFSKEKISLSRTSXXXXXXXXXHHHLTXXXXXXXXXXXXXXXXXXXXXXXXXIEIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXS

SEQ ID NO: 28334 - protein, 123 aa, Diabrotica virgifera
  misc_feature: Coding regions on vcDNA: vcDNA=SeqID_8031; Strand=+; Position=64-435
  misc_feature: Homolog annotation: Hit_ID=AAK61417.1; Match level="QueryCoverage =93%, HitCoverage=32%, E-value=2e-12, Identity=34%"; Hit description =transposase [Ceratitis rosa]
MYGKVGTQLIGPFFTEGNLTSDSHEMLLRNEIVTTLRNLFGISFNQIWFRQDRAPTHFGVNVRRYVDEIFPGRWIGRRGRIEWPPRSPDFNPKDYFYWGYLKNLVYKTKPESLADVQEFICTH

SEQ ID NO: 28335 - protein, 118 aa, Diabrotica virgifera
  misc_feature: Coding regions on vcDNA: vcDNA=SeqID_8032; Strand=+; Position=119-472
  misc_feature: Homolog annotation: Hit_ID=NP_848627.1; Match level="QueryCoverage =90%, HitCoverage=24%, E-value=3e-11, Identity=32%"; Hit description =hypothetical protein LOC285671 [Homo sapiens] dbj|BAC03514.1| unnamed protein product [Homo
TSNRRYFQEIKCKKCRKTIFSPDQIKTNLILNAHGHPMDNSRVCDIDVEETNVFINDEHLPSWIKDRIEAEEWSKGRINCPNCDSRIGSFDYVSGQKCACFTNLLPPIHFIKSKIDLI

SEQ ID NO: 28336 - protein, 79 aa, Diabrotica virgifera
  misc_feature: Coding regions on vcDNA: vcDNA=SeqID_8033; Strand=+; Position=133-372
  misc_feature (11)..(29): Xaa can be any naturally occurring amino acid
NLLLRRYYPIXXXXXXXXXXXXXXXXXXXHLFNGGDSQRNLTFVILSYQLPLLWSKSFDYIIILPTRMAVVILLSSSYL

SEQ ID NO: 28337 - protein, 289 aa, Diabrotica virgifera
  misc_feature: Coding regions on vcDNA: vcDNA=SeqID_8034; Strand=-; Position=1-867
  misc_feature (6)..(6): Xaa can be any naturally occurring amino acid
  misc_feature (8)..(246): Xaa can be any naturally occurring amino acid
  misc_feature (251)..(287): Xaa can be any naturally occurring amino acid
KIGSKXYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFRLXXXXXXXXXXXXXXXXXXXXXXXXXXXXXXXXXXXXXEV

SEQ ID NO: 28338 - protein, 95 aa, Diabrotica virgifera
  misc_feature: Coding regions on vcDNA: vcDNA=SeqID_8035; Strand=-; Position=6-293
  misc_feature (81)..(87): Xaa can be any naturally occurring amino acid
GITSCLSMYIITTIETKQRSTDCKYLHSDWILLSYTYLYWPDLCFHPIQLSQLFSHTICNVSVPTTLIVNNKISKNLRYEXXXXXXXALYFDSIL

SEQ ID NO: 28339 - protein, 61 aa, Diabrotica virgifera
  misc_feature: Coding regions on vcDNA: vcDNA=SeqID_8036; Strand=-; Position=583-768
VHIWQQLICRLWFFMILLVPIGFNKRSRCRENSSTKIRKFIFLLQLLQFYTALSHFTFCNV

SEQ ID NO: 28340 - protein, 185 aa, Diabrotica virgifera
  misc_feature: Coding regions on vcDNA: vcDNA=SeqID_8037; Strand=+; Position=1-558
  misc_feature: Homolog annotation: Hit_ID=XP_308120.1; Match level="QueryCoverage =96%, HitCoverage=39%, E-value=3e-52, Identity=54%"; Hit description =ENSANGP00000017139 [Anopheles gambiae]
  misc_feature: Gene Ontology Annotation: Molecular function=nucleoside transporter activity; Cellular component=integral to plasma membrane; Biological process=physiological processes
  misc_feature: Pfam annotation: Pfam_ID=Nucleoside_tran; Match level="Score=-11.7, E- value=6.7e-08, Copies=1"; Pfam description=Nucleoside transporter
  misc_feature (5)..(10): Xaa can be any naturally occurring amino acid
QRPPXXXXXXQSFPQLLNVWMVFFVTISVFPAVQSGIQRSDDSFFVPEFIYVNLMCFMTFNIFAMIGSCLPAFFVWPSPKFLWIPVTARIVYIPLFLLCNYQVKGIQRVLPRLITNDYVYFLLSASMALSSGYLSSLGMMYAPRSVDDRYAPTAGMFSAAALITGIFSGILIAFLWPWVIGHVGA

SEQ ID NO: 28341 - protein, 74 aa, Diabrotica virgifera
  misc_feature: Coding regions on vcDNA: vcDNA=SeqID_8038; Strand=-; Position=0-221
  misc_feature (62)..(67): Xaa can be any naturally occurring amino acid
ARGSLSNAESASSLSTLVENLVKNSTTRNDTLETKKRYTNLSAVSHYKNLNVRGLERTTTFXXXXXXSYEAFLT

SEQ ID NO: 28342 - protein, 108 aa, Diabrotica virgifera
  misc_feature: Coding regions on vcDNA: vcDNA=SeqID_8039; Strand=-; Position=42-368
KFGVKILMLHLWIFSEVLPKSLCMSVLRCEAGHESFPDFCGTHNGLMSSVDYGFYVLVNMQSFCSGPYIVRIVGELSSLYLTLNPSLLSTLLTDDHHKSFQWGVNTGE

SEQ ID NO: 28343 - protein, 94 aa, Diabrotica virgifera
  misc_feature: Coding regions on vcDNA: vcDNA=SeqID_8040; Strand=+; Position=643-925
  misc_feature: Homolog annotation: Hit_ID=CAG04540.1; Match level="QueryCoverage =84%, HitCoverage=15%, E-value=4e-20, Identity=63%"; Hit description =unnamed protein product [Tetraodon nigroviridis]
  misc_feature: Gene Ontology Annotation: Molecular function=xylosylprotein 4-beta -galactosyltransferase activity; Cellular component=Golgi apparatus
  misc_feature (38)..(38): Xaa can be any naturally occurring amino acid
  misc_feature (55)..(55): Xaa can be any naturally occurring amino acid
  misc_feature (59)..(59): Xaa can be any naturally occurring amino acid
  misc_feature (68)..(68): Xaa can be any naturally occurring amino acid
  misc_feature (71)..(71): Xaa can be any naturally occurring amino acid
  misc_feature (86)..(86): Xaa can be any naturally occurring amino acid
LLLLAVISKKLISSKHKLAVLVPYRERFEELMEFVPYXHNFLNKQKIVHDIIVLXQVDXFRFNRASLXKCXGFWEQSQIMIYIACXDVDLLPLN

SEQ ID NO: 28344 - protein, 290 aa, Diabrotica virgifera
  misc_feature: Coding regions on vcDNA: vcDNA=SeqID_8041; Strand=+; Position=3-874
  misc_feature: Homolog annotation: Hit_ID=CAH91014.1; Match level="QueryCoverage =95%, HitCoverage=58%, E-value=5e-64, Identity=44%"; Hit description =hypothetical protein [Pongo pygmaeus]
  misc_feature: Gene Ontology Annotation: Molecular function=arginyltransferase activity; Cellular component=cytoplasm; Biological process=RNA processing
  misc_feature: Pfam annotation: Pfam_ID=ATE_C; Match level="Score=214.5, E-value =2.1e-61, Copies=1"; Pfam description=Arginine-tRNA-protein transferase, C t
  misc_feature (66)..(72): Xaa can be any naturally occurring amino acid
  misc_feature (176)..(176): Xaa can be any naturally occurring amino acid
  misc_feature (211)..(211): Xaa can be any naturally occurring amino acid
  misc_feature (286)..(286): Xaa can be any naturally occurring amino acid
NTSSQKLITKTLRKEGLGADPNKPPRKKAKLLRIERKKAKGASVQKNSTPVQPKTLEEFLEEISVXXXXXXXITVERMSTTNDTFNFSANLYRKYQIKIHQDTPEECDEEQFFHFLVESPLQPKSFPNNEEGPGYGSFHQQYWLNEKLIAVGVIDILPKGVSSVYFFYDPDYAWLXLGTYGSLREVELTRKIQKSLPEFSYYYMGFYIHSXPKMRYKGKLTPSYLGWPETYTWIPIEKCLNLLEANKYSRLNEDIDALDTNIPSEEDILHIKIIYKRSLLYFSDFXNFVE

SEQ ID NO: 28345 - protein, 288 aa, Diabrotica virgifera
  misc_feature: Coding regions on vcDNA: vcDNA=SeqID_8042; Strand=-; Position=2-865
  misc_feature (3)..(3): Xaa can be any naturally occurring amino acid
  misc_feature (12)..(104): Xaa can be any naturally occurring amino acid
  misc_feature (108)..(124): Xaa can be any naturally occurring amino acid
  misc_feature (132)..(267): Xaa can be any naturally occurring amino acid
  misc_feature (272)..(281): Xaa can be any naturally occurring amino acid
IDXTSPIKLRCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXELSXXXXXXXXXXXXXXXXXVQINRWAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFRYXXXXXXXXXXRIKNFEF

SEQ ID NO: 28346 - protein, 128 aa, Diabrotica virgifera
  misc_feature: Coding regions on vcDNA: vcDNA=SeqID_8043; Strand=-; Position=63-449
CYRSSFGHIILLCVFLSGRIPSSSSFWSPSSFISDCSRYRLSSHAIVQFLYKFRNLSARPRPLPFHHLLPYSIHVHRSTPTIPVPISFFPSLRPTLPTCAHTDSLPTTALSITDAERGLGIAVQRSLQ

SEQ ID NO: 28347 - protein, 154 aa, Diabrotica virgifera
  misc_feature: Coding regions on vcDNA: vcDNA=SeqID_8044; Strand=+; Position=46-506
  misc_feature (2)..(28): Xaa can be any naturally occurring amino acid
  misc_feature (31)..(38): Xaa can be any naturally occurring amino acid
  misc_feature (74)..(74): Xaa can be any naturally occurring amino acid
KXXXXXXXXXXXXXXXXXXXXXXXXXXXGKXXXXXXXXYNQQRQEQRQKNKERGQQNKGSQRSKRKKRKRQRRXNPKRETAKQTRKKETHLRKEMTTEEETRQRNHTNRQESGRHRKAEKKREDHNTETGTKTTSNCKDSCFTYRNLIELLYLL

SEQ ID NO: 28348 - protein, 274 aa, Diabrotica virgifera
  misc_feature: Coding regions on vcDNA: vcDNA=SeqID_8045; Strand=+; Position=2-827
  misc_feature: Homolog annotation: Hit_ID=NP_523795.2; Match level="QueryCoverage =100%, HitCoverage=61%, E-value=1e-133, Identity=83%"; Hit description=CG9277-PB, isoform B [Drosophila melanogaster] gb|AAF57555.1| CG9277-PB, isoform B [Drosophila
  misc_feature: Gene Ontology Annotation: Molecular function=structural constituent of cytoskeleton; Cellular component=tubulin; Biological process =microtubule-based process
  misc_feature: Pfam annotation: Pfam_ID=Tubulin_C; Match level="Score=255.9, E-value= 7.3e-74, Copies=1"; Pfam description=Tubulin/FtsZ family, C-terminal domai
  misc_feature (60)..(60): Xaa can be any naturally occurring amino acid
  misc_feature (273)..(273): Xaa can be any naturally occurring amino acid
KVSDTVVEPYNATLSVHQLIENTDETYCIDNEALYDIGMHTLKPPSPSYGDLNYLVSLTXSGVTTCLRFPGQLNADLRKLAVNMVPFPRLHFFVPGFVPLTPKQSIKYRALTVAELTQQMFDAKNMMAPCDPRNGRYLTVATVFRGHMSMKEVDEQMLSIQNKNSSYFVEWIPNNVKVAVCDIPPRGLKMSATFIGNTTAIQELFKRISEQFSAMFARKAFVHWYTGEGMDEMEFTEAESNLNDLISEYQQYENAAVDDDADFEDDVEEVADXN

SEQ ID NO: 28349 - protein, 330 aa, Diabrotica virgifera
  misc_feature: Coding regions on vcDNA: vcDNA=SeqID_8046; Strand=+; Position=1-990
  misc_feature (2)..(254): Xaa can be any naturally occurring amino acid
  misc_feature (256)..(268): Xaa can be any naturally occurring amino acid
  misc_feature (276)..(276): Xaa can be any naturally occurring amino acid
  misc_feature (280)..(288): Xaa can be any naturally occurring amino acid
  misc_feature (290)..(298): Xaa can be any naturally occurring amino acid
  misc_feature (309)..(316): Xaa can be any naturally occurring amino acid
  misc_feature (321)..(329): Xaa can be any naturally occurring amino acid
SXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTXXXXXXXXXXXXXCDLDVGLXFIIXXXXXXXXXFXXXXXXXXXLTGVSPGGSIXXXXXXXXERPIXXXXXXXXXY

SEQ ID NO: 28350 - protein, 289 aa, Diabrotica virgifera
  misc_feature: Coding regions on vcDNA: vcDNA=SeqID_8047; Strand=-; Position=3-869
  misc_feature: Homolog annotation: Hit_ID=XP_222107.2; Match level="QueryCoverage =100%, HitCoverage=24%, E-value=5e-40, Identity=35%"; Hit description= similar to septin 10 isoform 1 [Rattus norvegicus]
  misc_feature (2)..(2): Xaa can be any naturally occurring amino acid
  misc_feature (46)..(46): Xaa can be any naturally occurring amino acid
  misc_feature (72)..(72): Xaa can be any naturally occurring amino acid
  misc_feature (95)..(95): Xaa can be any naturally occurring amino acid
  misc_feature (121)..(121): Xaa can be any naturally occurring amino acid
  misc_feature (127)..(127): Xaa can be any naturally occurring amino acid
KXSALNTRLFKTLCEDLESDHTTLPHHTEVRWLSKGNMLARLFDLXDEVITLEHQKQNELNMAFKKTLYPSXLAYLSDIFDSLNSLNLKLQGEDXRNIVVTHCDGGLVTQLWRRKISENPXKLFKFXTVEPISEETRFKDIFMKDQILKIQISNHLESIIEEFQKYFPNICDNFIYRMSTDPFHVNIDSLPESLQEDALQINPNDFLHDSSAKYFVIMDKPSFWLKYFKVYLSVSREALHLYLPFSTLLAIKTKYRNKLDVASDLCCALTKTQPRIGILVNKMQAHPSH

SEQ ID NO: 28351 - protein, 63 aa, Diabrotica virgifera
  misc_feature: Coding regions on vcDNA: vcDNA=SeqID_8048; Strand=-; Position=10-201
RVPSSMARIDNYLDVPSGTLLSVIRSHNLTCMDCMSIKCIRTYASPTHLVFGRRPENRIYILL

SEQ ID NO: 28352 - protein, 291 aa, Diabrotica virgifera
  misc_feature: Coding regions on vcDNA: vcDNA=SeqID_8049; Strand=+; Position=3-876
  misc_feature: Homolog annotation: Hit_ID=EAL25753.1; Match level="QueryCoverage =99%, HitCoverage=40%, E-value=2e-72, Identity=47%"; Hit description =GA17600-PA [Drosophila pseudoobscura]
  misc_feature: Pfam annotation: Pfam_ID=Transferrin; Match level="Score=-194.0, E -value=0.0044, Copies=1"; Pfam description=Transferrin
  misc_feature (20)..(20): Xaa can be any naturally occurring amino acid
  misc_feature (61)..(61): Xaa can be any naturally occurring amino acid
  misc_feature (74)..(74): Xaa can be any naturally occurring amino acid
  misc_feature (138)..(138): Xaa can be any naturally occurring amino acid
  misc_feature (165)..(165): Xaa can be any naturally occurring amino acid
  misc_feature (274)..(274): Xaa can be any naturally occurring amino acid
RVVAPDRTDRLRQILKGKAXFRYFSPEDLVAANNRRSTNSKSQMELENIVNTPFDYEVVAXVVDKKSGIKSRHXDLRERITRHPGHGYETDWTKILANFFEASVTTPSCDPLLSLSENRVKATSDFFGAACKGGPWVXDPILDIQLKRKYTNLCDLCGDPEKCSXDDKYWGRRGSLYCLTDGAGDISWARLDDVRPHFGLVPGSPEASADGYYFLCPNDSIMPLNSTNPCVWVVKPWPVVATRRTVADDIQKIVSPLSHSDRISWRYSLLMLLXTAYTTFYKLANIDPYRD

SEQ ID NO: 28353 - protein, 213 aa, Diabrotica virgifera
  misc_feature: Coding regions on vcDNA: vcDNA=SeqID_8050; Strand=+; Position=180-821
  misc_feature: Homolog annotation: Hit_ID=XP_397278.1; Match level="QueryCoverage =60%, HitCoverage=9%, E-value=9e-16, Identity=38%"; Hit description =similar to ENSANGP00000018654 [Apis mellifera]
  misc_feature: Pfam annotation: Pfam_ID=fn3; Match level="Score=32.0, E-value=1.8e -06, Copies=1"; Pfam description=Fibronectin type III domain
IVTPSNVTNSSITVTWSPPDKLNGPLNAYYIHYNKGVQKVDAINKTHNKEILTGLESYTKYVIYMRACTGSICSENSKNETVVTKMGVPAKIPRPYSNGNDENIIRWDRPDPPRGDINYYQLSITRDGNAQNYTIENCREAGLHTFFFAVRAVNIIDGEHVMAPWSDTSKIYCYRSSWYIFIYVFLGICGMVLIGYGLKRLYMCLDIARHVEI

SEQ ID NO: 28354 - protein, 54 aa, Diabrotica virgifera
  misc_feature: Coding regions on vcDNA: vcDNA=SeqID_8051; Strand=+; Position=133-297
PKSSKVGNDLTSQKLSTRAMEDGTRHIDNHSGDLDREITRMEKALLTTLSTQLP

SEQ ID NO: 28355 - protein, 55 aa, Diabrotica virgifera
  misc_feature: Coding regions on vcDNA: vcDNA=SeqID_8052; Strand=+; Position=396-563
LCLDVCCYCLLMEKMFDDFCHIMNSNNIFIYKSLYFYCEENKAIMTYYLLMFENI

SEQ ID NO: 28356 - protein, 120 aa, Diabrotica virgifera
  misc_feature: Coding regions on vcDNA: vcDNA=SeqID_8053; Strand=-; Position=49-411
ALFRISSDVRRHSYISSLTVYQQCHQVHRAQSCKPLQEKSFVSLTLSAAIDSKQLLVSNRSQILQGSRPGFLYTWNRVHGQSGITDIPPHHAVLHFQFCYLILHRLHNRKVTCSSQFFRV

SEQ ID NO: 28357 - protein, 76 aa, Diabrotica virgifera
  misc_feature: Coding regions on vcDNA: vcDNA=SeqID_8054; Strand=-; Position=2-229
QCGGVVDRSWVVCICRYAVLGNLVLRLAIHRQLFNSTAAYSRYESVQMLSGYRGYVVSSSGGLQPAGGGAGPGIPA

SEQ ID NO: 28358 - protein, 27 aa, Diabrotica virgifera
  misc_feature: Coding regions on vcDNA: vcDNA=SeqID_8055; Strand=-; Position=18-101
WMSICPMIPGFDFTLVSIYLDIEFVNV

SEQ ID NO: 28359 - protein, 24 aa, Diabrotica virgifera
  misc_feature: Coding regions on vcDNA: vcDNA=SeqID_8056; Strand=-; Position=1-72
  misc_feature (7)..(7): Xaa can be any naturally occurring amino acid
TLTLNEXGRVGDPESGPDCRRPAS

SEQ ID NO: 28360 - protein, 85 aa, Diabrotica virgifera
  misc_feature: Coding regions on vcDNA: vcDNA=SeqID_8057; Strand=+; Position=551-808
  misc_feature (75)..(75): Xaa can be any naturally occurring amino acid
LYGRLSFHLLRGRPITATVRFISYYFDYTGLLRSTYVRIPFFLSVSFRLRNRRKCNVHCTLHFLLMSSLHCRSLXHNRGLIFRVI

SEQ ID NO: 28361 - protein, 108 aa, Diabrotica virgifera
  misc_feature: Coding regions on vcDNA: vcDNA=SeqID_8058; Strand=+; Position=128-454
TTCYILSHLIVNPNGTPTLTIYKTVCAELVVTFVLNRLDNWLPLWSHDDKRCSKIKNTEGVFYQDLTNDRLIFRFINSMASSYKISPIDECLFCALSHTVQSGTTFSC

SEQ ID NO: 28362 - protein, 252 aa, Diabrotica virgifera
  misc_feature: Coding regions on vcDNA: vcDNA=SeqID_8059; Strand=-; Position=2-757
  misc_feature (1)..(173): Xaa can be any naturally occurring amino acid
  misc_feature (177)..(200): Xaa can be any naturally occurring amino acid
  misc_feature (202)..(213): Xaa can be any naturally occurring amino acid
  misc_feature (231)..(238): Xaa can be any naturally occurring amino acid
  misc_feature (244)..(250): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFIXXXXXXXXXXXXXXXXXXXXXXXXEXXXXXXXXXXXXTRRYEKVKFFLLRKEKEXXXXXXXXTIVSEXXXXXXXKK

SEQ ID NO: 28363 - protein, 267 aa, Diabrotica virgifera
  misc_feature: Coding regions on vcDNA: vcDNA=SeqID_8060; Strand=-; Position=2-805
  misc_feature (1)..(63): Xaa can be any naturally occurring amino acid
  misc_feature (67)..(74): Xaa can be any naturally occurring amino acid
  misc_feature (82)..(240): Xaa can be any naturally occurring amino acid
  misc_feature (246)..(255): Xaa can be any naturally occurring amino acid
XXXXXXXXXXXXXXXXXXXXXXXXXXXXXXXXXXXXXXXXXXXXXXXXXXXXXXXXXXXXXXXNKSXXXXXXXXYKRHVLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLIHEVXXXXXXXXXXERDSLRILINYR

SEQ ID NO: 28364 - protein, 30 aa, Diabrotica virgifera
  misc_feature: Coding regions on vcDNA: vcDNA=SeqID_8061; Strand=-; Position=0-89
YQLNRPIKEKIEIISREMYGAAGVSYSEIA

SEQ ID NO: 28365 - protein, 136 aa, Diabrotica virgifera
  misc_feature: Coding regions on vcDNA: vcDNA=SeqID_8062; Strand=+; Position=56-466
  misc_feature: Homolog annotation: Hit_ID=NP_731589.1; Match level="QueryCoverage =93%, HitCoverage=96%, E-value=3e-34, Identity=58%"; Hit description =CG31305-PI, isoform I [Drosophila melanogaster] gb|AAN13512.1| CG31305-PI, isoform I [Drosophila
  misc_feature: Gene Ontology Annotation: Molecular function=lipid binding; Cellular component=cytoplasm; Biological process=lipid binding
  misc_feature: Pfam annotation: Pfam_ID=Lipocalin; Match level="Score=96.0, E-value =9.9e-26, Copies=1"; Pfam description=Lipocalin / cytosolic fatty -acid bind
MTLTELLGKKYKLDKSENFDEYMKKLGVGLVTRKMGATVSPVVDLQKEGDEYILSSISTFKNVILKFKPGVEFDQETPDGRKVKSTITIDGNTLHEVQKNPSGTETVIDRTFSADEIKMEMSVNNVKATRIYKIQV

SEQ ID NO: 28366 - protein, 215 aa, Diabrotica virgifera
  misc_feature: Coding regions on vcDNA: vcDNA=SeqID_8063; Strand=+; Position=187-834
SHFDKSFVDLSCNSNVSTPKCIKNNSDSRLNLSYYSPVSPLYSEHSFNNSKGKKHTVCLGDFVITNVMKPTKKKTPLKKGNDDFNKRITPTSINNIPTNEAFKSSNSFNEFNTKAVGCDNVNTSRMNLAKERLKFLTRNDSDDRSAWVSSRKIILPDQREQIEPQLDLITYKNELTILSDIYILILKNNMVLNITGEIYFLTSLLVSKQYISESV

SEQ ID NO: 28367 - protein, 23 aa, Diabrotica virgifera
  misc_feature: Coding regions on vcDNA: vcDNA=SeqID_8064; Strand=+; Position=1-69
CSTVRIRVDTRRSRLQQHTSDKS

SEQ ID NO: 28368 - protein, 57 aa, Diabrotica virgifera
  misc_feature: Coding regions on vcDNA: vcDNA=SeqID_8065; Strand=+; Position=397-570
IESKPLLLILLQIYHFYLFVLEYSLSLKHFEIADRDVTTRFILADCFAFLIHDFLLL

SEQ ID NO: 28369 - protein, 214 aa, Diabrotica virgifera
  misc_feature: Coding regions on vcDNA: vcDNA=SeqID_8066; Strand=-; Position=216-860
  misc_feature (3)..(159): Xaa can be any naturally occurring amino acid
  misc_feature (163)..(168): Xaa can be any naturally occurring amino acid
  misc_feature (170)..(199): Xaa can be any naturally occurring amino acid
LFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKLMXXXXXXMXXXXXXXXXXXXXXXXXXXXXXXXXXXXXXIEKDLIRNRLLKKEI

SEQ ID NO: 28370 - protein, 137 aa, Diabrotica virgifera
  misc_feature: Coding regions on vcDNA: vcDNA=SeqID_8067; Strand=+; Position=13-621
  misc_feature: Homolog annotation: Hit_ID=AAF87760.1; Match level="QueryCoverage =100%, HitCoverage=47%, E-value=2e-51, Identity=59%"; Hit description= cytochrome oxidase subunit I [Diabrotica virgifera zeae]
  misc_feature: Pfam annotation: Pfam_ID=COX1; Match level="Score=-210.2, E-value =0.00042, Copies=1"; Pfam description=Cytochrome C and Quinol oxidase polyp
  misc_feature (54)..(54): Xaa can be any naturally occurring amino acid
  misc_feature (89)..(89): Xaa can be any naturally occurring amino acid
AVVITAILLLLSLPVLAGAITILLTDRNLNTSFFDPAGIIYAIIAIGLLGFIVXAHHIFTVGMDVDTRAYFTSATIIIAVPTGIKVFRXLATYHGTTITYRLTGVVLANSSIDIVLHDTYYVVAIGAVFAIIAGFIQ

SEQ ID NO: 28371 - protein, 239 aa, Diabrotica virgifera
  misc_feature: Coding regions on vcDNA: vcDNA=SeqID_8068; Strand=-; Position=2-718
  misc_feature (29)..(63): Xaa can be any naturally occurring amino acid
  misc_feature (104)..(110): Xaa can be any naturally occurring amino acid
  misc_feature (114)..(122): Xaa can be any naturally occurring amino acid
  misc_feature (124)..(144): Xaa can be any naturally occurring amino acid
  misc_feature (146)..(238): Xaa can be any naturally occurring amino acid
GGGGGCGLFRGFVHALATPPARPPPPGGXXXXXXXXXXXXXXXXXXXXXXXXXXXXXXXXXXXPSTKKNLKEYFNAPVGGGERNKKRKEETKFCLCVCGGGGRXXXXXXXSHPXXXXXXXXXGXXXXXXXXXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXP

SEQ ID NO: 28372 - protein, 51 aa, Diabrotica virgifera
  misc_feature: Coding regions on vcDNA: vcDNA=SeqID_8069; Strand=-; Position=1-153
  misc_feature (7)..(48): Xaa can be any naturally occurring amino acid
NQKNGSXXXXXXXXXXXXXXXXXXXXXXXXXXXXXXXXXXXXXXXXXXENE

SEQ ID NO: 28373 - protein, 66 aa, Diabrotica virgifera
  misc_feature: Coding regions on vcDNA: vcDNA=SeqID_8070; Strand=-; Position=2-199
  misc_feature (2)..(13): Xaa can be any naturally occurring amino acid
  misc_feature (23)..(30): Xaa can be any naturally occurring amino acid
  misc_feature (33)..(40): Xaa can be any naturally occurring amino acid
  misc_feature (45)..(45): Xaa can be any naturally occurring amino acid
  misc_feature (52)..(65): Xaa can be any naturally occurring amino acid
LXXXXXXXXXXXXPTLAHTGLNXXXXXXXXSNXXXXXXXXPIINXNPTSRSXXXXXXXXXXXXXXV

SEQ ID NO: 28374 - protein, 202 aa, Diabrotica virgifera
  misc_feature: Coding regions on vcDNA: vcDNA=SeqID_8071; Strand=+; Position=46-820
  misc_feature: Homolog annotation: Hit_ID=AAF87760.1; Match level="QueryCoverage =100%, HitCoverage=62%, E-value=4e-75, Identity=61%"; Hit description= cytochrome oxidase subunit I [Diabrotica virgifera zeae]
  misc_feature: Pfam annotation: Pfam_ID=COX1; Match level="Score=-189.7, E-value =8.4e-05, Copies=1"; Pfam description=Cytochrome C and Quinol oxidase polyp
  misc_feature (34)..(34): Xaa can be any naturally occurring amino acid
  misc_feature (69)..(69): Xaa can be any naturally occurring amino acid
  misc_feature (105)..(111): Xaa can be any naturally occurring amino acid
  misc_feature (125)..(125): Xaa can be any naturally occurring amino acid
  misc_feature (149)..(149): Xaa can be any naturally occurring amino acid
  misc_feature (184)..(184): Xaa can be any naturally occurring amino acid
HPEGFGLISHIVRFGTLGIIYAIIAIGLLGFIVXAHHIFTVGMDVDTRAYFTSATIIIAVPTGIKVFRXLATYHGTTITYRLTGVVLANSSIDIVLHDTYYVVAXXXXXXXIGAVFAIIAGFIQXFPLFTGLIGIPRRYSDYPDVFILXNIVSSIGSLISLIGKLFLFQRKRLRPLRITSSIEXLQFYPPAEHRYSELPILS

SEQ ID NO: 28375 - protein, 66 aa, Diabrotica virgifera; identical to SEQ ID NO: 26808
  misc_feature: Coding regions on vcDNA: vcDNA=SeqID_8072; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28376 - protein, 35 aa, Diabrotica virgifera
  misc_feature: Coding regions on vcDNA: vcDNA=SeqID_8073; Strand=-; Position=2-106
  misc_feature (2)..(2): Xaa can be any naturally occurring amino acid
  misc_feature (25)..(25): Xaa can be any naturally occurring amino acid
  misc_feature (27)..(35): Xaa can be any naturally occurring amino acid
SXHRGSAIFIYRFELSNIKLRCYPXRXXXXXXXXX

SEQ ID NO: 28377 - protein, 166 aa, Diabrotica virgifera
  misc_feature: Coding regions on vcDNA: vcDNA=SeqID_8074; Strand=-; Position=0-497
  misc_feature (1)..(15): Xaa can be any naturally occurring amino acid
  misc_feature (17)..(49): Xaa can be any naturally occurring amino acid
  misc_feature (55)..(79): Xaa can be any naturally occurring amino acid
  misc_feature (84)..(101): Xaa can be any naturally occurring amino acid
  misc_feature (111)..(146): Xaa can be any naturally occurring amino acid
  misc_feature (151)..(165): Xaa can be any naturally occurring amino acid
XXXXXXXXXXXXXXXRXXXXXXXXXXXXXXXXXXXXXXXXXXXXXXXXXGGRPPXXXXXXXXXXXXXXXXXXXXXXXXXGGGGXXXXXXXXXXXXXXXXXXPPRPAAGRRXXXXXXXXXXXXXXXXXXXXXXXXXXXXXXXXXXXXGEGKXXXXXXXXXXXXXXXS

SEQ ID NO: 28378 - protein, 100 aa, Diabrotica virgifera
  misc_feature: Coding regions on vcDNA: vcDNA=SeqID_8075; Strand=+; Position=3-305
  misc_feature (1)..(14): Xaa can be any naturally occurring amino acid
  misc_feature (17)..(26): Xaa can be any naturally occurring amino acid
  misc_feature (40)..(50): Xaa can be any naturally occurring amino acid
  misc_feature (57)..(66): Xaa can be any naturally occurring amino acid
XXXXXXXXXXXXXXVGXXXXXXXXXXTHVNWRGLNFFPNXXXXXXXXXXXTPYIAPXXXXXXXXXXKGKTTGPHNKTPSPPESWTKNSKKRSIGRKMKES

SEQ ID NO: 28379 - protein, 101 aa, Diabrotica virgifera
  misc_feature: Coding regions on vcDNA: vcDNA=SeqID_8076; Strand=-; Position=21-326
INKYLSTCEKSTIIKVVYTGGNDDETVNVFSNLKEKKREPKRKKKFDEFDFQLDFIGVSFELAEPVLNEGRPTKRGNITDATTIPFIPRYIGATSSYEDLI

SEQ ID NO: 28380 - protein, 80 aa, Diabrotica virgifera
  misc_feature: Coding regions on vcDNA: vcDNA=SeqID_8077; Strand=+; Position=2-244
SAIYHIPSQERLFSRGFRLAKKSGFGNISLNLVLVTFQLSYLTIPLLAPTSTIPCLLTDTSFDLQVNDFRAFITLWLSEI

SEQ ID NO: 28381 - protein, 234 aa, Diabrotica virgifera
  misc_feature: Coding regions on vcDNA: vcDNA=SeqID_8078; Strand=+; Position=210-912
  misc_feature: Homolog annotation: Hit_ID=NP_729892.1; Match level="QueryCoverage =26%, HitCoverage=9%, E-value=1e-15, Identity=63%"; Hit description =CG32121-PA [Drosophila melanogaster] gb|AAN11836.1| CG32121-PA [Drosophila melanogaster]
  misc_feature: Gene Ontology Annotation: Molecular function=transcription factor activity; Cellular component=nucleus; Biological process=behavior
  misc_feature: Pfam annotation: Pfam_ID=zf-C2H2; Match level="Score=30.3, E-value =5.9e-06, Copies=2"; Pfam description=Zinc finger, C2H2 type
  misc_feature (205)..(205): Xaa can be any naturally occurring amino acid
MKSAHPVVILHNVSFEEVKAILSFMYRGQCVVSQDQLPSLLSVAKLLKVQGLCDMKVPENRPRPEGLSKNEPLQSSDKLINDDNFHRYEYDCKLRPADRLTENILSKRHYDDDTPKNEYSNIHHNFKSLNYYDDNVLPLTKDSTEPIPLKYEEPYLFPRKCPSKDSSETCKCFLCGKYLSNQYNLRVHMETHEEAYHACQSCPHXVSRSRDALRKHVSYRHPEEYHQKRRKTDT

SEQ ID NO: 28382 - protein, 114 aa, Diabrotica virgifera
  misc_feature: Coding regions on vcDNA: vcDNA=SeqID_8079; Strand=-; Position=388-732
IRDFDDSSSIYSTYDDINVSLLHYNNYISLLFVNLVLSHFFLHIKISLLDNFLAAPGSALNDLPRSRKIHRLVTFIDHLETVNDPLLYLTAIKITLSLLLCGVPTFNKYFNIGT

SEQ ID NO: 28383 - protein, 241 aa, Diabrotica virgifera
  misc_feature: Coding regions on vcDNA: vcDNA=SeqID_8080; Strand=-; Position=129-852
  misc_feature: Homolog annotation: Hit_ID=S27163; Match level="QueryCoverage=98%, HitCoverage=42%, E-value=2e-63, Identity=47%"; Hit description =alpha,alpha-trehalase (EC 3.2.1.28) - yellow mealworm dbj|BAA01951.1| trehalase precursor
  misc_feature: Gene Ontology Annotation: Molecular function=alpha,alpha-trehalase activity; Cellular component=extrinsic to plasma membrane, GPI -anchored; Biological process=trehalose catabolism
  misc_feature: Pfam annotation: Pfam_ID=Trehalase; Match level="Score=-111.3, E -value=1.1e-12, Copies=1"; Pfam description=Trehalase
  misc_feature (6)..(6): Xaa can be any naturally occurring amino acid
  misc_feature (11)..(11): Xaa can be any naturally occurring amino acid
SGWDFXSRWIXNSSGGIGVNLTDIHTSDILPVDLNAFICGAFDQLSKFYTLVGNKTKSTEYKLKVDKWRIAIDKIFYHKHDGIWYDVDAKVGRYRAGFYPSSLAPLWAKCFAPARADYYGSRAADYLNRNKVSNFLGGVPTSLIQSGQQWDLPNAWPPLQEMFVLGLDETKNKKAKILANLFSNRILRAFMAGMNTTNEMFEKYDAISVGQYGGGGEYTVQSGFGWTNGVAFSLIQRDYIR

SEQ ID NO: 28384 - protein, 222 aa, Diabrotica virgifera
  misc_feature: Coding regions on vcDNA: vcDNA=SeqID_8081; Strand=-; Position=2-670
  misc_feature: Homolog annotation: Hit_ID=XP_307144.1; Match level="QueryCoverage =99%, HitCoverage=60%, E-value=7e-32, Identity=37%"; Hit description =ENSANGP00000024852 [Anopheles gambiae]
  misc_feature (36)..(36): Xaa can be any naturally occurring amino acid
  misc_feature (52)..(52): Xaa can be any naturally occurring amino acid
  misc_feature (94)..(94): Xaa can be any naturally occurring amino acid
  misc_feature (151)..(151): Xaa can be any naturally occurring amino acid
MLFIDFKQAYDSISRNGLYEAMRALGILENLTRLVXMTLTNTVNKVMIEGSXSNQFNVNRGLKQGDPLSTDLFNLVLEKIIRGANIQTIGTILXEDNSVGMGFADDLVFLTRSRTKLQKMFKQFEEEAKKYGLTINQGKTKYMEMRNEMRXAEENKWITLRTNDKDYKFEKVTEFEYLGVSVTNRGNEEREIDKPLLKGSKAVGSLNALLKAKNVSRAAKIR

SEQ ID NO: 28385 - protein, 56 aa, Diabrotica virgifera
  misc_feature: Coding regions on vcDNA: vcDNA=SeqID_8082; Strand=+; Position=78-245
  misc_feature (9)..(9): Xaa can be any naturally occurring amino acid
  misc_feature (34)..(42): Xaa can be any naturally occurring amino acid
  misc_feature (46)..(55): Xaa can be any naturally occurring amino acid
LGVAVILNXSLVDFLKFYMDLSFKPWGGPVWVLXXXXXXXXXTKRXXXXXXXXXXG

SEQ ID NO: 28386 - protein, 253 aa, Diabrotica virgifera
  misc_feature: Coding regions on vcDNA: vcDNA=SeqID_8083; Strand=+; Position=1-759
  misc_feature (1)..(15): Xaa can be any naturally occurring amino acid
  misc_feature (18)..(220): Xaa can be any naturally occurring amino acid
  misc_feature (224)..(251): Xaa can be any naturally occurring amino acid
XXXXXXXXXXXXXXXYLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEWKXXXXXXXXXXXXXXXXXXXXXXXXXXXXRT

SEQ ID NO: 28387 - protein, 208 aa, Diabrotica virgifera
  misc_feature: Coding regions on vcDNA: vcDNA=SeqID_8084; Strand=-; Position=289-915
  misc_feature: Homolog annotation: Hit_ID=AAT40504.1; Match level="QueryCoverage =77%, HitCoverage=18%, E-value=8e-24, Identity=39%"; Hit description =putative polyprotein [Solanum demissum]
  misc_feature (6)..(6): Xaa can be any naturally occurring amino acid
  misc_feature (22)..(22): Xaa can be any naturally occurring amino acid
  misc_feature (36)..(36): Xaa can be any naturally occurring amino acid
  misc_feature (75)..(75): Xaa can be any naturally occurring amino acid
MRPLHXVEDFKYLGSIMNGQGXIDPEINSRVMSATXLYYALNKSFIRKKEVSLKTKMKVFQTVYEPVLLYGSETXTVNDNIRSKIQACEMRYLLAVSGVTRRDRIRNEDIRERCGVGRTLDRLEKKQLSWFGHMARMSEGRTVKRVWKAASDNKRRRGRPARERKYWKGLRKKKYWVERSRKTSYWPKVMETSDFSTYLDTVRYKRTA

SEQ ID NO: 28388 - protein, 64 aa, Diabrotica virgifera
  misc_feature: Coding regions on vcDNA: vcDNA=SeqID_8085; Strand=-; Position=15-209
  misc_feature (3)..(14): Xaa can be any naturally occurring amino acid
  misc_feature (24)..(31): Xaa can be any naturally occurring amino acid
  misc_feature (45)..(45): Xaa can be any naturally occurring amino acid
SLXXXXXXXXXXXXPTWALHRFKXXXXXXXXSTRLNIILLLHQLXTFNPNIEVRHLYYRLTFSN

SEQ ID NO: 28389 - protein, 209 aa, Diabrotica virgifera
  misc_feature: Coding regions on vcDNA: vcDNA=SeqID_8086; Strand=+; Position=202-825
  misc_feature: Homolog annotation: Hit_ID=XP_395780.1; Match level="QueryCoverage =89%, HitCoverage=50%, E-value=3e-22, Identity=34%"; Hit description =similar to CG1697-PB [Apis mellifera]
  misc_feature: Pfam annotation: Pfam_ID=efhand; Match level="Score=54.0, E-value =4.4e-13, Copies=2"; Pfam description=EF hand
  misc_feature (187)..(187): Xaa can be any naturally occurring amino acid
  misc_feature (189)..(189): Xaa can be any naturally occurring amino acid
  misc_feature (194)..(194): Xaa can be any naturally occurring amino acid
  misc_feature (199)..(199): Xaa can be any naturally occurring amino acid
MARNDPENIPMDDVGYIDSRKRQIFEQCDTDGDGYITLDELAKFISDNETSCACINPRAIKKIYQNADKDKDHKLSFQEFVDFVESEAFQSLVNRCITTYIHHLIPHPKQAVSLRAARSGGRRGSQGDLCDEYSCFPPPVFMLLISILEFALFITDELTQEGSSLTATGVTGRYLLYDPDKKKEVWXRXVTYMXVHIGXHHIIRNLVVH

SEQ ID NO: 28390 - protein, 34 aa, Diabrotica virgifera
  misc_feature: Coding regions on vcDNA: vcDNA=SeqID_8087; Strand=-; Position=2-103
  misc_feature (13)..(13): Xaa can be any naturally occurring amino acid
  misc_feature (15)..(33): Xaa can be any naturally occurring amino acid
NYAVSPKVIISIXQXXXXXXXXXXXXXXXXXXXF

SEQ ID NO: 28391 - protein, 260 aa, Diabrotica virgifera
  misc_feature: Coding regions on vcDNA: vcDNA=SeqID_8088; Strand=+; Position=36-812
  misc_feature: Homolog annotation: Hit_ID=XP_394701.1; Match level="QueryCoverage =69%, HitCoverage=27%, E-value=5e-57, Identity=63%"; Hit description =similar to CG32697-PA [Apis mellifera]
  misc_feature: Gene Ontology Annotation: Molecular function=transmembrane receptor protein tyrosine phosphatase activity; Cellular component=integral to plasma membrane; Biological process=cell adhesion
  misc_feature: Pfam annotation: Pfam_ID=Y_phosphatase; Match level="Score=14.2, E -value=2.1e-08, Copies=1"; Pfam description=Protein-tyrosine phosphatase
  misc_feature (175)..(175): Xaa can be any naturally occurring amino acid
  misc_feature (200)..(200): Xaa can be any naturally occurring amino acid
  misc_feature (221)..(221): Xaa can be any naturally occurring amino acid
  misc_feature (233)..(233): Xaa can be any naturally occurring amino acid
MKLFVIGLKILNIIDVGLQLVTANLRMVFHVLSIPLFYLTDGKTPSPQKRTSAPSDIDISGSGNGVDSWAEEANLNPPSSASSGFSDDDSLHGDGAALTAMQLVDYVRDRGRSGLMQEYAEIRSRPPDGTFNIAKSKSNLPKNRYTDVLCYDHSRVILTELDNDKDSDYIHANFXVDGYKQKNAFINTQGPLSKTTPDFXWRMIWEQHTLVIVMTTRAMEXRGRPKCHQYWEXLKGWLGNNMGSVWGVKNGVYKDKLYLY

SEQ ID NO: 28392 - protein, 111 aa, Diabrotica virgifera
  misc_feature: Coding regions on vcDNA: vcDNA=SeqID_8089; Strand=-; Position=1-333
  misc_feature (4)..(17): Xaa can be any naturally occurring amino acid
  misc_feature (25)..(31): Xaa can be any naturally occurring amino acid
  misc_feature (76)..(87): Xaa can be any naturally occurring amino acid
  misc_feature (90)..(110): Xaa can be any naturally occurring amino acid
PLLXXXXXXXXXXXXXXGPPRVKLXXXXXXXSTRLNNKLYTNITLIQPRGPILYRLTLHKKYAVSLGNYLISKNGXXXXXXXXXXXXLNXXXXXXXXXXXXXXXXXXXXXL

SEQ ID NO: 28393 - protein, 223 aa, Diabrotica virgifera
  misc_feature: Coding regions on vcDNA: vcDNA=SeqID_8090; Strand=+; Position=137-808
  misc_feature: Pfam annotation: Pfam_ID=CDI; Match level="Score=22.7, E-value =0.0007, Copies=1"; Pfam description=Cyclin-dependent kinase inhibitor
  misc_feature (181)..(209): Xaa can be any naturally occurring amino acid
RRYAKSFVPEISEIRQYLCEFGCITSNVNKTQNMYYKPIELVSSKITPHFCRPEIRKVKRVLFEPVDHIATQRFVEEELEKVRVTKSEKWNFDFQHERSLSPSGDYQWKPATPVKKQPLSLKHAIIEFEGQDLYPVPGDIIRPIPIMLSSTPRKEVTSPRKTHPRTHHSVLYPTYHHGIQXXXXXXXXXXXXXXXXXXXXXXXXXXXXXLGNRDQHAILRQRK

SEQ ID NO: 28394 - protein, 75 aa, Diabrotica virgifera
  misc_feature: Coding regions on vcDNA: vcDNA=SeqID_8091; Strand=-; Position=2-226
  misc_feature (1)..(9): Xaa can be any naturally occurring amino acid
  misc_feature (12)..(20): Xaa can be any naturally occurring amino acid
  misc_feature (32)..(39): Xaa can be any naturally occurring amino acid
  misc_feature (42)..(55): Xaa can be any naturally occurring amino acid
  misc_feature (61)..(74): Xaa can be any naturally occurring amino acid
XXXXXXXXXVLXXXXXXXXXIETNRAHTGLNXXXXXXXXSNXXXXXXXXXXXXXXPTSRSXXXXXXXXXXXXXXV

SEQ ID NO: 28395 - protein, 57 aa, Diabrotica virgifera
  misc_feature: Coding regions on vcDNA: vcDNA=SeqID_8092; Strand=+; Position=393-566
MRMKVKLLLVREMLVHYIYIRILLLSIKLLLHYRSRHCCSVMQSPLVLESGIYRQNP

SEQ ID NO: 28396 - protein, 242 aa, Diabrotica virgifera
  misc_feature: Coding regions on vcDNA: vcDNA=SeqID_8093; Strand=+; Position=59-787
  misc_feature: Homolog annotation: Hit_ID=XP_392002.1; Match level="QueryCoverage =97%, HitCoverage=42%, E-value=8e-51, Identity=43%"; Hit description =similar to ENSANGP00000024998 [Apis mellifera]
MLQLVLVLAALAVLFYYFAVKPMSYWKERGIKQTKPVWLLGDSWGTVIKKHSLVDFVQYIYDQVPSVRYFGCYQMVTPTLVIRDPDLIKNIAVKDFDHFMDHRQMIPANADPLFGKNLFALKGQVWRDTRPILSPTFTSSKMRAMFVLMSECGENFIKYFQNNNKDIIEMEMKDTFRRFTNDVIATTAFGVKTDSLKDRDNEFFTMGTRAVDFGFWRSLKFFGYFLIPKILAFFKVSIFGKD

SEQ ID NO: 28397 - protein, 47 aa, Diabrotica virgifera
  misc_feature: Coding regions on vcDNA: vcDNA=SeqID_8094; Strand=-; Position=2-142
  misc_feature (1)..(16): Xaa can be any naturally occurring amino acid
  misc_feature (20)..(20): Xaa can be any naturally occurring amino acid
  misc_feature (24)..(24): Xaa can be any naturally occurring amino acid
  misc_feature (26)..(26): Xaa can be any naturally occurring amino acid
  misc_feature (28)..(28): Xaa can be any naturally occurring amino acid
  misc_feature (30)..(42): Xaa can be any naturally occurring amino acid
  misc_feature (44)..(44): Xaa can be any naturally occurring amino acid
XXXXXXXXXXXXXXXXKKNXKLLXLXNXNXXXXXXXXXXXXXPXTFQ

SEQ ID NO: 28398 - protein, 243 aa, Diabrotica virgifera
  misc_feature: Coding regions on vcDNA: vcDNA=SeqID_8095; Strand=+; Position=1-731
  misc_feature: Homolog annotation: Hit_ID=XP_394723.1; Match level="QueryCoverage =97%, HitCoverage=33%, E-value=1e-106, Identity=79%"; Hit description= similar to ENSANGP00000015773 [Apis mellifera]
  misc_feature: Gene Ontology Annotation: Molecular function=RNA helicase activity; Cellular component=nucleus; Biological process=cell growth
  misc_feature: Pfam annotation: Pfam_ID=Helicase_C; Match level="Score=121.3, E -value=2.3e-33, Copies=1"; Pfam description=Helicase conserved C -terminal domain
  misc_feature (8)..(8): Xaa can be any naturally occurring amino acid
TYLVLDEXRMLDMGFEPQIRKIIQQIRPDRQVLMWSATWPKQVQQLAEEFLENYIQVNVGGLSLSANHNIKQIVEVCDELEKEEKLIRYLKEFGSDRQNKIIIFVETKKKVDDITKVVKREGFSAISMHGDKSQPERDYVLNEFRSGKSSILVATDVAARGLDVEDVKYVINYDYPNSSEDYVHRIGRTGRCQQAGTAYAFFTPNNQRQAKDLIAVLEEAGQVVNPQLLDLAQQAKSTNPKQK

SEQ ID NO: 28399 - protein, 76 aa, Diabrotica virgifera
  misc_feature: Coding regions on vcDNA: vcDNA=SeqID_8096; Strand=-; Position=2-229
  misc_feature (4)..(10): Xaa can be any naturally occurring amino acid
  misc_feature (13)..(23): Xaa can be any naturally occurring amino acid
  misc_feature (32)..(40): Xaa can be any naturally occurring amino acid
  misc_feature (43)..(56): Xaa can be any naturally occurring amino acid
  misc_feature (62)..(75): Xaa can be any naturally occurring amino acid
LNIXXXXXXXPFXXXXXXXXXXXTNLGSTGLXXXXXXXXXSNXXXXXXXXXXXXXXPTSRSXXXXXXXXXXXXXXV

SEQ ID NO: 28400 - protein, 45 aa, Diabrotica virgifera
  misc_feature: Coding regions on vcDNA: vcDNA=SeqID_8097; Strand=-; Position=168-305
LQVSLGCSTTFQGFGLWDAAKSRMCVQLTVINNWSPSSLRCVFET

SEQ ID NO: 28401 - protein, 21 aa, Diabrotica virgifera
  misc_feature: Coding regions on vcDNA: vcDNA=SeqID_8098; Strand=-; Position=1-63
YILVINIQLININIIVTSKSK

SEQ ID NO: 28402 - protein, 95 aa, Diabrotica virgifera
  misc_feature: Coding regions on vcDNA: vcDNA=SeqID_8099; Strand=-; Position=257-544
  misc_feature (25)..(35): Xaa can be any naturally occurring amino acid
TLFLGGKGALRSLVIQISIGVKLVXXXXXXXXXXXLSLSSLNIVGTALHFNFLLPSCLTFFHMSEVVFLNIQKLNTIFFNDINIIKRMHQMQIFN

SEQ ID NO: 28403 - protein, 132 aa, Diabrotica virgifera
  misc_feature: Coding regions on vcDNA: vcDNA=SeqID_8100; Strand=+; Position=179-574
  misc_feature (6)..(11): Xaa can be any naturally occurring amino acid
  misc_feature (23)..(37): Xaa can be any naturally occurring amino acid
  misc_feature (43)..(53): Xaa can be any naturally occurring amino acid
  misc_feature (109)..(128): Xaa can be any naturally occurring amino acid
KYYKMXXXXXXVYIQNLFQWGWXXXXXXXXXXXXXXXTNFFEXXXXXXXXXXXLKGTRGNFYLGSFKSLKKNWDPPRGGYRFNIGGKKPFLYKSRLPYFIFFFNFVLIXXXXXXXXXXXXXXXXXXXXEGGP

SEQ ID NO: 28404 - protein, 83 aa, Diabrotica virgifera
  misc_feature: Coding regions on vcDNA: vcDNA=SeqID_8101; Strand=-; Position=2-253
  misc_feature (16)..(25): Xaa can be any naturally occurring amino acid
  misc_feature (38)..(83): Xaa can be any naturally occurring amino acid
LLPQFINLYPTIEVRXXXXXXXXXXKNYAVIPKGNLFXXXXXXXXXXXXXXXXXXXXXXXXXXXXXXXXXXXXXXXXXXXXXX

SEQ ID NO: 28405 - protein, 58 aa, Diabrotica virgifera
  misc_feature: Coding regions on vcDNA: vcDNA=SeqID_8102; Strand=+; Position=52-225
  misc_feature (42)..(55): Xaa can be any naturally occurring amino acid
IKIATLDVGIKVYNWGSSYFNKVCSTFKILPEFEFKPGGGPXXXXXXXXXXXXXXQRG

SEQ ID NO: 28406 - protein, 265 aa, Diabrotica virgifera
  misc_feature: Coding regions on vcDNA: vcDNA=SeqID_8103; Strand=-; Position=2-796
  misc_feature (9)..(21): Xaa can be any naturally occurring amino acid
  misc_feature (23)..(265): Xaa can be any naturally occurring amino acid
KNTAVSLKXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 28407 - protein, 166 aa, Diabrotica virgifera
  misc_feature: Coding regions on vcDNA: vcDNA=SeqID_8104; Strand=-; Position=1-498
  misc_feature (5)..(15): Xaa can be any naturally occurring amino acid
  misc_feature (18)..(166): Xaa can be any naturally occurring amino acid
SLFCXXXXXXXXXXXKNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 28408 - protein, 67 aa, Diabrotica virgifera
  misc_feature: Coding regions on vcDNA: vcDNA=SeqID_8105; Strand=-; Position=122-325
TLVPGHSLYRNPLKFHNLSIPVFSPNFRSQMTPVKPHNRANLHYIFRLAYAYKCHLRLMSQDKGAHM

SEQ ID NO: 28409 - protein, 188 aa, Diabrotica virgifera
  misc_feature: Coding regions on vcDNA: vcDNA=SeqID_8106; Strand=-; Position=0-563
  misc_feature (1)..(9): Xaa can be any naturally occurring amino acid
  misc_feature (18)..(29): Xaa can be any naturally occurring amino acid
  misc_feature (50)..(79): Xaa can be any naturally occurring amino acid
  misc_feature (84)..(135): Xaa can be any naturally occurring amino acid
  misc_feature (137)..(167): Xaa can be any naturally occurring amino acid
  misc_feature (170)..(187): Xaa can be any naturally occurring amino acid
XXXXXXXXXLWFVASDGXXXXXXXXXXXXSPLPPKIPKNKNKNRGKGLGXXXXXXXXXXXXXXXXXXXXXXXXXXXXXXSPPPXXXXXXXXXXXXXXXXXXXXXXXXXXXXXXXXXXXXXXXXXXXXXXXXXXXXRXXXXXXXXXXXXXXXXXXXXXXXXXXXXXXXLFXXXXXXXXXXXXXXXXXXS

SEQ ID NO: 28410 - protein, 229 aa, Diabrotica virgifera
  misc_feature: Coding regions on vcDNA: vcDNA=SeqID_8107; Strand=-; Position=335-1024
  misc_feature (1)..(6): Xaa can be any naturally occurring amino acid
  misc_feature (17)..(30): Xaa can be any naturally occurring amino acid
  misc_feature (36)..(49): Xaa can be any naturally occurring amino acid
  misc_feature (51)..(59): Xaa can be any naturally occurring amino acid
  misc_feature (62)..(78): Xaa can be any naturally occurring amino acid
  misc_feature (87)..(117): Xaa can be any naturally occurring amino acid
  misc_feature (127)..(138): Xaa can be any naturally occurring amino acid
  misc_feature (145)..(150): Xaa can be any naturally occurring amino acid
  misc_feature (160)..(179): Xaa can be any naturally occurring amino acid
  misc_feature (195)..(204): Xaa can be any naturally occurring amino acid
  misc_feature (217)..(224): Xaa can be any naturally occurring amino acid
XXXXXXCFGWWGGGERXXXXXXXXXXXXXXPPAPHXXXXXXXXXXXXXXSXXXXXXXXXGGXXXXXXXXXXXXXXXXXGGQQKTKLXXXXXXXXXXXXXXXXXXXXXXXXXXXXXXXAAGKTHTGVXXXXXXXXXXXXRWVKKHXXXXXXNFGGGGRGEXXXXXXXXXXXXXXXXXXXXHTPWWWVFLSPPPPRXXXXXXXXXXRGFFSSSREGVLXXXXXXXXFRRGV

SEQ ID NO: 28411 - protein, 71 aa, Diabrotica virgifera
  misc_feature: Coding regions on vcDNA: vcDNA=SeqID_8108; Strand=+; Position=675-890
  misc_feature (29)..(29): Xaa can be any naturally occurring amino acid
  misc_feature (34)..(39): Xaa can be any naturally occurring amino acid
PMWSFHSTLLFLTQLLMLYTLHLRRISIXSSSVXXXXXXDLIRRVFISATSSNIFVLSVSGRILPRWYYCP

SEQ ID NO: 28412 - protein, 27 aa, Diabrotica virgifera
  misc_feature: Coding regions on vcDNA: vcDNA=SeqID_8109; Strand=-; Position=1-81
  misc_feature (16)..(27): Xaa can be any naturally occurring amino acid
AIFISIRLSNRIALLXXXXXXXXXXXX

SEQ ID NO: 28413 - protein, 129 aa, Diabrotica virgifera
  misc_feature: Coding regions on vcDNA: vcDNA=SeqID_8110; Strand=+; Position=82-471
  misc_feature: Homolog annotation: Hit_ID=XP_397089.1; Match level="QueryCoverage =79%, HitCoverage=16%, E-value=4e-10, Identity=31%"; Hit description =similar to ENSANGP00000011801 [Apis mellifera]
EDTIRSVDKVVSEIRRIYNSLGCHYRIVILPACKIENSESLHISIQMYSNFKKEYVEVGNVCFYDTYVSKRLLFTYSFNKDKKYPKIIAGSLINVHKFLACTLENIASENNVNLNASLKKKFEEINNVC

SEQ ID NO: 28414 - protein, 71 aa, Diabrotica virgifera
  misc_feature: Coding regions on vcDNA: vcDNA=SeqID_8111; Strand=+; Position=17-232
HHPCANSPTRDFGIRSKDTLGDHLGFVLGHLVSASDCHFHYYTTFIFCIRLGTFILTIKFYSLSHIFCFNI

SEQ ID NO: 28415 - protein, 206 aa, Diabrotica virgifera
  misc_feature: Coding regions on vcDNA: vcDNA=SeqID_8112; Strand=+; Position=269-975
  misc_feature: Homolog annotation: Hit_ID=CAG32146.1; Match level="QueryCoverage =97%, HitCoverage=56%, E-value=1e-31, Identity=33%"; Hit description =hypothetical protein [Gallus gallus]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=118.6, E-value =1.5e-32, Copies=6"; Pfam description=Zinc finger, C2H2 type
  misc_feature (85)..(85): Xaa can be any naturally occurring amino acid
  misc_feature (141)..(141): Xaa can be any naturally occurring amino acid
  misc_feature (151)..(151): Xaa can be any naturally occurring amino acid
  misc_feature (155)..(155): Xaa can be any naturally occurring amino acid
MKMEDQKMEFDTSYPIEDDDDDDIIDIKRETDFVYSCNRCETIFLHKEDLDSHLKSHLKEEYNVSCEICQKKFSKLAHMNRHLRXQFKCEFCEKSFHRQEQLRNHMNGHSGLKPHICDICCKGFNQISNLRDHMLRHSGIXAHLCSTCGKXFASXGELGAHLRKHTGARPFVCQVCNHGFTTSSSLTKHKTISFWRETHTNVIPVK

SEQ ID NO: 28416 - protein, 81 aa, Diabrotica virgifera
  misc_feature: Coding regions on vcDNA: vcDNA=SeqID_8113; Strand=+; Position=570-815
SFCSNIFIIYRNKSIEVKWMYVVARQCLCFCIAKHLARILNVETKIVRSRYGTKVISLLRHIYFISLIMKAEFINNFVFLP

SEQ ID NO: 28417 - protein, 89 aa, Diabrotica virgifera
  misc_feature: Coding regions on vcDNA: vcDNA=SeqID_8114; Strand=-; Position=448-717
ILFLYILSYRIASRWDSHTNTLYSLSSLVIHRCTTKGRFKHRSRVFSCLSYRVDIPLSCSYPCVPYLSQMSNISIVIQLQDMCRTSIDY

SEQ ID NO: 28418 - protein, 83 aa, Diabrotica virgifera
  misc_feature: Coding regions on vcDNA: vcDNA=SeqID_8115; Strand=-; Position=751-1002
LGQAERPSTLLPQIILFYKTDVYYNVYVYIGCIHKCRQTQSETAQFVYILPKQELAASVRSLALSAARTIVTLIQGVAMVTVN

SEQ ID NO: 28419 - protein, 140 aa, Diabrotica virgifera
  misc_feature: Coding regions on vcDNA: vcDNA=SeqID_8116; Strand=+; Position=10-432
  misc_feature (88)..(94): Xaa can be any naturally occurring amino acid
MSEVVKDVGKIWDRLFDHRPFLNGEISLILQAFEQRRKDKEVDNLFKAIEEITEIKDTEIEKLKQAEKLTDKINDNLEEALRICDKFXXXXXXXKQSTPLEQSRNKRKLDWDKFMGGITTKYSEINSQFETEDIEKKLLI

SEQ ID NO: 28420 - protein, 155 aa, Diabrotica virgifera
  misc_feature: Coding regions on vcDNA: vcDNA=SeqID_8117; Strand=+; Position=374-841
  misc_feature: Homolog annotation: Hit_ID=NP_777225.1; Match level="QueryCoverage =88%, HitCoverage=23%, E-value=1e-16, Identity=31%"; Hit description =p97 protein [Bos taurus] dbj|BAA20065.1| bucentaur [Bos taurus]
  misc_feature (122)..(128): Xaa can be any naturally occurring amino acid
  misc_feature (139)..(139): Xaa can be any naturally occurring amino acid
MNKETVVNSITNRIRIGTWNIRTLLRAGKMEELANEMEKIEILALQEIRWKDQGSIVKNKYTVFYSGDTKQGHNGTAFLISSKLRDTVIDIKAICGRLSYVRIKNKQSNLTFINEYAPTENXXXXXXXDFYEKPEKIYXNIPKDDIFILLGDSMQ

SEQ ID NO: 28421 - protein, 58 aa, Diabrotica virgifera
  misc_feature: Coding regions on vcDNA: vcDNA=SeqID_8118; Strand=+; Position=10-183
  misc_feature (21)..(22): Xaa can be any naturally occurring amino acid
  misc_feature (35)..(41): Xaa can be any naturally occurring amino acid
  misc_feature (49)..(49): Xaa can be any naturally occurring amino acid
KTGPGRNESTIVKDKFPRLLXXLVNSLSEKMPNSXXXXXXXFTIYFPPXQLYIYCVWY

SEQ ID NO: 28422 - protein, 71 aa, Diabrotica virgifera
  misc_feature: Coding regions on vcDNA: vcDNA=SeqID_8119; Strand=-; Position=47-262
  misc_feature (5)..(24): Xaa can be any naturally occurring amino acid
  misc_feature (36)..(42): Xaa can be any naturally occurring amino acid
VPPFXXXXXXXXXXXXXXXXXXXXAPPPGFKTSDPXXXXXXXEPEFKKLSLLPPIINFYPNHRVGHLLLWI

SEQ ID NO: 28423 - protein, 297 aa, Diabrotica virgifera
  misc_feature: Coding regions on vcDNA: vcDNA=SeqID_8120; Strand=+; Position=2-892
  misc_feature: Homolog annotation: Hit_ID=XP_392015.1; Match level="QueryCoverage =93%, HitCoverage=36%, E-value=4e-34, Identity=31%"; Hit description =similar to CG31116-PC [Apis mellifera]
  misc_feature: Gene Ontology Annotation: Molecular function=voltage-gated chloride channel activity; Cellular component=integral to plasma membrane; Biological process=transport
  misc_feature: Pfam annotation: Pfam_ID=CBS; Match level="Score=21.5, E-value =0.0027, Copies=1"; Pfam description=CBS domain
AVLIANGVARLLAPSIYDLVIRSKKLPYLPDLLPNTSSIYEVYVEDFMKTEIKYLSLSMNYGQMKELLISHKKIEVFPLVDHPQTMTLLGSITRQELIVLLDQRVGTVQRRQYLPTPMIDRHETSFENIEFIQSMRKRSVPHIDDSSDSEKEDDIRVEDNITTHPGMHEMKEIKVNSLEDTRDQIMKKWAPAKKTMTLPPLAPKSPLPERRGATSLLNLDVPGLRVCDLPDHEQQAWEVDQLKQQVDFTNCRIDPAPFQLVGEDLFASTFTLLPLSHLRLRNVDWKIWLGCCRSKGN

SEQ ID NO: 28424 - protein, 256 aa, Diabrotica virgifera
  misc_feature: Coding regions on vcDNA: vcDNA=SeqID_8121; Strand=-; Position=1-768
  misc_feature (3)..(29): Xaa can be any naturally occurring amino acid
  misc_feature (31)..(256): Xaa can be any naturally occurring amino acid
YIXXXXXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 28425 - protein, 211 aa, Diabrotica virgifera
  misc_feature: Coding regions on vcDNA: vcDNA=SeqID_8122; Strand=-; Position=0-632
  misc_feature (2)..(76): Xaa can be any naturally occurring amino acid
  misc_feature (78)..(100): Xaa can be any naturally occurring amino acid
  misc_feature (104)..(118): Xaa can be any naturally occurring amino acid
  misc_feature (121)..(147): Xaa can be any naturally occurring amino acid
  misc_feature (149)..(162): Xaa can be any naturally occurring amino acid
  misc_feature (165)..(178): Xaa can be any naturally occurring amino acid
  misc_feature (180)..(200): Xaa can be any naturally occurring amino acid
SXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXRRGXXXXXXXXXXXXXXXGGXXXXXXXXXXXXXXXXXXXXXXXXXXXSXXXXXXXXXXXXXXAPXXXXXXXXXXXXXXEXXXXXXXXXXXXXXXXXXXXXPPSVWWEGEDG

SEQ ID NO: 28426 - protein, 154 aa, Diabrotica virgifera
  misc_feature: Coding regions on vcDNA: vcDNA=SeqID_8123; Strand=-; Position=244-708
  misc_feature (4)..(37): Xaa can be any naturally occurring amino acid
  misc_feature (40)..(88): Xaa can be any naturally occurring amino acid
GQTXXXXXXXXXXXXXXXXXXXXXXXXXXXXXXXXXXITXXXXXXXXXXXXXXXXXXXXXXXXXXXXXXXXXXXXXXXXXXXXXXXXXRICRLFINIYQIAINCLSMNRSDIETGGEDETSRPVECYQQTQNKRLSMLNVTDVIHRIIKVTETT

SEQ ID NO: 28427 - protein, 303 aa, Diabrotica virgifera
  misc_feature: Coding regions on vcDNA: vcDNA=SeqID_8124; Strand=+; Position=2-914
  misc_feature: Homolog annotation: Hit_ID=CAE56149.1; Match level="QueryCoverage =97%, HitCoverage=24%, E-value=6e-36, Identity=32%"; Hit description =Hypothetical protein CBG23762 [Caenorhabditis briggsae]
  misc_feature (263)..(263): Xaa can be any naturally occurring amino acid
  misc_feature (275)..(275): Xaa can be any naturally occurring amino acid
  misc_feature (287)..(287): Xaa can be any naturally occurring amino acid
  misc_feature (295)..(295): Xaa can be any naturally occurring amino acid
RKANQGENSEFKYFSTKNEIIDAGTDLTLWFHSNVIDKLMAKLSEFEEKGSGWALEKIISLEVNINKYEIGNGASSFIKLPDQIRNKNACINVKNNDEACFFWSIVSALYPSKANSDRTSSYPHYTTVLNVDGLETPMTIGGISKFEKQNDISVNVYGLEMNVAKEKTFYVTIPLRLCKIKLARHVNLLMIQDKYFLKLNDYEAPIEDDEIVDIKYHYCMIKNLSRLLSSQTSNHSHKIFVCDRCLNNFSSFDRLNDHAKYCXESRLQSFISPYXHVKFKIMCIATXTFCVYADXEACYKKLK

SEQ ID NO: 28428 - protein, 33 aa, Diabrotica virgifera
  misc_feature: Coding regions on vcDNA: vcDNA=SeqID_8125; Strand=-; Position=1-99
  misc_feature (3)..(17): Xaa can be any naturally occurring amino acid
  misc_feature (24)..(31): Xaa can be any naturally occurring amino acid
SFXXXXXXXXXXXXXXXSSTPSIXXXXXXXXDY

SEQ ID NO: 28429 - protein, 81 aa, Diabrotica virgifera
  misc_feature: Coding regions on vcDNA: vcDNA=SeqID_8126; Strand=-; Position=168-413
YCLSRMMIRCIHRCIQLQQIGIDSIDRHHTIRRISRIPYHQSFHKHGFSYESEFLTERSVTESVISVDLSTIHRSRQRYLE

SEQ ID NO: 28430 - protein, 51 aa, Diabrotica virgifera
  misc_feature: Coding regions on vcDNA: vcDNA=SeqID_8127; Strand=-; Position=2-154
FWFSCAYLFEQCSSFTVWIFDEEDIVDYYEDSRVCRIQEYWVHPYFETHAS

SEQ ID NO: 28431 - protein, 258 aa, Diabrotica virgifera
  misc_feature: Coding regions on vcDNA: vcDNA=SeqID_8128; Strand=+; Position=54-827
  misc_feature: Homolog annotation: Hit_ID=XP_542015.1; Match level="QueryCoverage =67%, HitCoverage=35%, E-value=1e-28, Identity=36%"; Hit description =PREDICTED: similar to zinc finger protein 333 [Canis familiaris]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=62.0, E-value =1.6e-15, Copies=3"; Pfam description=Zinc finger, C2H2 type
  misc_feature (97)..(105): Xaa can be any naturally occurring amino acid
  misc_feature (146)..(152): Xaa can be any naturally occurring amino acid
  misc_feature (154)..(159): Xaa can be any naturally occurring amino acid
  misc_feature (230)..(241): Xaa can be any naturally occurring amino acid
  misc_feature (244)..(244): Xaa can be any naturally occurring amino acid
  misc_feature (253)..(253): Xaa can be any naturally occurring amino acid
MEVKQEVSDETYQAEIIYCNAVDDSPSDISKIEIKEESKTESAYHAFPIKTEIEQEEFKSFKEKELNGFPSEENILESMKTIPIEQHMSQPIEENTXXXXXXXXXFAKKRSLKTHLRLHTGETPYRCELCSKPFTTASILKRHVRXXXXXXXHXXXXXXEQFSQSSDLKKHMITHTGEKSYMCEICLKQFTTTGHLKTHMRIHTGETPYKCEFCFKVLSRASDLKTHLRXXXXXXXXXXXXCFXQFSHPSDLXKHTRT

SEQ ID NO: 28432 - protein, 295 aa, Diabrotica virgifera
  misc_feature: Coding regions on vcDNA: vcDNA=SeqID_8129; Strand=+; Position=25-912
  misc_feature: Homolog annotation: Hit_ID=XP_392619.1; Match level="QueryCoverage =96%, HitCoverage=26%, E-value=7e-18, Identity=29%"; Hit description =similar to ENSANGP00000015659 [Apis mellifera]
EQLKKLKAEKAKQQQIAAAASKNTPKVKQSLAGTGPKNRPQRTSKQKALEQVKSWCGNISDEEGISMKRPRSPDSDDSFSEKRMKFEEMSEDSDGEVSKPKMPLRKIAPKPPASPLQVIKNGVGKNTPLPQNILIPDANGVVRINQKQLPSLSTGVYIMSKTAGIIKLDSSTSKVATSSGQMIVKVAPKIGQTHIKIMKKDGTSTQQVVQMSPKNIQQTPKALKSHLTKAKKSLSELKASPAAPKAEVLKKQVLTPTKMDIDKKQMVVKKLPELAPKPGPKAFLNFHQSRVEKRI

SEQ ID NO: 28433 - protein, 16 aa, Diabrotica virgifera
  misc_feature: Coding regions on vcDNA: vcDNA=SeqID_8130; Strand=-; Position=1-48
  misc_feature (2)..(15): Xaa can be any naturally occurring amino acid
SXXXXXXXXXXXXXXL

SEQ ID NO: 28434 - protein, 25 aa, Diabrotica virgifera
  misc_feature: Coding regions on vcDNA: vcDNA=SeqID_8131; Strand=-; Position=0-74
  misc_feature (3)..(23): Xaa can be any naturally occurring amino acid
SFXXXXXXXXXXXXXXXXXXXXXIP

SEQ ID NO: 28435 - protein, 281 aa, Diabrotica virgifera
  misc_feature: Coding regions on vcDNA: vcDNA=SeqID_8132; Strand=+; Position=102-948
  misc_feature: Homolog annotation: Hit_ID=XP_314386.1; Match level="QueryCoverage =73%, HitCoverage=56%, E-value=2e-33, Identity=38%"; Hit description =ENSANGP00000018976 [Anopheles gambiae]
  misc_feature: Gene Ontology Annotation: Molecular function=plasma kallikrein activity; Cellular component=extracellular space; Biological process= antifungal polypeptide induction
  misc_feature: Pfam annotation: Pfam_ID=Trypsin; Match level="Score=29.4, E-value =5.1e-06, Copies=1"; Pfam description=Trypsin
  misc_feature (231)..(231): Xaa can be any naturally occurring amino acid
  misc_feature (235)..(235): Xaa can be any naturally occurring amino acid
  misc_feature (244)..(244): Xaa can be any naturally occurring amino acid
MFIIFIIFTFIAKLHGADQGCSIGGLQGTCQPISACSGVFSLLKDTDINFCQEEDPELYICCPDYLSSPTVEVEQYEDPSSISVKKCEEYYPPPADFIITAVGGTKSLPKEFPHMALIGYGQEKDKQWLCGGSLISHNFVLTAAHCLQSTDYGEAKWVHLGDLDISTDEDDAEPQDFKIIRVIAHPRYSFSSKYHDIALVKLDRNVMLTEYVAIACLQTVKKIYDPYNNMXAAGXGKIGFAEEXSSFLLKVSLNEVNTETCNRLYSDVKNRSTTGVLLVTR

SEQ ID NO: 28436 - protein, 279 aa, Diabrotica virgifera
  misc_feature: Coding regions on vcDNA: vcDNA=SeqID_8133; Strand=+; Position=14-853
  misc_feature: Homolog annotation: Hit_ID=EAK97664.1; Match level="QueryCoverage =94%, HitCoverage=36%, E-value=4e-10, Identity=24%"; Hit description =hypothetical protein CaO19.10912 [Candida albicans SC5314]
MIIQTVAPALVDTPDNLETILAVQSLQNIDIPKQDESNISEKERREMEALAMAVQSITEPSSNSYVDDYMTPTIESECLIQGDVIETQDQEISMLVTEMEPVQEPIIDTNSIQESTCEAEIKAVVDSEKVNEIDTQPMIQDNAVSSEPTEIETSNSSQQTEAANIEQDVVETSHSDVSIAKLSDIEPNITTSNIDATNDIDEDVKEVSTSEQLEVDPESSTTNQQSNAVTSFADTESEAVKKPVDNFEDSTEEPNLVTSVTDEVKTVEAVTQLIVLKIL

SEQ ID NO: 28437 - protein, 90 aa, Diabrotica virgifera
  misc_feature: Coding regions on vcDNA: vcDNA=SeqID_8134; Strand=-; Position=403-675
  misc_feature (6)..(11): Xaa can be any naturally occurring amino acid
ICAPSXXXXXXKFADAIVLTAERIDGAKELLKRFYLYSLKKGLKINTLKSKIIDSLAELYTLEVSNSLKLLSDSSDFSSMLQPYYLRKSM

SEQ ID NO: 28438 - protein, 62 aa, Diabrotica virgifera
  misc_feature: Coding regions on vcDNA: vcDNA=SeqID_8135; Strand=-; Position=23-211
  misc_feature (3)..(13): Xaa can be any naturally occurring amino acid
  misc_feature (23)..(30): Xaa can be any naturally occurring amino acid
  misc_feature (33)..(40): Xaa can be any naturally occurring amino acid
PFXXXXXXXXXXXTNLAPPGLNXXXXXXXXSNXXXXXXXXPIINFNPTSRSQSLLSIRTLLD

SEQ ID NO: 28439 - protein, 304 aa, Diabrotica virgifera
  misc_feature: Coding regions on vcDNA: vcDNA=SeqID_8136; Strand=-; Position=1-912
  misc_feature (4)..(287): Xaa can be any naturally occurring amino acid
  misc_feature (290)..(304): Xaa can be any naturally occurring amino acid
KKKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 28440 - protein, 27 aa, Diabrotica virgifera
  misc_feature: Coding regions on vcDNA: vcDNA=SeqID_8137; Strand=-; Position=0-80
  misc_feature (6)..(14): Xaa can be any naturally occurring amino acid
  misc_feature (19)..(24): Xaa can be any naturally occurring amino acid
YIPYIXXXXXXXXXFKNYXXXXXXFIS

SEQ ID NO: 28441 - protein, 108 aa, Diabrotica virgifera; identical to SEQ ID NO: 27732
  misc_feature: Coding regions on vcDNA: vcDNA=SeqID_8138; Strand=+; Position=227-553
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 28442 - protein, 240 aa, Diabrotica virgifera
  misc_feature: Coding regions on vcDNA: vcDNA=SeqID_8139; Strand=+; Position=138-856
  misc_feature: Homolog annotation: Hit_ID=NP_995753.1; Match level="QueryCoverage =97%, HitCoverage=43%, E-value=1e-114, Identity=87%"; Hit description= CG9446-PC, isoform C [Drosophila melanogaster] ref|NP_724509.1| CG9446-PB, isoform B [Drosophila
  misc_feature: Gene Ontology Annotation: Molecular function=structural molecule activity; Cellular component=actin cytoskeleton; Biological process =signal transduction
  misc_feature: Pfam annotation: Pfam_ID=WD40; Match level="Score=83.9, E-value=4.3e -22, Copies=3"; Pfam description=WD domain, G-beta repeat
  misc_feature (219)..(219): Xaa can be any naturally occurring amino acid
KPKMSFRVVRSSKFRHVYGQALKREQCYDNIRVSKSSWDSTFCAVNPKFLAIIVESAGGGAFIVLPLSSINKTGRIAADHPLVGGHKGPVLDIAWCPHNDNVIASGSEDCVVKVWHIPDHGLHKTLTEPVVDLVYHQRRVGLVLWHPTALNVLLTAGSDNHVVIWNVGTGESLVEIDCHPDIVYSACFNWDGSKLLTTCKDKKIRIINPRNWRSRSCRXLLHEGSIATRAVFLRHGLYSH

SEQ ID NO: 28443 - protein, 192 aa, Diabrotica virgifera
  misc_feature: Coding regions on vcDNA: vcDNA=SeqID_8140; Strand=+; Position=242-818
  misc_feature: Homolog annotation: Hit_ID=EAA08835.2; Match level="QueryCoverage =100%, HitCoverage=100%, E-value=2e-48, Identity=53%"; Hit description=ENSANGP00000011823 [Anopheles gambiae str. PEST] ref|XP _562513.1| ENSANGP00000011823 [Anopheles gambiae
  misc_feature: Gene Ontology Annotation: Molecular function=molecular_function unknown; Cellular component=cellular_component unknown; Biological process=biological_process unknown
  misc_feature: Pfam annotation: Pfam_ID=zf-AN1; Match level="Score=68.9, E-value =1.4e-17, Copies=1"; Pfam description=AN1-like Zinc finger
  misc_feature (23)..(29): Xaa can be any naturally occurring amino acid
  misc_feature (34)..(39): Xaa can be any naturally occurring amino acid
  misc_feature (162)..(162): Xaa can be any naturally occurring amino acid
  misc_feature (178)..(178): Xaa can be any naturally occurring amino acid
MEREFNPMQALCGSGCGFYGNPXXXXXXXLCFKXXXXXXQQLPNTPTSLSALKDTTTAQPTISHISSPVVTDLPTDASEECSNTASAAASNSTTAEPEAVATVSTSSGEMNAGTSSEDKDGDKDVKKKKNRCATCRKKVGLTGFECRCGELFCATHRYSDKXHDCSFNYREMGAQEIXRNNPVVLSERIQKI

SEQ ID NO: 28444 - protein, 27 aa, Diabrotica virgifera
  misc_feature: Coding regions on vcDNA: vcDNA=SeqID_8141; Strand=+; Position=1-84
PRPPPPPYVMYILFILHLVLKNVSEKI

SEQ ID NO: 28445 - protein, 253 aa, Diabrotica virgifera
  misc_feature: Coding regions on vcDNA: vcDNA=SeqID_8142; Strand=-; Position=1-759
  misc_feature (5)..(5): Xaa can be any naturally occurring amino acid
  misc_feature (8)..(8): Xaa can be any naturally occurring amino acid
  misc_feature (10)..(236): Xaa can be any naturally occurring amino acid
  misc_feature (239)..(253): Xaa can be any naturally occurring amino acid
SLVFXKNXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 28446 - protein, 164 aa, Diabrotica virgifera
  misc_feature: Coding regions on vcDNA: vcDNA=SeqID_8143; Strand=-; Position=420-914
  misc_feature (15)..(15): Xaa can be any naturally occurring amino acid
  misc_feature (85)..(91): Xaa can be any naturally occurring amino acid
STFSLAYIHFSNDYXIRLYFIGFVLCFHLTSMRSMISCVIHSCFLVFREPDVFLYFSFLEQSMLLQRLSVPKLSTVSISFSTVIXXXXXXXEFFSCEMSIFLITFSLLTFRNLFKLKSIYNWIVIGINVSSRECFTRFYVFLKVVIEYNEVNLIPNNSIFSIYG

SEQ ID NO: 28447 - protein, 79 aa, Diabrotica virgifera
  misc_feature: Coding regions on vcDNA: vcDNA=SeqID_8144; Strand=+; Position=1-240
LKPEDRQKFEWFLERYRYKEIFTETTLVKHKIDIGINERKEKTYCPAQQTRHNAPDAPRSSKVTVEIDEITVQFDQKVQ

SEQ ID NO: 28448 - protein, 62 aa, Diabrotica virgifera
  misc_feature: Coding regions on vcDNA: vcDNA=SeqID_8145; Strand=-; Position=0-185
  misc_feature (3)..(61): Xaa can be any naturally occurring amino acid
KNXXXXXXXXXXXXXXXXXXXXXXXXXXXXXXXXXXXXXXXXXXXXXXXXXXXXXXXXXXXA

SEQ ID NO: 28449 - protein, 111 aa, Diabrotica virgifera
  misc_feature: Coding regions on vcDNA: vcDNA=SeqID_8146; Strand=-; Position=2-334
  misc_feature (22)..(22): Xaa can be any naturally occurring amino acid
  misc_feature (56)..(56): Xaa can be any naturally occurring amino acid
  misc_feature (67)..(67): Xaa can be any naturally occurring amino acid
  misc_feature (69)..(69): Xaa can be any naturally occurring amino acid
  misc_feature (75)..(75): Xaa can be any naturally occurring amino acid
  misc_feature (81)..(81): Xaa can be any naturally occurring amino acid
  misc_feature (91)..(94): Xaa can be any naturally occurring amino acid
  misc_feature (101)..(101): Xaa can be any naturally occurring amino acid
  misc_feature (104)..(105): Xaa can be any naturally occurring amino acid
VVLFLGFPPFSLLFSWCFLLPXSLPSLWAFLLVVLWLLVSSVVAPPCLLLLVVVLXCSLPSLPASLXAXFLGSVXSSVSVXPSPFSSSSSXXXXSLKGSFXFSXXFLRPLR

SEQ ID NO: 28450 - protein, 183 aa, Diabrotica virgifera
  misc_feature: Coding regions on vcDNA: vcDNA=SeqID_8147; Strand=-; Position=1-549
  misc_feature (1)..(180): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRAK

SEQ ID NO: 28451 - protein, 294 aa, Diabrotica virgifera
  misc_feature: Coding regions on vcDNA: vcDNA=SeqID_8148; Strand=-; Position=1-882
  misc_feature (3)..(12): Xaa can be any naturally occurring amino acid
  misc_feature (14)..(40): Xaa can be any naturally occurring amino acid
  misc_feature (45)..(83): Xaa can be any naturally occurring amino acid
  misc_feature (86)..(294): Xaa can be any naturally occurring amino acid
IYXXXXXXXXXXVXXXXXXXXXXXXXXXXXXXXXXXXXXXKGSSXXXXXXXXXXXXXXXXXXXXXXXXXXXXXXXXXXXXXXXLCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 28452 - protein, 80 aa, Diabrotica virgifera
  misc_feature: Coding regions on vcDNA: vcDNA=SeqID_8149; Strand=-; Position=1-240
SQYTVNRTTIWAKKTDFLIISGFCIPYEGVLYPIFEIFVVKTTDFFTIKRENSQNNTKNTIFVPQQRCRKPRDLEWSIHF

SEQ ID NO: 28453 - protein, 58 aa, Diabrotica virgifera
  misc_feature: Coding regions on vcDNA: vcDNA=SeqID_8150; Strand=+; Position=130-306
LLISTLGKNCPFCVYEMVLIKEYDYKQNCLINKNNFYPSGIGTHLRDRIRLDPISLSL

SEQ ID NO: 28454 - protein, 125 aa, Diabrotica virgifera
  misc_feature: Coding regions on vcDNA: vcDNA=SeqID_8151; Strand=+; Position=2-379
  misc_feature (1)..(110): Xaa can be any naturally occurring amino acid
  misc_feature (121)..(121): Xaa can be any naturally occurring amino acid
  misc_feature (124)..(124): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYLRDNSVILLXESXR

SEQ ID NO: 28455 - protein, 16 aa, Diabrotica virgifera
  misc_feature: Coding regions on vcDNA: vcDNA=SeqID_8152; Strand=-; Position=3-50
  misc_feature (13)..(13): Xaa can be any naturally occurring amino acid
  misc_feature (15)..(15): Xaa can be any naturally occurring amino acid
AVSPKVIYSYIKXNXI

SEQ ID NO: 28456 - protein, 129 aa, Diabrotica virgifera
  misc_feature: Coding regions on vcDNA: vcDNA=SeqID_8153; Strand=-; Position=380-783
  misc_feature: Homolog annotation: Hit_ID=AAK61417.1; Match level="QueryCoverage =92%, HitCoverage=32%, E-value=6e-26, Identity=50%"; Hit description =transposase [Ceratitis rosa]
  misc_feature (34)..(34): Xaa can be any naturally occurring amino acid
  misc_feature (63)..(71): Xaa can be any naturally occurring amino acid
ENFVDPYFHKRIWFSGEPHFWLNGYVTKQNCHIXSEDPQVYVKTPLHLEKLTIWCNLRAGGIXXXXXXXXXAGQNVTVNGDRYNSATITVILIPQLNNHDVQELWFQQDGATCRTSRATIDLKQWRPVR

SEQ ID NO: 28457 - protein, 218 aa, Diabrotica virgifera
  misc_feature: Coding regions on vcDNA: vcDNA=SeqID_8154; Strand=+; Position=294-947
  misc_feature: Homolog annotation: Hit_ID=AAH36234.1; Match level="QueryCoverage =78%, HitCoverage=19%, E-value=4e-30, Identity=42%"; Hit description =Hypothetical protein FLJ23598 [Homo sapiens]
  misc_feature: Gene Ontology Annotation: Cellular component=nucleus
  misc_feature (179)..(179): Xaa can be any naturally occurring amino acid
  misc_feature (206)..(207): Xaa can be any naturally occurring amino acid
MDQESENNGCCKQEPEGNVQSLQATLFPIKPTNSTSYFANFIIKSPAEEDDIRFKIRESPHKDWFSCNKDTPFDFQPPRWPTECQVLEERVKHIIDSPSTYEAYYIPTGTECQPKPSGEECGKVVFHYVPLSAVNYFSRSSVGGNKFILPSSLCAEEDTLKFESRFECGNLAKAIMITXNYYELHLRSDFYTNRHMQWFYFRISNXXKGFLYRFSITN

SEQ ID NO: 28458 - protein, 132 aa, Diabrotica virgifera
  misc_feature: Coding regions on vcDNA: vcDNA=SeqID_8155; Strand=-; Position=2-397
  misc_feature (1)..(8): Xaa can be any naturally occurring amino acid
  misc_feature (11)..(24): Xaa can be any naturally occurring amino acid
  misc_feature (45)..(132): Xaa can be any naturally occurring amino acid
XXXXXXXXSTXXXXXXXXXXXXXXPTSRSQSLLSIDLSNKITLLXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 28459 - protein, 246 aa, Diabrotica virgifera
  misc_feature: Coding regions on vcDNA: vcDNA=SeqID_8156; Strand=+; Position=1-738
  misc_feature (1)..(241): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYLIWV

SEQ ID NO: 28460 - protein, 47 aa, Diabrotica virgifera
  misc_feature: Coding regions on vcDNA: vcDNA=SeqID_8157; Strand=+; Position=82-222
  misc_feature (20)..(26): Xaa can be any naturally occurring amino acid
QKYCSYLFGINVTYSLAIVXXXXXXXKSFKYRVFSFTVICIELLSTS

SEQ ID NO: 28461 - protein, 244 aa, Diabrotica virgifera
  misc_feature: Coding regions on vcDNA: vcDNA=SeqID_8158; Strand=+; Position=29-760
  misc_feature: Homolog annotation: Hit_ID=XP_393073.1; Match level="QueryCoverage =90%, HitCoverage=50%, E-value=4e-77, Identity=60%"; Hit description =similar to CG5373-PA [Apis mellifera]
  misc_feature: Gene Ontology Annotation: Molecular function=phosphatidylinositol 3 -kinase activity; Cellular component=membrane fraction; Biological process=vacuolar transport
  misc_feature: Pfam annotation: Pfam_ID=PI3K_C2; Match level="Score=157.6, E-value =2.7e-44, Copies=1"; Pfam description=Phosphoinositide 3-kinase C2
  misc_feature (150)..(162): Xaa can be any naturally occurring amino acid
  misc_feature (207)..(214): Xaa can be any naturally occurring amino acid
  misc_feature (225)..(225): Xaa can be any naturally occurring amino acid
MEEFNDKFYFVYSSSISDKIQIKIGTLEGKRHKPEYTKILEDPMLKYSGLYQDGCADLVVSCQIFDNNQPLALPVTTSYKAFTQRWNWNEWLTLPVQYNDLPRNAQLALTVYDCFGPNRLCPVGGTTISLFSKHSVFRQGMLDLRVWPNXXXXXXXXXXXXXKTKNGKEQMQRLAKLAKKHRNGYITKVDWLDRLTFRELEVVNEKXXXXXXXXYLMIEFPTINXDGMPHHIVYFEQNGEEILF

SEQ ID NO: 28462 - protein, 101 aa, Diabrotica virgifera
  misc_feature: Coding regions on vcDNA: vcDNA=SeqID_8159; Strand=+; Position=190-495
  misc_feature: Homolog annotation: Hit_ID=NP_524846.1; Match level="QueryCoverage =73%, HitCoverage=73%, E-value=1e-14, Identity=45%"; Hit description =CG15191-PA [Drosophila melanogaster] gb|AAF48062.1| CG15191-PA [Drosophila melanogaster]
MPQDYDSKVSLHLDINHGLERVTELVQTRLIESGWRDQVKLACRKAILENGEKHPPTVDELITQITPKARSMVPDAVKRELLHELELILVNVDKAGYSKNF

SEQ ID NO: 28463 - protein, 93 aa, Diabrotica virgifera
  misc_feature: Coding regions on vcDNA: vcDNA=SeqID_8160; Strand=-; Position=422-703
  misc_feature (69)..(75): Xaa can be any naturally occurring amino acid
YQNIPKSMFLMCLSVTNVCDHHGNLYFICSNAEKLHRCCVEPLLIPILSLTSYLIHDGSSLLQVCAGRXXXXXXXGFHSRAAFAILELFFRSV

SEQ ID NO: 28464 - protein, 247 aa, Diabrotica virgifera
  misc_feature: Coding regions on vcDNA: vcDNA=SeqID_8161; Strand=+; Position=2-745
  misc_feature: Homolog annotation: Hit_ID=XP_392311.1; Match level="QueryCoverage =100%, HitCoverage=5%, E-value=4e-51, Identity=48%"; Hit description =similar to Short stop/Kakapo long isoform [Apis mellifera]
  misc_feature: Gene Ontology Annotation: Cellular component=cytoskeleton; Biological process=microtubule-based process
  misc_feature (211)..(220): Xaa can be any naturally occurring amino acid
LADGVSQTMTAFKPKTSASSPTSGSSASRTPQGPITKVRERSQRSVPMGSLPRTSKSSLSAGTPDSLSDNESSTFRTPRKPSYRSTLTPGGSRSNSRPQSRTGSRPGSKPPSRHGSNLSLDSTDDATPSRIPRRTPTSGRSSALSTTKSINGSGSRPRTPSGLISPASPVGRSASSSKVKQVTIGVAPSLRTASRTRTPSGSNTPVHPDQXXXXXXXXXXSTGGTDTPTSQTRKKKSSLSDREPFRL

SEQ ID NO: 28465 - protein, 82 aa, Diabrotica virgifera
  misc_feature: Coding regions on vcDNA: vcDNA=SeqID_8162; Strand=-; Position=2-247
  misc_feature (1)..(16): Xaa can be any naturally occurring amino acid
  misc_feature (19)..(29): Xaa can be any naturally occurring amino acid
  misc_feature (39)..(46): Xaa can be any naturally occurring amino acid
  misc_feature (49)..(62): Xaa can be any naturally occurring amino acid
  misc_feature (68)..(81): Xaa can be any naturally occurring amino acid
XXXXXXXXXXXXXXXXPFXXXXXXXXXXXTNLAHTGLNXXXXXXXXSNXXXXXXXXXXXXXXPTSRSXXXXXXXXXXXXXXV

SEQ ID NO: 28466 - protein, 78 aa, Diabrotica virgifera
  misc_feature: Coding regions on vcDNA: vcDNA=SeqID_8163; Strand=-; Position=465-701
  misc_feature (42)..(48): Xaa can be any naturally occurring amino acid
IKRVLHSLYNTSPLVREKYISLSILVDNSQNSLPFSSIKNHXXXXXXXICLKVFDKDNSFVHLPNQPSRFFSDDMVLE

SEQ ID NO: 28467 - protein, 76 aa, Diabrotica virgifera
  misc_feature: Coding regions on vcDNA: vcDNA=SeqID_8164; Strand=-; Position=107-337
  misc_feature (7)..(15): Xaa can be any naturally occurring amino acid
  misc_feature (47)..(55): Xaa can be any naturally occurring amino acid
AHSQKSXXXXXXXXXFILICIIANFHLSVQKLETDNYESQFVTQWIXXXXXXXXXSLFYLLQNSRTMNIKLLRNHS

SEQ ID NO: 28468 - protein, 238 aa, Diabrotica virgifera
  misc_feature: Coding regions on vcDNA: vcDNA=SeqID_8165; Strand=+; Position=155-871
  misc_feature (235)..(235): Xaa can be any naturally occurring amino acid
SWHKMENTWTVVKFPDENDAVEAVPTSWLHNNLCYWPPFPKNVIREAIECCSSPEKSWSLFKFEHLKNNVAGSFQEAKKKVFYATQKSDLESDSQSCLERGLNKRKIFKKRFEPYSSFEEDEEADDFPEPPALKKPKMSDLQRAGASTSRIEDTPRSVSRNTLFGSTGNIQRTQSPSRGANLSSPAVFCSTNKDTSDNDTTTNHIILEHLKKLLKKQNILQSMMQDIVSDVSDLXKRL

SEQ ID NO: 28469 - protein, 17 aa, Diabrotica virgifera
  misc_feature: Coding regions on vcDNA: vcDNA=SeqID_8166; Strand=-; Position=0-50
  misc_feature (1)..(13): Xaa can be any naturally occurring amino acid
XXXXXXXXXXXXXFFIT

SEQ ID NO: 28470 - protein, 184 aa, Diabrotica virgifera
  misc_feature: Coding regions on vcDNA: vcDNA=SeqID_8167; Strand=-; Position=1-552
VHCHVAALRIISSVDSCWFGREIVEKMIGLSLSVISLGIFLQMIGSNMAVLLGIIFMDTLGVSLVSFHWNSITLFSSGVIVSHVMVAQYFSTSAAQSFVCRTVLKAPEGSHSWYPVGSSSEWRSKNAGHLALQIFVIFWCIGRSASVVDLQRSYVSIPVQVEDSNMSISSMCRMLYGPTYGVIN

SEQ ID NO: 28471 - protein, 56 aa, Diabrotica virgifera
  misc_feature: Coding regions on vcDNA: vcDNA=SeqID_8168; Strand=-; Position=1-168
  misc_feature (3)..(37): Xaa can be any naturally occurring amino acid
  misc_feature (42)..(54): Xaa can be any naturally occurring amino acid
FLXXXXXXXXXXXXXXXXXXXXXXXXXXXXXXXXXXXTVKYXXXXXXXXXXXXXIL

SEQ ID NO: 28472 - protein, 46 aa, Diabrotica virgifera
  misc_feature: Coding regions on vcDNA: vcDNA=SeqID_8169; Strand=+; Position=29-169
DGSTVVKYRRGRLRNPMCFMTDRPLSCSVSVVHNAMISWTSSILSL

SEQ ID NO: 28473 - protein, 68 aa, Diabrotica virgifera
  misc_feature: Coding regions on vcDNA: vcDNA=SeqID_8170; Strand=-; Position=67-273
RRITFHFTWITFAIATTIPNVVFPTYQSSISVKTMICTNDALTTGFPKKTRNFHKLNFLTQSYLSIKE

SEQ ID NO: 28474 - protein, 308 aa, Diabrotica virgifera
  misc_feature: Coding regions on vcDNA: vcDNA=SeqID_8171; Strand=+; Position=22-946
  misc_feature: Homolog annotation: Hit_ID=CAG32095.1; Match level="QueryCoverage =98%, HitCoverage=95%, E-value=1e-106, Identity=61%"; Hit description= hypothetical protein [Gallus gallus]
  misc_feature: Pfam annotation: Pfam_ID=ubiquitin; Match level="Score=42.7, E-value =1.1e-09, Copies=1"; Pfam description=Ubiquitin family
  misc_feature (263)..(263): Xaa can be any naturally occurring amino acid
  misc_feature (291)..(291): Xaa can be any naturally occurring amino acid
  misc_feature (299)..(299): Xaa can be any naturally occurring amino acid
  misc_feature (303)..(303): Xaa can be any naturally occurring amino acid
MSTVIKIVLKWNGKEFNLESSEDDTVSDLKKTIENVTSVKCGRQKLLNLKYKGKTPEDDCTLGLLKLKPNFKLMMMGSLEEDIAEANTAPENLPDVVNDLDIEEEEVAIENQDVYLAKVEKRIKDYKINMLNDLRPEKKLLVLDIDYTLFDHRSTAQSGAELMRPYLHEFLTTSYEHYDIVIWSATGMKWIEEKMKLLGVSTHPDYKIAFYLDSLAMISVHIPKYGVVDVKPLGVIWGKFTQFSSKNTIMFDDIRRNFIMNPXNGLRIRPFREAHLNREKDRELLHLCQYXKDLAEKLXDFAXCNHRH

SEQ ID NO: 28475 - protein, 321 aa, Diabrotica virgifera
  misc_feature: Coding regions on vcDNA: vcDNA=SeqID_8172; Strand=+; Position=1-963
  misc_feature: Homolog annotation: Hit_ID=NP_611375.2; Match level="QueryCoverage =90%, HitCoverage=59%, E-value=3e-56, Identity=40%"; Hit description =CG15094-PA, isoform A [Drosophila melanogaster] gb|AAF57636.3| CG15094-PA, isoform A [Drosophila
  misc_feature: Gene Ontology Annotation: Molecular function=inorganic phosphate transporter activity; Cellular component=integral to membrane; Biological process=phosphate transport
  misc_feature: Pfam annotation: Pfam_ID=MFS_1; Match level="Score=6.9, E-value =0.002, Copies=1"; Pfam description=Major Facilitator Superfamily
  misc_feature (45)..(49): Xaa can be any naturally occurring amino acid
  misc_feature (230)..(241): Xaa can be any naturally occurring amino acid
KQEYTKEQLETLLRTHEAACNNGPTIGKRHIQIVLASCITLLNYXXXXXMSVIIVAMTDSTANKNKDIPTYNWTDKSLVVSSFLWGYVIPQVAAGYLATMHGAKWFLAGSLIASSTLGLLVPIAAATFGSKGLMAIRMLQGLSQGVMFPSIHVFLSRWVPINERSRLGTLPYVGSPVGTVGSMLLTGLIASSWYGWPMAVYFFSSLGLCVGLVFAYFGCSEPSIHSTITXXXXXXXXXXXXGTESTVEKEEVAPVPWTEILTSLPFWALLLAQIGWSWSNWTLLLETPIYMNHVMKFDFKSNSVLSSLPYIAEAASAICYS

SEQ ID NO: 28476 - protein, 19 aa, Diabrotica virgifera
  misc_feature: Coding regions on vcDNA: vcDNA=SeqID_8173; Strand=+; Position=1-57
  misc_feature (8)..(8): Xaa can be any naturally occurring amino acid
CKSLFTSXCTKHINKLFYL

SEQ ID NO: 28477 - protein, 99 aa, Diabrotica virgifera
  misc_feature: Coding regions on vcDNA: vcDNA=SeqID_8174; Strand=+; Position=538-834
  misc_feature: Homolog annotation: Hit_ID=NP_525123.2; Match level="QueryCoverage =83%, HitCoverage=13%, E-value=2e-18, Identity=59%"; Hit description =CG12085-PA, isoform A [Drosophila melanogaster] gb|AAF47501.1| CG12085-PA, isoform A [Drosophila
  misc_feature: Gene Ontology Annotation: Cellular component=nucleus; Biological process=cystoblast cell division
  misc_feature (58)..(58): Xaa can be any naturally occurring amino acid
  misc_feature (65)..(65): Xaa can be any naturally occurring amino acid
  misc_feature (73)..(73): Xaa can be any naturally occurring amino acid
HYCSRSLPGLCEGYEYIYDLIQIGEVITGPGARSSTIAGILGGALPKLSSDDADAVSXAKKYAMXTSIRMVLXEQTIAYQQQKNKTFQRHQVLVLMCRV

SEQ ID NO: 28478 - protein, 116 aa, Diabrotica virgifera
  misc_feature: Coding regions on vcDNA: vcDNA=SeqID_8175; Strand=-; Position=0-347
  misc_feature (4)..(16): Xaa can be any naturally occurring amino acid
  misc_feature (19)..(29): Xaa can be any naturally occurring amino acid
  misc_feature (39)..(46): Xaa can be any naturally occurring amino acid
  misc_feature (49)..(62): Xaa can be any naturally occurring amino acid
  misc_feature (68)..(81): Xaa can be any naturally occurring amino acid
  misc_feature (83)..(115): Xaa can be any naturally occurring amino acid
KITXXXXXXXXXXXXXPFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXG

SEQ ID NO: 28479 - protein, 247 aa, Diabrotica virgifera
  misc_feature: Coding regions on vcDNA: vcDNA=SeqID_8176; Strand=+; Position=2-742
  misc_feature: Homolog annotation: Hit_ID=XP_312382.1; Match level="QueryCoverage =98%, HitCoverage=39%, E-value=7e-84, Identity=63%"; Hit description =ENSANGP00000012169 [Anopheles gambiae]
  misc_feature: Gene Ontology Annotation: Biological process=reproduction
  misc_feature: Pfam annotation: Pfam_ID=GMC_oxred_N; Match level="Score=76.5, E -value=7.2e-20, Copies=1"; Pfam description=GMC oxidoreductase
  misc_feature (202)..(203): Xaa can be any naturally occurring amino acid
  misc_feature (234)..(234): Xaa can be any naturally occurring amino acid
  misc_feature (236)..(236): Xaa can be any naturally occurring amino acid
GRVGEVLPHFLKSEDNKQMDQVDIGYHNQGGLLTVSQFPYHPPLSKSILKAAQELGYPIRDLNGRYHSGFAIAQTTNRNGSRMSTAKAFLRPFVGRKNLHILLNATVTKILVNSKTKEAYGVELLRAGVKSSIYASKEVIVSGGAVNSPQILLLSGIGPREELKKVKVPVVHDLPGVGKNLQNHVAFFINFFLNDTNTTPLXXATAMEYLLFRDGLMSGTGISEVTGFINTKYXDXMEEHPDISYFF

SEQ ID NO: 28480 - protein, 66 aa, Diabrotica virgifera; identical to SEQ ID NO: 26808
  misc_feature: Coding regions on vcDNA: vcDNA=SeqID_8177; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28481 - protein, 83 aa, Diabrotica virgifera
  misc_feature: Coding regions on vcDNA: vcDNA=SeqID_8178; Strand=-; Position=1-252
  misc_feature (1)..(31): Xaa can be any naturally occurring amino acid
  misc_feature (33)..(79): Xaa can be any naturally occurring amino acid
XXXXXXXXXXXXXXXXXXXXXXXXXXXXXXXLXXXXXXXXXXXXXXXXXXXXXXXXXXXXXXXXXXXXXXXXXXXXXXXRPIK

SEQ ID NO: 28482 - protein, 46 aa, Diabrotica virgifera
  misc_feature: Coding regions on vcDNA: vcDNA=SeqID_8179; Strand=-; Position=7-147
  misc_feature (1)..(8): Xaa can be any naturally occurring amino acid
XXXXXXXXDTDFILEHSLYKVFFVKFSEFFNGQVSFFLKFVLVTHF

SEQ ID NO: 28483 - protein, 90 aa, Diabrotica virgifera
  misc_feature: Coding regions on vcDNA: vcDNA=SeqID_8180; Strand=-; Position=2-271
  misc_feature (1)..(17): Xaa can be any naturally occurring amino acid
  misc_feature (20)..(90): Xaa can be any naturally occurring amino acid
XXXXXXXXXXXXXXXXXITXXXXXXXXXXXXXXXXXXXXXXXXXXXXXXXXXXXXXXXXXXXXXXXXXXXXXXXXXXXXXXXXXXXXXXX

SEQ ID NO: 28484 - protein, 85 aa, Diabrotica virgifera
  misc_feature: Coding regions on vcDNA: vcDNA=SeqID_8181; Strand=-; Position=156-413
DLPPRTGVVFTSQGNRTFMWETRDLSAKFFYVLIVMGAVFSTSIWIFKCMCRPNILIASSPVLWRRLPSRLRLSGLVLLNERMVM

SEQ ID NO: 28485 - protein, 53 aa, Diabrotica virgifera
  misc_feature: Coding regions on vcDNA: vcDNA=SeqID_8182; Strand=-; Position=23-184
RLYSIAVLAQLNELIRNVVMLVEILQLKPLKKHVNVTKECINITCIYVKCVKR

SEQ ID NO: 28486 - protein, 141 aa, Diabrotica virgifera
  misc_feature: Coding regions on vcDNA: vcDNA=SeqID_8183; Strand=+; Position=259-681
  misc_feature: Homolog annotation: Hit_ID=XP_313043.1; Match level="QueryCoverage =82%, HitCoverage=17%, E-value=2e-44, Identity=72%"; Hit description =ENSANGP00000011712 [Anopheles gambiae]
  misc_feature: Gene Ontology Annotation: Molecular function=electron transporter activity; Cellular component=cytosol; Biological process=pyruvate metabolism
  misc_feature (136)..(136): Xaa can be any naturally occurring amino acid
SCNHKKRNRSVTANAGHKTILNQIPRTINAEDQHKRHLTGDVISPGQVMGIEHLRDPRLNKGLGFTLEERQALGIHGLQPARFKTQEQQLELCRISVERYQEDLNKYIYLTELQDRNEKLFFRLLSENIETLMPIXYTPTV

SEQ ID NO: 28487 - protein, 36 aa, Diabrotica virgifera
  misc_feature: Coding regions on vcDNA: vcDNA=SeqID_8184; Strand=-; Position=4-114
  misc_feature (2)..(10): Xaa can be any naturally occurring amino acid
  misc_feature (28)..(29): Xaa can be any naturally occurring amino acid
  misc_feature (36)..(36): Xaa can be any naturally occurring amino acid
DXXXXXXXXXNYKLNPHRGSQSYYRLTXXIKLRCIX

SEQ ID NO: 28488 - protein, 126 aa, Diabrotica virgifera
  misc_feature: Coding regions on vcDNA: vcDNA=SeqID_8185; Strand=-; Position=1-378
  misc_feature (97)..(102): Xaa can be any naturally occurring amino acid
NGIYYTIGPCKLYPYGKPSIIHFTEKSFLRKKLRIVQNPRFNHHISILSNIIRGTSKSLNFTQEQSSSIPHNIENCHYEKLFGIKNYILICNYILPXXXXXXEKLQITNITLSYLNSDNSFIINVT

SEQ ID NO: 28489 - protein, 181 aa, Diabrotica virgifera
  misc_feature: Coding regions on vcDNA: vcDNA=SeqID_8186; Strand=+; Position=223-768
  misc_feature: Homolog annotation: Hit_ID=XP_392420.1; Match level="QueryCoverage =93%, HitCoverage=15%, E-value=8e-37, Identity=49%"; Hit description =similar to ENSANGP00000010741 [Apis mellifera]
  misc_feature: Gene Ontology Annotation: Molecular function=protein binding
  misc_feature: Pfam annotation: Pfam_ID=ubiquitin; Match level="Score=74.4, E-value =3.2e-19, Copies=1"; Pfam description=Ubiquitin family
  misc_feature (28)..(28): Xaa can be any naturally occurring amino acid
  misc_feature (150)..(150): Xaa can be any naturally occurring amino acid
MIELTVKTLDSQNHQFTVEDDITVQQFXVKIAETVNISAETQRIIYCGRVLQDNSKLADYDVNGKVVHLVQRPPPGTTPRSNSRSTSPQPQRRGFRGFRNLEQGNAMYLGSVAFPGSFMESQGIEPPPPTSSLSRSRLNVARRMLRRAEXLIRVLETNPSGRSQEQAAEEIQKRRKEVLRL

SEQ ID NO: 28490 - protein, 225 aa, Diabrotica virgifera
  misc_feature: Coding regions on vcDNA: vcDNA=SeqID_8187; Strand=-; Position=2-676
  misc_feature (5)..(13): Xaa can be any naturally occurring amino acid
  misc_feature (22)..(28): Xaa can be any naturally occurring amino acid
  misc_feature (60)..(68): Xaa can be any naturally occurring amino acid
  misc_feature (84)..(106): Xaa can be any naturally occurring amino acid
  misc_feature (116)..(133): Xaa can be any naturally occurring amino acid
  misc_feature (137)..(173): Xaa can be any naturally occurring amino acid
  misc_feature (177)..(189): Xaa can be any naturally occurring amino acid
  misc_feature (198)..(224): Xaa can be any naturally occurring amino acid
PLFNXXXXXXXXXPFFCLLLGXXXXXXXGGNPPTLGQKRGKKEKRGASGPSPTLLSPLGXXXXXXXXXLGPSGGGPFSPSWCPXXXXXXXXXXXXXXXXXXXXXXXPGVFFGSPPXXXXXXXXXXXXXXXXXXPLFXXXXXXXXXXXXXXXXXXXXXXXXXXXXXXXXXXXXXGSGXXXXXXXXXXXXXPPLPPFLGXXXXXXXXXXXXXXXXXXXXXXXXXXXF

SEQ ID NO: 28491 - protein, 168 aa, Diabrotica virgifera
  misc_feature: Coding regions on vcDNA: vcDNA=SeqID_8188; Strand=+; Position=2-508
  misc_feature (142)..(142): Xaa can be any naturally occurring amino acid
  misc_feature (146)..(146): Xaa can be any naturally occurring amino acid
EYVVDQEYYKSLGYTGPKPTFSKKVYTVRVDGISFELVDPIVLDNCDSIETIFDVDTSKSDYLPIPGEHALNVSSDCTLMFPLIFLKAKGFSNQPFGGFITIRALHNKYVLDITSLVLIPKSDPRDIRIIFEVDGTEYIILXYFYXKITFISILLITAFILAVELRRS

SEQ ID NO: 28492 - protein, 55 aa, Diabrotica virgifera
  misc_feature: Coding regions on vcDNA: vcDNA=SeqID_8189; Strand=+; Position=67-234
  misc_feature (12)..(18): Xaa can be any naturally occurring amino acid
  misc_feature (41)..(47): Xaa can be any naturally occurring amino acid
LINIAREYFIFXXXXXXXLYPRCHESLKNTDILITSQYKSXXXXXXXAAKTNINK

SEQ ID NO: 28493 - protein, 307 aa, Diabrotica virgifera
  misc_feature: Coding regions on vcDNA: vcDNA=SeqID_8190; Strand=+; Position=3-923
  misc_feature: Homolog annotation: Hit_ID=XP_396328.1; Match level="QueryCoverage =100%, HitCoverage=34%, E-value=1e-140, Identity=78%"; Hit description=similar to ENSANGP00000023222 [Apis mellifera]
  misc_feature: Gene Ontology Annotation: Molecular function=pyruvate carboxylase activity; Cellular component=cytosol; Biological process =gluconeogenesis
  misc_feature: Pfam annotation: Pfam_ID=Biotin_carb_C; Match level="Score=138.4, E -value=1.6e-38, Copies=1"; Pfam description=Biotin carboxylase C -terminal domain
  misc_feature (175)..(186): Xaa can be any naturally occurring amino acid
  misc_feature (283)..(283): Xaa can be any naturally occurring amino acid
PDTGRIEVFRSGEGMGIRLDGASAFAGAIISPYYDSLLVKVIAHSKDLASSCAKMNRALREFRVRGVKTNIPFLLNVLENQKFLNGSVDTYFIDENPQLFKFAPTKNRAQKLLNYLGEVLVNGPQTPLGTTLKPAEIKPHVPVVSQEYLVTNPDHVPSIEPPKGFRQIYKEQGPXXXXXXXXXXXXVLLMDTTFRDAHQSLLATRVRTHDLLKISPFVAHNFNQLYSLENWGGATFDVALRFLHECPWERLEDMRKMIPNIPFQMVLRGANAVGYTNYPDNVXYKFWDLAGQRGMDVFRVFDSPHYL

SEQ ID NO: 28494 - protein, 80 aa, Diabrotica virgifera
  misc_feature: Coding regions on vcDNA: vcDNA=SeqID_8191; Strand=-; Position=1-240
  misc_feature (7)..(23): Xaa can be any naturally occurring amino acid
  misc_feature (25)..(25): Xaa can be any naturally occurring amino acid
  misc_feature (28)..(78): Xaa can be any naturally occurring amino acid
SKKWIKXXXXXXXXXXXXXXXXXQXNKXXXXXXXXXXXXXXXXXXXXXXXXXXXXXXXXXXXXXXXXXXXXXXXXXXXPF

SEQ ID NO: 28495 - protein, 112 aa, Diabrotica virgifera
  misc_feature: Coding regions on vcDNA: vcDNA=SeqID_8192; Strand=+; Position=11-349
  misc_feature: Homolog annotation: Hit_ID=AAS20593.1; Match level="QueryCoverage =88%, HitCoverage=31%, E-value=7e-15, Identity=40%"; Hit description =digestive cysteine proteinase intestain [Leptinotarsa decemlineata]
  misc_feature: Gene Ontology Annotation: Molecular function=molecular_function unknown; Cellular component=cellular_component unknown; Biological process=biological_process unknown
MFKYFLLFLIAAALAADTYLSDDEEFEKFKKDFSRNYETPNEEQHRRGIFVNTLNTVKAHNAKFERGEVSYSLGINQFADLTQDEFENRYTMKKWVEQQGKGKLATKTATQN

SEQ ID NO: 28496 - protein, 84 aa, Diabrotica virgifera
  misc_feature: Coding regions on vcDNA: vcDNA=SeqID_8193; Strand=-; Position=36-290
  misc_feature (43)..(48): Xaa can be any naturally occurring amino acid
VFAAFTISFHVCRSCATNSHCRTPIFSRSSLTASFHLFLGRPXXXXXXLSQNTFFIRRVSLLRIAMDLLPRVIYTRDHKKRVTR

SEQ ID NO: 28497 - protein, 27 aa, Diabrotica virgifera
  misc_feature: Coding regions on vcDNA: vcDNA=SeqID_8194; Strand=-; Position=0-80
  misc_feature (1)..(26): Xaa can be any naturally occurring amino acid
XXXXXXXXXXXXXXXXXXXXXXXXXXA

SEQ ID NO: 28498 - protein, 245 aa, Diabrotica virgifera
  misc_feature: Coding regions on vcDNA: vcDNA=SeqID_8195; Strand=+; Position=5-743
  misc_feature: Homolog annotation: Hit_ID=XP_392862.1; Match level="QueryCoverage =95%, HitCoverage=32%, E-value=1e-17, Identity=30%"; Hit description =similar to CG1093-PA [Apis mellifera]
  misc_feature (104)..(104): Xaa can be any naturally occurring amino acid
DWRKRVLQQSQINKLEMQNRALDVTIGSLGNFVQSLIEQKLDLEIPDDVQRILSQLSFTDRIKHEVKPHQNNLLRMFQRSPEKIMTKSQSMGLINLPTNVNNKXDQTRSRTSSLSKRKEANPNLTTTPNNSAERISKFFSGSHHNILQQKLNAQNNILSNTKIDITVQEFKNEDLRENNPVEFPFVNNNISPTNSEDSGVVSPASNPLSPKSVDSHPLSNCDVSFMFNGTRELKTIRNINDITNK

SEQ ID NO: 28499 - protein, 287 aa, Diabrotica virgifera
  misc_feature: Coding regions on vcDNA: vcDNA=SeqID_8196; Strand=+; Position=18-883
  misc_feature: Homolog annotation: Hit_ID=NP_503166.1; Match level="QueryCoverage =96%, HitCoverage=42%, E-value=3e-36, Identity=32%"; Hit description =predicted CDS, reverse transcriptase family member (5A739) [Caenorhabditis elegans]
  misc_feature: Pfam annotation: Pfam_ID=RVT_1; Match level="Score=-15.6, E-value =0.0013, Copies=1"; Pfam description=Reverse transcriptase (RNA -dependent
  misc_feature (41)..(41): Xaa can be any naturally occurring amino acid
  misc_feature (47)..(47): Xaa can be any naturally occurring amino acid
  misc_feature (101)..(101): Xaa can be any naturally occurring amino acid
  misc_feature (150)..(150): Xaa can be any naturally occurring amino acid
  misc_feature (179)..(179): Xaa can be any naturally occurring amino acid
  misc_feature (252)..(252): Xaa can be any naturally occurring amino acid
AGFRPKYGTNDHLQCIKVLIEKSIEYNRPLLLTFIDFQKAXYTNIIXNVYRNATTTITLHGPTNKIHIRRGIRQGDTMSPKLFITVLKHTLKSLKWKNKGXISMMRFADDIVLISDDLKTVNDMLNEFSDAARKVGLNINYQKTNIMTNXSSEPYLKVEDVEIRVVESYIYLGHMVKIXDNPTAELLRTLGWAAYGRLRDIFKGDIPISLKRRAFNQCVLPVLTYDTETLTITKTSARKLQVTQRRIEKLLXITLRDRVRIEEIRRRSGVEDIIKHNQNYMEKRTRS

SEQ ID NO: 28500 - protein, 170 aa, Diabrotica virgifera
  misc_feature: Coding regions on vcDNA: vcDNA=SeqID_8197; Strand=+; Position=43-552
  misc_feature (2)..(31): Xaa can be any naturally occurring amino acid
  misc_feature (35)..(86): Xaa can be any naturally occurring amino acid
  misc_feature (89)..(164): Xaa can be any naturally occurring amino acid
  misc_feature (168)..(168): Xaa can be any naturally occurring amino acid
DXXXXXXXXXXXXXXXXXXXXXXXXXXXXXXLIIXXXXXXXXXXXXXXXXXXXXXXXXXXXXXXXXXXXXXXXXXXXXXXXXXXXXEWXXXXXXXXXXXXXXXXXXXXXXXXXXXXXXXXXXXXXXXXXXXXXXXXXXXXXXXXXXXXXXXXXXXXXXXXXXXXGGDXKI

SEQ ID NO: 28501 - protein, 116 aa, Diabrotica virgifera
  misc_feature: Coding regions on vcDNA: vcDNA=SeqID_8198; Strand=-; Position=107-457
RYSKHFRWGVNRRILRISCIVSHQRQKFYIEWVKSANYIVTIKRRNLEYLGLVMRNEQRYDLLRTILQGKVHGKRGPGRRRISWLHNLRKWFNLTTPGLQGSSQQSQNSHVSVQHP

SEQ ID NO: 28502 - protein, 251 aa, Diabrotica virgifera
  misc_feature: Coding regions on vcDNA: vcDNA=SeqID_8199; Strand=+; Position=131-886
  misc_feature: Homolog annotation: Hit_ID=XP_420435.1; Match level="QueryCoverage =93%, HitCoverage=27%, E-value=6e-34, Identity=34%"; Hit description =PREDICTED: similar to hypothetical protein BC004337 [Gallus gallus]
  misc_feature: Pfam annotation: Pfam_ID=TPR_2; Match level="Score=23.7, E-value =0.00058, Copies=2"; Pfam description=Tetratricopeptide repeat
MAGRVPRLGDSIYYLKKAKQACVKNDFAEAYENFVLYFESLNDPAESTSAVQTVFTKLVCKMGAVLEETSNIEELLKCYIQALNLFPDNYVILNNLGAYMFKISEVDIARRYLERAVNVNKNYLPAEINLMRVKWHQIPRWHFRMLNDKGRNLAYDEAIREVIKNGYKNVIDIGAGCGLLSLIAAEMPGTSVIAIEENKQLYNLCVDIMKKNEVSNVKVLQCYSLDNEEVLDKCNFLVTEVFDCGFVGDEL

SEQ ID NO: 28503 - protein, 66 aa, Diabrotica virgifera; identical to SEQ ID NO: 26808
  misc_feature: Coding regions on vcDNA: vcDNA=SeqID_8200; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28504 - protein, 48 aa, Diabrotica virgifera
  misc_feature: Coding regions on vcDNA: vcDNA=SeqID_8201; Strand=+; Position=1-147
  misc_feature (2)..(16): Xaa can be any naturally occurring amino acid
  misc_feature (18)..(25): Xaa can be any naturally occurring amino acid
FXXXXXXXXXXXXXXXRXXXXXXXXDRNQPGSHRFKLRSCKILKVEQT

SEQ ID NO: 28505 - protein, 245 aa, Diabrotica virgifera
  misc_feature: Coding regions on vcDNA: vcDNA=SeqID_8202; Strand=+; Position=1-738
  misc_feature: Homolog annotation: Hit_ID=XP_396168.1; Match level="QueryCoverage =81%, HitCoverage=11%, E-value=2e-11, Identity=26%"; Hit description =similar to RE58116p [Apis mellifera]
  misc_feature (51)..(62): Xaa can be any naturally occurring amino acid
IILVALLSLTAAKSVEDALLKNGLQSKFKDERNSLEGDKLTAINTEINEFXXXXXXXXXXXXEKSKLEPILLDNIKQQFLTASIELTHGKLNGLSHVYRDGDVTVTYDRNANIITLNLPLLFKKLSFTYDYHVVVFLVGPTGGLTGSIDNFRLSINLSLDLNKYQASNSGHITVKFDGHLSDVILNIMSQFVTTALHPILQGFIEAIVKNASNKVVDGVNKVIDEILNPDVIKNFDLTQYQQYLR

SEQ ID NO: 28506 - protein, 260 aa, Diabrotica virgifera
  misc_feature: Coding regions on vcDNA: vcDNA=SeqID_8203; Strand=-; Position=1-780
  misc_feature (1)..(260): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 28507 - protein, 118 aa, Diabrotica virgifera
  misc_feature: Coding regions on vcDNA: vcDNA=SeqID_8204; Strand=+; Position=1-357
DYCIKTISISIQKSSCWYKKALKIFLNWILYACLLSFVCKSFIIHYYIKTISSRIQKSSCWYRKALKIFLNWILYACLLSFVCKSFIIQYCIKTIISRIQKSSCCYIKALKIFLNLVL

SEQ ID NO: 28508 - protein, 259 aa, Diabrotica virgifera
  misc_feature: Coding regions on vcDNA: vcDNA=SeqID_8205; Strand=+; Position=135-914
  misc_feature: Homolog annotation: Hit_ID=XP_393465.1; Match level="QueryCoverage =86%, HitCoverage=87%, E-value=8e-28, Identity=37%"; Hit description =similar to CG32521-PA [Apis mellifera]
  misc_feature: Gene Ontology Annotation: Molecular function=protein binding; Cellular component=extracellular matrix; Biological process=heart development
  misc_feature: Pfam annotation: Pfam_ID=Collagen; Match level="Score=-40.4, E-value =0.034, Copies=1"; Pfam description=Collagen triple helix repeat (20 copi
MNLFQFAIFLGYFSIGYCYTKYGRTCKDIGCPSTQECVMATDPCSYYHRQGECGSYPTCQRVSNAPRTCSTYVCPPTKVCRMDGDTPKCFDDVGKVGHVGYETSGNTNHLSQSGHNGNLYPNLPKGETTPRPNINRPVSSGGYQGGQVGSGYPGGQVNSGYPGGQVGSGYPGGQVGSGYPGGQVGSGYPGGQVGSGYPGYTQQGGYPRQGYPQQGYPQQGYPQQGNQRQTGYHNMDDIHKPTNQARGLHIRQITSGLKS

SEQ ID NO: 28509 - protein, 61 aa, Diabrotica virgifera
  misc_feature: Coding regions on vcDNA: vcDNA=SeqID_8206; Strand=-; Position=14-199
  misc_feature (3)..(11): Xaa can be any naturally occurring amino acid
  misc_feature (13)..(13): Xaa can be any naturally occurring amino acid
  misc_feature (23)..(30): Xaa can be any naturally occurring amino acid
  misc_feature (32)..(41): Xaa can be any naturally occurring amino acid
  misc_feature (43)..(43): Xaa can be any naturally occurring amino acid
  misc_feature (60)..(60): Xaa can be any naturally occurring amino acid
SFXXXXXXXXXDXNQPGSHGFKXXXXXXXXSXXXXXXXXXXIXNLIHIEGRNLYYRFDSXK

SEQ ID NO: 28510 - protein, 74 aa, Diabrotica virgifera
  misc_feature: Coding regions on vcDNA: vcDNA=SeqID_8207; Strand=+; Position=277-501
  misc_feature: Homolog annotation: Hit_ID=XP_319628.1; Match level="QueryCoverage =50%, HitCoverage=9%, E-value=4e-11, Identity=75%"; Hit description =ENSANGP00000013899 [Anopheles gambiae]
  misc_feature: Gene Ontology Annotation: Biological process=growth
MEIQYLTKDHLIGFDNYKYNCIDSGILSIYVMHPFWNWVVKRSQSYTRSLRLLLCWACCTYDQEVSQMIRKLHT

SEQ ID NO: 28511 - protein, 108 aa, Diabrotica virgifera; identical to SEQ ID NO: 27732
  misc_feature: Coding regions on vcDNA: vcDNA=SeqID_8208; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 28512 - protein, 307 aa, Diabrotica virgifera
  misc_feature: Coding regions on vcDNA: vcDNA=SeqID_8209; Strand=+; Position=2-922
  misc_feature: Homolog annotation: Hit_ID=EAA07253.2; Match level="QueryCoverage =96%, HitCoverage=40%, E-value=3e-28, Identity=28%"; Hit description =ENSANGP00000010236 [Anopheles gambiae str. PEST] ref|XP_559022.1| ENSANGP00000010236 [Anopheles gambiae st
  misc_feature: Gene Ontology Annotation: Molecular function=RNA polymerase III transcription factor activity; Cellular component=transcription factor TFIIIC complex; Biological process=transcription from Pol III promoter
  misc_feature (280)..(280): Xaa can be any naturally occurring amino acid
KYAECLASCDMIEQAIDSYYTVKELAPGHVEVLYPLAMLLLKQNQREEALKVMSQDFSANKLDVAVLLEQMKLLKQINNWESYWKCMELLMSRHCPVLKHPEELKILLTKERPPEKLAKLRKMRNFRNDSTSVESNFTVIKELSLEEDYDIYKNILQLSIDRREYCYLQKFTFMGLASKRFQKYFSEVNIMAAFSCLLTNDCFHGYNLLRETLMRYSNNNLAWNWFGIVTATQEELRFARFLERFGGSLPIDNRRIIIANHHLSMGNYINTINFYLKRYXATNSVFAGVMVAVAMLQHYHHKSLDKA

SEQ ID NO: 28513 - protein, 295 aa, Diabrotica virgifera
  misc_feature: Coding regions on vcDNA: vcDNA=SeqID_8210; Strand=-; Position=1-885
  misc_feature (3)..(4): Xaa can be any naturally occurring amino acid
  misc_feature (17)..(17): Xaa can be any naturally occurring amino acid
  misc_feature (23)..(23): Xaa can be any naturally occurring amino acid
  misc_feature (28)..(36): Xaa can be any naturally occurring amino acid
  misc_feature (49)..(49): Xaa can be any naturally occurring amino acid
  misc_feature (52)..(60): Xaa can be any naturally occurring amino acid
  misc_feature (62)..(293): Xaa can be any naturally occurring amino acid
NIXXNKDRTHPGSHRLXLRSCKXLKVEXXXXXXXXXNYKLNPTSRSQSXLSXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDE

SEQ ID NO: 28514 - protein, 120 aa, Diabrotica virgifera
  misc_feature: Coding regions on vcDNA: vcDNA=SeqID_8211; Strand=+; Position=3-365
ISEKLSTGGHVLSPKLTQEESTLIKQIALKAEEDANKKEPHSESKRREESTSGERDDSELRQRISTQVNESVDESILAPAADPLLEDSIQRSNTDKLWTAAIWILITIIALLLIRRIFFL

SEQ ID NO: 28515 - protein, 74 aa, Diabrotica virgifera
  misc_feature: Coding regions on vcDNA: vcDNA=SeqID_8212; Strand=-; Position=196-420
  misc_feature (1)..(8): Xaa can be any naturally occurring amino acid
  misc_feature (38)..(44): Xaa can be any naturally occurring amino acid
XXXXXXXXNREDITKTIISRSNLFKNYMQIESKKQTKXXXXXXXVTVYYIGTRNGHVNSIYSFIANDIDNILLI

SEQ ID NO: 28516 - protein, 66 aa, Diabrotica virgifera; identical to SEQ ID NO: 26808
  misc_feature: Coding regions on vcDNA: vcDNA=SeqID_8213; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28517 - protein, 236 aa, Diabrotica virgifera
  misc_feature: Coding regions on vcDNA: vcDNA=SeqID_8214; Strand=+; Position=197-907
  misc_feature: Homolog annotation: Hit_ID=XP_317211.1; Match level="QueryCoverage =95%, HitCoverage=59%, E-value=7e-39, Identity=38%"; Hit description =ENSANGP00000011408 [Anopheles gambiae]
  misc_feature: Gene Ontology Annotation: Molecular function=galactosyltransferase activity; Cellular component=integral to Golgi membrane; Biological process=glycosphingolipid biosynthesis
  misc_feature: Pfam annotation: Pfam_ID=Gly_transf_sug; Match level="Score=51.4, E -value=2.6e-12, Copies=1"; Pfam description=Glycosyltransferase sugar- binding reg
  misc_feature (191)..(191): Xaa can be any naturally occurring amino acid
  misc_feature (215)..(215): Xaa can be any naturally occurring amino acid
MMKFYFKYRRRWMTFLIYFTLAVITIVLIHSLITEKNTIQCYRIKTEKSLPSIANFNPQPGKSIFFHETSCLSFYRGKIWISSRQACAVESVAKLNPNKEVYLLYTSPMDFKFEGDESDRFLKVILSYPNVKILHLDYENYTRGSPVEDLYRSGKIESSRHVVAHASDVLRYLTLWKYGGLYMDLDVIALXPVDDLEDNYAGIESSSVVASGVLXFDAAGEGHKLVERCLMDSKKI

SEQ ID NO: 28518 - protein, 301 aa, Diabrotica virgifera
  misc_feature: Coding regions on vcDNA: vcDNA=SeqID_8215; Strand=+; Position=48-953
  misc_feature: Homolog annotation: Hit_ID=XP_316463.1; Match level="QueryCoverage =96%, HitCoverage=22%, E-value=1e-41, Identity=32%"; Hit description =ENSANGP00000004277 [Anopheles gambiae]
  misc_feature: Gene Ontology Annotation: Molecular function=15-hydroxyprostaglandin dehydrogenase (NAD+) activity; Cellular component=cellular_component unknown; Biological process=biological_process unknown
  misc_feature (201)..(218): Xaa can be any naturally occurring amino acid
  misc_feature (273)..(273): Xaa can be any naturally occurring amino acid
  misc_feature (281)..(281): Xaa can be any naturally occurring amino acid
  misc_feature (284)..(284): Xaa can be any naturally occurring amino acid
  misc_feature (288)..(288): Xaa can be any naturally occurring amino acid
  misc_feature (292)..(292): Xaa can be any naturally occurring amino acid
MDSSKRNAKETNPRTKASIFRLLTFFYNYPLFKKARKKGLDDSDIYEIPKWLASEQLGNNLEDAWMRQRKKKGEDASLVRCLFSCFGMQYLILGLIQLVVKTVLVFIQPRALSKVVAYYAPNQTDVTTKDLYIYASLVVGLNVFSVIYNHNYQQFTTEVGIRVRTSVAALVYRKAVKLGPNAWNHVTVGKIVTLITKDVFXXXXXXXXXXXXXXXXXXTIIITGVIFNRIQWSVFGGIGFYMLTIPLQLFVGKVVSSKRVQSAKRTDERLQLXTETIRNIXTIXMYTXENFXTTKLNELRK

SEQ ID NO: 28519 - protein, 22 aa, Diabrotica virgifera
  misc_feature: Coding regions on vcDNA: vcDNA=SeqID_8216; Strand=-; Position=1-66
  misc_feature (5)..(13): Xaa can be any naturally occurring amino acid
  misc_feature (16)..(16): Xaa can be any naturally occurring amino acid
  misc_feature (22)..(22): Xaa can be any naturally occurring amino acid
KLRCXXXXXXXXXQKXWIKKLX

SEQ ID NO: 28520 - protein, 76 aa, Diabrotica virgifera
  misc_feature: Coding regions on vcDNA: vcDNA=SeqID_8217; Strand=-; Position=452-682
HLQSVWMTAFIKGPCITLCKSLMLYFTVVQHMFDCFKFPTANSSTVCCMQMSSNVVYYSELIPVCFLQYFSPSSAS

SEQ ID NO: 28521 - protein, 282 aa, Diabrotica virgifera
  misc_feature: Coding regions on vcDNA: vcDNA=SeqID_8218; Strand=+; Position=2-849
  misc_feature: Homolog annotation: Hit_ID=EAL34170.1; Match level="QueryCoverage =88%, HitCoverage=66%, E-value=6e-27, Identity=32%"; Hit description =GA16592-PA [Drosophila pseudoobscura]
  misc_feature: Gene Ontology Annotation: Molecular function=molecular_function unknown
  misc_feature: Pfam annotation: Pfam_ID=DUF227; Match level="Score=57.1, E-value =5.1e-14, Copies=1"; Pfam description=Domain of unknown function (DUF227)
  misc_feature (58)..(65): Xaa can be any naturally occurring amino acid
  misc_feature (128)..(134): Xaa can be any naturally occurring amino acid
  misc_feature (211)..(211): Xaa can be any naturally occurring amino acid
  misc_feature (235)..(235): Xaa can be any naturally occurring amino acid
EIRDLEELLGIKEEVRNVDITSLTAPGDNFGSLMLKVDVTLKDKILHLVAKKIPQSVXXXXXXXXQVTYRKEVELYKSIVPILEEFAKKRLEFFPRYYASRYNLKDNDDVIDEDAVLVLENLAVLGYXXXXXXXGFDLQNALLFLEDLAKFHAVPLAFKLKHPNEFDEKIKKLCFNTVFTDAKRYGILNEASRKIVSECNSISHLADKILXSHVNNMQPVSDAYGTLIHFDLWVXNIMVNLKDGRSVGNKLVDFQVYSYGSPASDVLFFFLTVFKIRHRTSR

SEQ ID NO: 28522 - protein, 106 aa, Diabrotica virgifera
  misc_feature: Coding regions on vcDNA: vcDNA=SeqID_8219; Strand=-; Position=2-319
  misc_feature (34)..(106): Xaa can be any naturally occurring amino acid
YSCYTIINLIQHRGRNLYYRCELSNKITLLSVRXXXXXXXXXXXXXXXXXXXXXXXXXXXXXXXXXXXXXXXXXXXXXXXXXXXXXXXXXXXXXXXXXXXXXXXXX

SEQ ID NO: 28523 - protein, 53 aa, Diabrotica virgifera
  misc_feature: Coding regions on vcDNA: vcDNA=SeqID_8220; Strand=-; Position=120-281
PELHPKPVLVFFSSCFDPSQHRNLYIPLSSQPLFAHSITLGPEIERCHEGETC

SEQ ID NO: 28524 - protein, 38 aa, Diabrotica virgifera
  misc_feature: Coding regions on vcDNA: vcDNA=SeqID_8221; Strand=-; Position=1-114
  misc_feature (2)..(37): Xaa can be any naturally occurring amino acid
SXXXXXXXXXXXXXXXXXXXXXXXXXXXXXXXXXXXXL

SEQ ID NO: 28525 - protein, 72 aa, Diabrotica virgifera
  misc_feature: Coding regions on vcDNA: vcDNA=SeqID_8222; Strand=+; Position=77-295
  misc_feature (24)..(29): Xaa can be any naturally occurring amino acid
LETTYTSIIFHNKRAKKYIFLLQXXXXXXDSCNEMFLASVYIRSFTTRVAILINNIIIVIYLYIICFVYLYA

SEQ ID NO: 28526 - protein, 66 aa, Diabrotica virgifera; identical to SEQ ID NO: 26808
  misc_feature: Coding regions on vcDNA: vcDNA=SeqID_8223; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28527 - protein, 102 aa, Diabrotica virgifera
  misc_feature: Coding regions on vcDNA: vcDNA=SeqID_8224; Strand=-; Position=107-415
  misc_feature: Pfam annotation: Pfam_ID=CBM_14; Match level="Score=43.9, E-value =4.6e-10, Copies=1"; Pfam description=Chitin binding Peritrophin-A domain
LEHVLLHCFHPILFFLLSSDHFGLLSRTPLLYLLYPYILISSPSVDGRYPVYLPDATSCSTFYECFNGTPYQFKCAYGTYFDSQSRICRHKRDVNCGSRRRD

SEQ ID NO: 28528 - protein, 70 aa, Diabrotica virgifera
  misc_feature: Coding regions on vcDNA: vcDNA=SeqID_8225; Strand=+; Position=247-459
VKLFMMLTFSEPAKQSWVLSRGEKIVSISKNEAAKLKNQDILAINFLFQNFKNEFQGSILNEENGYATLL

SEQ ID NO: 28529 - protein, 74 aa, Diabrotica virgifera
  misc_feature: Coding regions on vcDNA: vcDNA=SeqID_8226; Strand=-; Position=308-532
  misc_feature (32)..(40): Xaa can be any naturally occurring amino acid
  misc_feature (54)..(60): Xaa can be any naturally occurring amino acid
HSPLRHHFLLKNFCDVNETTKNCTHKKKYMSXXXXXXXXXVQFPAISLMSQKFXXXXXXXLKGEGQFAKCYTDT

SEQ ID NO: 28530 - protein, 265 aa, Diabrotica virgifera
  misc_feature: Coding regions on vcDNA: vcDNA=SeqID_8227; Strand=+; Position=60-854
  misc_feature: Homolog annotation: Hit_ID=EAA13001.3; Match level="QueryCoverage =78%, HitCoverage=68%, E-value=1e-48, Identity=45%"; Hit description =ENSANGP00000019985 [Anopheles gambiae str. PEST] ref|XP_554841.1| ENSANGP00000019985 [Anopheles gambiae st
  misc_feature: Gene Ontology Annotation: Molecular function=3'-5' exoribonuclease activity; Cellular component=CCR4-NOT core complex; Biological process=poly(A) tail shortening
  misc_feature: Pfam annotation: Pfam_ID=Exo_endo_phos; Match level="Score=47.1, E -value=5.2e-11, Copies=1"; Pfam description =Endonuclease/Exonuclease/phosphatase f
MASVDISVGTNIMSLRLWENTCDNVSRTPGFIFTLMSYNVLAQDLVELHPYLYKEHDSAALSWPTRWKNLFEEISKFKPDILCLQEVQESHIADYYSTLKILGYDGIFKKRTGGQSDGCAIYYKSDKVEMLDYTLAQFYQSDIAVLNRDNVGIVAKFVPKLHPTREFVVATTHLLYNPRRHDVRMAQMHLLMTDIEKMSYKNDEGNIHYLPIILTGDFNSPPHSDLYEFITHGNIKYEHLAEPLKTPGDHRRQQLVTSSLGITDS

SEQ ID NO: 28531 - protein, 28 aa, Diabrotica virgifera
  misc_feature: Coding regions on vcDNA: vcDNA=SeqID_8228; Strand=+; Position=2-85
  misc_feature (4)..(18): Xaa can be any naturally occurring amino acid
  misc_feature (23)..(23): Xaa can be any naturally occurring amino acid
  misc_feature (26)..(27): Xaa can be any naturally occurring amino acid
SFIXXXXXXXXXXXXXXXNYLIXGDXXN

SEQ ID NO: 28532 - protein, 308 aa, Diabrotica virgifera
  misc_feature: Coding regions on vcDNA: vcDNA=SeqID_8229; Strand=+; Position=2-925
  misc_feature: Homolog annotation: Hit_ID=EAA44350.2; Match level="QueryCoverage =96%, HitCoverage=31%, E-value=2e-47, Identity=37%"; Hit description =ENSANGP00000023272 [Anopheles gambiae str. PEST] ref|XP_557727.1| ENSANGP00000023272 [Anopheles gambiae st
  misc_feature: Gene Ontology Annotation: Cellular component=endoplasmic reticulum
  misc_feature: Pfam annotation: Pfam_ID=Glyco_hydro_38C; Match level="Score=53.3, E -value=6.7e-13, Copies=1"; Pfam description=Glycosyl hydrolases family 38 C-termi
  misc_feature (258)..(258): Xaa can be any naturally occurring amino acid
  misc_feature (282)..(282): Xaa can be any naturally occurring amino acid
  misc_feature (286)..(286): Xaa can be any naturally occurring amino acid
  misc_feature (297)..(297): Xaa can be any naturally occurring amino acid
  misc_feature (299)..(299): Xaa can be any naturally occurring amino acid
SNFSHVKIKGETPSAFELVFAAKDIPPMGFKLYYIQKTSATRDAKQEEEGDSDDITTFVMNDNDNTLQSVILNDLNMDITQNFYYYVSDDGNSSGVASGAYIFRPVAPGTANPVSPAQINKIFQKAGKVVDEVHQVWTSEEAEILQIIRHYKNESYIEFDWIIGNINITDNKGKEFISKYTINSNFNNNNVFYTDSNGRELIKRVKNKRSDYTYDPEVEPVSSNYYPVTSRIVIKDEDQDIEVAVLTDRSEGGSSLSXNELELMVHRRILHDDHKGVDENLXEIEXDTGVYVRSTHXLXYRKANKSNL

SEQ ID NO: 28533 - protein, 58 aa, Diabrotica virgifera
  misc_feature: Coding regions on vcDNA: vcDNA=SeqID_8230; Strand=+; Position=587-760
MDVATVIKRIHTPCSSTASEKHGLEYTDKKAGLASTKRSCPLRRRQKPYSMKTYACFE

SEQ ID NO: 28534 - protein, 73 aa, Diabrotica virgifera
  misc_feature: Coding regions on vcDNA: vcDNA=SeqID_8231; Strand=-; Position=46-267
  misc_feature (8)..(14): Xaa can be any naturally occurring amino acid
  misc_feature (21)..(28): Xaa can be any naturally occurring amino acid
  misc_feature (69)..(72): Xaa can be any naturally occurring amino acid
SIYSSIFXXXXXXXPYIYFIXXXXXXXXLNHHSYFPIHYFYNIIFIFYIGTPSPPPPFLFPSSFPLLFXXXXL

SEQ ID NO: 28535 - protein, 80 aa, Diabrotica virgifera
  misc_feature: Coding regions on vcDNA: vcDNA=SeqID_8232; Strand=+; Position=181-423
SHRGPIILYKDAYRYASRALHAVCSPRVSGADRSWIVVRCVHAVCVPLKNAYSLQSARRVYLHIHTFSSKNRFVLISKQF

SEQ ID NO: 28536 - protein, 260 aa, Diabrotica virgifera
  misc_feature: Coding regions on vcDNA: vcDNA=SeqID_8233; Strand=-; Position=3-782
  misc_feature (1)..(23): Xaa can be any naturally occurring amino acid
  misc_feature (26)..(36): Xaa can be any naturally occurring amino acid
  misc_feature (46)..(53): Xaa can be any naturally occurring amino acid
  misc_feature (56)..(69): Xaa can be any naturally occurring amino acid
  misc_feature (75)..(88): Xaa can be any naturally occurring amino acid
  misc_feature (90)..(257): Xaa can be any naturally occurring amino acid
XXXXXXXXXXXXXXXXXXXXXXXPFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVKF

SEQ ID NO: 28537 - protein, 101 aa, Diabrotica virgifera
  misc_feature: Coding regions on vcDNA: vcDNA=SeqID_8234; Strand=-; Position=273-578
RQVYICALLGVRAARAQHVRQFSTCFQVAHKRHAHGAPQSNFCRFFNKSFDGSQYVFGRVCEWFVGFGAPELKISKKTFINQKFNSVSGEATQLEKTDIIL

SEQ ID NO: 28538 - protein, 34 aa, Diabrotica virgifera
  misc_feature: Coding regions on vcDNA: vcDNA=SeqID_8235; Strand=-; Position=1-102
  misc_feature (3)..(15): Xaa can be any naturally occurring amino acid
  misc_feature (18)..(34): Xaa can be any naturally occurring amino acid
SVXXXXXXXXXXXXXFNXXXXXXXXXXXXXXXXX

SEQ ID NO: 28539 - protein, 133 aa, Diabrotica virgifera
  misc_feature: Coding regions on vcDNA: vcDNA=SeqID_8236; Strand=+; Position=196-596
  misc_feature: Homolog annotation: Hit_ID=XP_313990.1; Match level="QueryCoverage =97%, HitCoverage=76%, E-value=4e-46, Identity=69%"; Hit description =ENSANGP00000009967 [Anopheles gambiae]
  misc_feature: Gene Ontology Annotation: Biological process=lipid metabolism
  misc_feature (115)..(115): Xaa can be any naturally occurring amino acid
MAREQVTRKWEIFQGRNRFYCNGRLMTAPHSGVFLLTLFLITVTSVLFFVFDCKYLAENVTIAIPIIGALLFLFTVSSLLRTSLSDPGIIPRASSKEAAYVEKQIKVTNSANSAXTIEPPTRTKEVFVKGQTI

SEQ ID NO: 28540 - protein, 101 aa, Diabrotica virgifera
  misc_feature: Coding regions on vcDNA: vcDNA=SeqID_8237; Strand=-; Position=1-303
  misc_feature (1)..(6): Xaa can be any naturally occurring amino acid
  misc_feature (16)..(101): Xaa can be any naturally occurring amino acid
XXXXXXELSNKITLLXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 28541 - protein, 83 aa, Diabrotica virgifera
  misc_feature: Coding regions on vcDNA: vcDNA=SeqID_8238; Strand=-; Position=97-348
HFIDRSGYLPHEMQVSPNHDNILVLNKFRIKWLQTIAFVVSKCRFQIWFQETKLHKNLSVDRLQVLQWLLRTNERTYIFYVGN

SEQ ID NO: 28542 - protein, 25 aa, Diabrotica virgifera
  misc_feature: Coding regions on vcDNA: vcDNA=SeqID_8239; Strand=-; Position=1-78
  misc_feature (1)..(24): Xaa can be any naturally occurring amino acid
XXXXXXXXXXXXXXXXXXXXXXXXK

SEQ ID NO: 28543 - protein, 38 aa, Diabrotica virgifera
  misc_feature: Coding regions on vcDNA: vcDNA=SeqID_8240; Strand=-; Position=0-113
  misc_feature (1)..(35): Xaa can be any naturally occurring amino acid
XXXXXXXXXXXXXXXXXXXXXXXXXXXXXXXXXXXLLT

SEQ ID NO: 28544 - protein, 218 aa, Diabrotica virgifera
  misc_feature: Coding regions on vcDNA: vcDNA=SeqID_8241; Strand=-; Position=538-1194
  misc_feature (1)..(24): Xaa can be any naturally occurring amino acid
  misc_feature (31)..(72): Xaa can be any naturally occurring amino acid
  misc_feature (76)..(114): Xaa can be any naturally occurring amino acid
  misc_feature (117)..(188): Xaa can be any naturally occurring amino acid
XXXXXXXXXXXXXXXXXXXXXXXXLWCFQGXXXXXXXXXXXXXXXXXXXXXXXXXXXXXXXXXXXXXXXXXXKCYXXXXXXXXXXXXXXXXXXXXXXXXXXXXXXXXXXXXXXXGEXXXXXXXXXXXXXXXXXXXXXXXXXXXXXXXXXXXXXXXXXXXXXXXXXXXXXXXXXXXXXXXXXXXXXXXXLIKEFGNIFFTCLLKTCLFVLNIKSRLPTD

SEQ ID NO: 28545 - protein, 68 aa, Diabrotica virgifera
  misc_feature: Coding regions on vcDNA: vcDNA=SeqID_8242; Strand=-; Position=243-449
VCSFVLSVTLVLEKCKKSVTLSCFFVFLVLTLFFFTIHSTSVVERVQLVSLKCCRKKSVKCTLHQQES

SEQ ID NO: 28546 - protein, 78 aa, Diabrotica virgifera
  misc_feature: Coding regions on vcDNA: vcDNA=SeqID_8243; Strand=-; Position=602-838
  misc_feature (1)..(5): Xaa can be any naturally occurring amino acid
XXXXXETKLKLNCRQYSLLYEGLRYMDGGHDESLNGGPETIKRHKEYRETGYERSSQCKEHWKELREVYVQQWTRLAD

SEQ ID NO: 28547 - protein, 114 aa, Diabrotica virgifera
  misc_feature: Coding regions on vcDNA: vcDNA=SeqID_8244; Strand=+; Position=328-672
HKRGATLPPNVSRRRNFTINEKIKNTYEVDDIVIWGRQRLCFWWPYKRIGCTILYFMNIVLLSRFIDSYIKDYKRDLIEGRLCIVWLIVNSSERKKTAYGKEYIRNSTSKHYCY

SEQ ID NO: 28548 - protein, 92 aa, Diabrotica virgifera
  misc_feature: Coding regions on vcDNA: vcDNA=SeqID_8245; Strand=-; Position=1-276
  misc_feature (1)..(92): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 28549 - protein, 80 aa, Diabrotica virgifera
  misc_feature: Coding regions on vcDNA: vcDNA=SeqID_8246; Strand=-; Position=105-347
KAVLDLTVCKSVWRDNEWNRFLCPNYFIVGLISTSMNIIYSPSIYTPCILLCYFCYTHSMKLIKNYTHSINHLVSLCELF

SEQ ID NO: 28550 - protein, 94 aa, Diabrotica virgifera
  misc_feature: Coding regions on vcDNA: vcDNA=SeqID_8247; Strand=+; Position=191-475
QKSGYSKWKYSINCITQQKSSSSNFFFFLSFFLFRNRCSLIFIATHICTSGLLYLYLSLPSFMPHNPFIFSSSKIFKQLNPSFQIVFISTSNMT

SEQ ID NO: 28551 - protein, 65 aa, Diabrotica virgifera
  misc_feature: Coding regions on vcDNA: vcDNA=SeqID_8248; Strand=-; Position=2-196
  misc_feature (3)..(10): Xaa can be any naturally occurring amino acid
  misc_feature (22)..(29): Xaa can be any naturally occurring amino acid
  misc_feature (32)..(39): Xaa can be any naturally occurring amino acid
  misc_feature (51)..(64): Xaa can be any naturally occurring amino acid
AFXXXXXXXXDRNHLGSPGLNXXXXXXXXRTXXXXXXXXQIINFNPTSRSXXXXXXXXXXXXXXV

SEQ ID NO: 28552 - protein, 36 aa, Diabrotica virgifera
  misc_feature: Coding regions on vcDNA: vcDNA=SeqID_8249; Strand=-; Position=147-257
  misc_feature (3)..(12): Xaa can be any naturally occurring amino acid
DKXXXXXXXXXXTVNYAVLKKWFYWDFGRVELNFYF

SEQ ID NO: 28553 - protein, 295 aa, Diabrotica virgifera
  misc_feature: Coding regions on vcDNA: vcDNA=SeqID_8250; Strand=+; Position=45-932
  misc_feature: Homolog annotation: Hit_ID=AAH67979.1; Match level="QueryCoverage =77%, HitCoverage=33%, E-value=1e-87, Identity=64%"; Hit description =Hypothetical protein MGC69247 [Xenopus tropicalis] ref|NP_998842.1| hypothetical protein MGC69247 [Xenopus
  misc_feature: Gene Ontology Annotation: Molecular function=molecular_function unknown; Cellular component=cellular_component unknown; Biological process=biological_process unknown
MQVSDPNNIKIYNLSAGKSLPEWLSERKRRALLKKNVDIRRRIELIQDFDMPGLSSAVRVSKDGQYILATGIYKPRIKCFDVNNLSLKFERCFDAEAVTFQILSDDYSKLIFLQCDRYIEFHAAYGRYYRLRIPKFGRDLQYDFPSCDVFVVGASSDIYRLNLERGQFMTPYTSTASSINKCTINPAHHLLLCGTQEGKVEAWDQRTKTMVGSLDCALTCLSENKEVKNEIWNNISVDPSVVKRKWLDIINKQHQNQNVSQTIYPQIWKQFPTKNANFIYGYYHYIFSYIMHRRK

SEQ ID NO: 28554 - protein, 171 aa, Diabrotica virgifera
  misc_feature: Coding regions on vcDNA: vcDNA=SeqID_8251; Strand=+; Position=2-712
  misc_feature: Homolog annotation: Hit_ID=AAF87759.1; Match level="QueryCoverage =100%, HitCoverage=55%, E-value=3e-68, Identity=63%"; Hit description= cytochrome oxidase subunit I [Diabrotica virgifera virgifera]
  misc_feature: Pfam annotation: Pfam_ID=COX1; Match level="Score=-104.4, E-value =1.1e-07, Copies=1"; Pfam description=Cytochrome C and Quinol oxidase polyp
  misc_feature (34)..(34): Xaa can be any naturally occurring amino acid
  misc_feature (88)..(88): Xaa can be any naturally occurring amino acid
  misc_feature (123)..(123): Xaa can be any naturally occurring amino acid
AGISSILGAINFITTVINIRPIGITFDRIPLFVXAVVITAILLLLSLPVLAGAITILLTDRNLNTSFFDPAGIIYAIIAIGLLGFIVXAHHIFTVGMDVDTRAYFTSATIIIAVPTGIKVFRXLATYHGTTITYRLTGVVLANSSIDIVLHDTYYVVAIGAVFAIIAGFIQ

SEQ ID NO: 28555 - protein, 36 aa, Diabrotica virgifera
  misc_feature: Coding regions on vcDNA: vcDNA=SeqID_8252; Strand=+; Position=12-122
  misc_feature (2)..(10): Xaa can be any naturally occurring amino acid
TXXXXXXXXXLYELVTHDHGCVLDRVHKRCLIEVRC

SEQ ID NO: 28556 - protein, 247 aa, Diabrotica virgifera
  misc_feature: Coding regions on vcDNA: vcDNA=SeqID_8253; Strand=+; Position=141-884
  misc_feature: Homolog annotation: Hit_ID=XP_315587.1; Match level="QueryCoverage =93%, HitCoverage=33%, E-value=2e-25, Identity=32%"; Hit description =ENSANGP00000017876 [Anopheles gambiae]
  misc_feature (233)..(234): Xaa can be any naturally occurring amino acid
  misc_feature (236)..(236): Xaa can be any naturally occurring amino acid
MASKETTPTTKKVNTDLITPHRLTVSILIKSFCLFRDDEKFKEMEDQALMCKYRRDFCVLTLRLIQSPDLPLFDLRKLLTSKKYVIPDSLIESFDQTLATLNEEGIGNLLDIVDTLLKIMDKSDDPLNSNSAIAKTSIAGYYLRRFIVFFEKLTFSEVAKVYEDFQRYYNELEKSAKHIQTDEEPADNWLNTKENWSRRQAELFIATQAALLSNDEEKALPPPELQKRIVNIXXSXPDLSGAHFVPY

SEQ ID NO: 28557 - protein, 195 aa, Diabrotica virgifera
  misc_feature: Coding regions on vcDNA: vcDNA=SeqID_8254; Strand=+; Position=83-667
  misc_feature: Homolog annotation: Hit_ID=XP_311046.1; Match level="QueryCoverage =90%, HitCoverage=27%, E-value=8e-54, Identity=59%"; Hit description =ENSANGP00000019882 [Anopheles gambiae]
  misc_feature: Gene Ontology Annotation: Molecular function=alpha-16 -mannosyltransferase activity; Cellular component=cellular_component unknown; Biological process=dolichol-linked oligosaccharide biosynthesis
  misc_feature (78)..(86): Xaa can be any naturally occurring amino acid
MSQIMLIIASAYLVYCPFTKVEESFNLQAIHDILYHGFNLTQYDHLEFPGVVPRTFIGPLFISALASPVVAVLQLLNXXXXXXXXXVRTILATCVVYSFNILSKTLEKQFGTRWLQWFIAITVTQSHFMFYLSRPLPNIFALPLVLLALDGWLHNNNKTFILCSGAAIIIFRAELTVTNSWSRDKLHFFGKDPYW

SEQ ID NO: 28558 - protein, 44 aa, Diabrotica virgifera
  misc_feature: Coding regions on vcDNA: vcDNA=SeqID_8255; Strand=-; Position=3-134
  misc_feature (11)..(24): Xaa can be any naturally occurring amino acid
  misc_feature (26)..(26): Xaa can be any naturally occurring amino acid
  misc_feature (31)..(43): Xaa can be any naturally occurring amino acid
TQIMYNLKVDXXXXXXXXXXXXXXSXIEVAXXXXXXXXXXXXXC

SEQ ID NO: 28559 - protein, 178 aa, Diabrotica virgifera
  misc_feature: Coding regions on vcDNA: vcDNA=SeqID_8256; Strand=-; Position=1-534
  misc_feature (27)..(28): Xaa can be any naturally occurring amino acid
  misc_feature (36)..(178): Xaa can be any naturally occurring amino acid
LLHNYNLNPHRGRIFISIDSPINYAVXXGNLFYIKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 28560 - protein, 90 aa, Diabrotica virgifera
  misc_feature: Coding regions on vcDNA: vcDNA=SeqID_8257; Strand=-; Position=2-274
  misc_feature (2)..(24): Xaa can be any naturally occurring amino acid
EXXXXXXXXXXXXXXXXXXXXXXXSLHLLRRKAHFGVLGTQASATGRLPSLLFDSCHPLSRHTKCLKPPAPEGPGNPAPPAGGHLPYRSR

SEQ ID NO: 28561 - protein, 46 aa, Diabrotica virgifera
  misc_feature: Coding regions on vcDNA: vcDNA=SeqID_8258; Strand=-; Position=1-138
  misc_feature (3)..(10): Xaa can be any naturally occurring amino acid
  misc_feature (12)..(20): Xaa can be any naturally occurring amino acid
  misc_feature (32)..(44): Xaa can be any naturally occurring amino acid
LNXXXXXXXXSXXXXXXXXXPIINLIHIEGRXXXXXXXXXXXXXLL

SEQ ID NO: 28562 - protein, 66 aa, Diabrotica virgifera
  misc_feature: Coding regions on vcDNA: vcDNA=SeqID_8259; Strand=-; Position=2-199
  misc_feature (2)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PXXXXXXXXXXXXTNLAHTGLNXXXXXXXXSNXXXXXXXXXXXXXXPTSRSXXXXXXXXXXXXXXV

SEQ ID NO: 28563 - protein, 90 aa, Diabrotica virgifera
  misc_feature: Coding regions on vcDNA: vcDNA=SeqID_8260; Strand=+; Position=1-273
  misc_feature (2)..(19): Xaa can be any naturally occurring amino acid
  misc_feature (22)..(55): Xaa can be any naturally occurring amino acid
  misc_feature (57)..(73): Xaa can be any naturally occurring amino acid
DXXXXXXXXXXXXXXXXXXGMXXXXXXXXXXXXXXXXXXXXXXXXXXXXXXXXXXDXXXXXXXXXXXXXXXXXILVGMMILIITPVVYYT

SEQ ID NO: 28564 - protein, 85 aa, Diabrotica virgifera
  misc_feature: Coding regions on vcDNA: vcDNA=SeqID_8261; Strand=-; Position=99-356
  misc_feature (19)..(47): Xaa can be any naturally occurring amino acid
  misc_feature (51)..(59): Xaa can be any naturally occurring amino acid
PPPPSLLKNTFGGSLFRGXXXXXXXXXXXXXXXXXXXXXXXXXXXXXALWXXXXXXXXXERNPTWLPPRLNSDQVKFKSRTDLLL

SEQ ID NO: 28565 - protein, 36 aa, Diabrotica virgifera
  misc_feature: Coding regions on vcDNA: vcDNA=SeqID_8262; Strand=-; Position=1-108
  misc_feature (7)..(33): Xaa can be any naturally occurring amino acid
NGSKIIXXXXXXXXXXXXXXXXXXXXXXXXXXXLKN

SEQ ID NO: 28566 - protein, 64 aa, Diabrotica virgifera
  misc_feature: Coding regions on vcDNA: vcDNA=SeqID_8263; Strand=-; Position=536-730
CSNPIFSVLSQIFLNCSRFLIIVLIKSSICLIQNTMSIDFICKMSNKRSVKGKISAKNLNRNIL

SEQ ID NO: 28567 - protein, 35 aa, Diabrotica virgifera
  misc_feature: Coding regions on vcDNA: vcDNA=SeqID_8264; Strand=+; Position=2-109
IYFLHNTKHHLILIHPTLNYTLIAVLKVYSTDSIT

SEQ ID NO: 28568 - protein, 27 aa, Diabrotica virgifera
  misc_feature: Coding regions on vcDNA: vcDNA=SeqID_8265; Strand=+; Position=1-84
FISFRKEEFYFQLGRYYCECREYIVGL

SEQ ID NO: 28569 - protein, 79 aa, Diabrotica virgifera; identical to SEQ ID NO: 27306
  misc_feature: Coding regions on vcDNA: vcDNA=SeqID_8266; Strand=-; Position=2-238
  misc_feature (1)..(13): Xaa can be any naturally occurring amino acid
  misc_feature (16)..(26): Xaa can be any naturally occurring amino acid
  misc_feature (36)..(43): Xaa can be any naturally occurring amino acid
  misc_feature (46)..(59): Xaa can be any naturally occurring amino acid
  misc_feature (65)..(78): Xaa can be any naturally occurring amino acid

SEQ ID NO: 28570 - protein, 141 aa, Diabrotica virgifera
  misc_feature: Coding regions on vcDNA: vcDNA=SeqID_8267; Strand=+; Position=2-427
  misc_feature: Homolog annotation: Hit_ID=XP_320267.1; Match level="QueryCoverage =82%, HitCoverage=80%, E-value=1e-30, Identity=50%"; Hit description =ENSANGP00000016675 [Anopheles gambiae]
  misc_feature: Gene Ontology Annotation: Molecular function=molecular_function unknown; Cellular component=Golgi membrane; Biological process =vesicle-mediated transport
  misc_feature: Pfam annotation: Pfam_ID=SNARE; Match level="Score=46.4, E-value=8.2e- 11, Copies=1"; Pfam description=SNARE domain
SIFIQKTKFCKYIFSLFFKVIKRYLTVAAYKMRRAHAGNYYEPLPQASNEIEDENDRMTNDLQEKIGVLKSLTIDIGNEVKYQDRMLRDVDDDLDKTGGFLGTTMSRVLRLSKGSHNYLILYLFVVSVVVFFILYLVIKFR

SEQ ID NO: 28571 - protein, 318 aa, Diabrotica virgifera
  misc_feature: Coding regions on vcDNA: vcDNA=SeqID_8268; Strand=-; Position=2-955
  misc_feature: Homolog annotation: Hit_ID=CAA10770.1; Match level="QueryCoverage =87%, HitCoverage=81%, E-value=1e-40, Identity=36%"; Hit description =reverse transcriptase-like [Bos taurus]
  misc_feature: Pfam annotation: Pfam_ID=RVT_1; Match level="Score=-8.5, E-value =0.00047, Copies=1"; Pfam description=Reverse transcriptase (RNA -dependent
  misc_feature (59)..(59): Xaa can be any naturally occurring amino acid
  misc_feature (61)..(68): Xaa can be any naturally occurring amino acid
  misc_feature (76)..(76): Xaa can be any naturally occurring amino acid
  misc_feature (287)..(287): Xaa can be any naturally occurring amino acid
MFRCPGHLCLLPRLYKGIRYGEKHNLIKLLRTKNIDTRDIRIINNLYYEQEAVIRINNXNXXXXXXXXSVRQGCVXSPSLFNAYSEKIFKKALEDEVAGIKINGLPICEIRYADDTILIAETITDLQRILDKVVGMSEEFGLSLNIKKTKFMVISKKNIRNINLHVNNKTIERVQNYNYLGTNISETNDYTKEIRIRIEKARSAFTNMKQILCSRDLSLNLRKRVLKCYVFFVLLYGVDTWTLNKQCLNRLEAFEMWTYRRMPRISWTDTITNEEVLRRMQNSREIXGFHQNKLQYLGHITRGDRYELLKLIMQGKIQ

SEQ ID NO: 28572 - protein, 53 aa, Diabrotica virgifera
  misc_feature: Coding regions on vcDNA: vcDNA=SeqID_8269; Strand=-; Position=2-160
  misc_feature (27)..(32): Xaa can be any naturally occurring amino acid
  misc_feature (40)..(47): Xaa can be any naturally occurring amino acid
SGSRGRGRADFCVNRISWSLTILICYXXXXXXVSYREECXXXXXXXXRGRGAR

SEQ ID NO: 28573 - protein, 215 aa, Diabrotica virgifera
  misc_feature: Coding regions on vcDNA: vcDNA=SeqID_8270; Strand=+; Position=45-692
  misc_feature: Homolog annotation: Hit_ID=EAL40632.1; Match level="QueryCoverage =83%, HitCoverage=36%, E-value=3e-12, Identity=28%"; Hit description =ENSANGP00000006819 [Anopheles gambiae str. PEST] ref|XP_558714.1| ENSANGP00000006819 [Anopheles gambiae st
  misc_feature: Pfam annotation: Pfam_ID=RnaseH; Match level="Score=22.5, E-value =3.7e-06, Copies=1"; Pfam description=RNase H
FIELNYLTGTFQAICSTHKKLETYTHQEFLNEFSASYGNYTWVFTDGSLDPESRTVGFGVHIPSINYNYASRLHEHTQICTAEIIAINKAVSVAIIFSDAKSAIQKLHNTTWGTNNHIVNLTKRLIIENIILAWIPGHTGVKGNTEADKLANIGKTLNVPADIKIDKFDFLPFEFKVEWTKQFKTKGKWYQQCQSDFSINPWFHKFTFVALNINY

SEQ ID NO: 28574 - protein, 66 aa, Diabrotica virgifera
  misc_feature: Coding regions on vcDNA: vcDNA=SeqID_8271; Strand=-; Position=2-199
  misc_feature (3)..(13): Xaa can be any naturally occurring amino acid
  misc_feature (22)..(30): Xaa can be any naturally occurring amino acid
  misc_feature (33)..(40): Xaa can be any naturally occurring amino acid
  misc_feature (45)..(45): Xaa can be any naturally occurring amino acid
  misc_feature (52)..(65): Xaa can be any naturally occurring amino acid
VLXXXXXXXXXXXNHLGSHRFXXXXXXXXXSNXXXXXXXXPIINXNPTSRSXXXXXXXXXXXXXXV

SEQ ID NO: 28575 - protein, 295 aa, Diabrotica virgifera
  misc_feature: Coding regions on vcDNA: vcDNA=SeqID_8272; Strand=+; Position=22-904
  misc_feature: Homolog annotation: Hit_ID=XP_393651.1; Match level="QueryCoverage =100%, HitCoverage=84%, E-value=2e-76, Identity=48%"; Hit description= similar to hypothetical protein MG01114.4 [Apis mellifera]
  misc_feature: Gene Ontology Annotation: Molecular function=oxidoreductase activity, acting on the CH-OH group of donors, NAD or NADP as acceptor; Cellular component=cellular_component unknown; Biological process =biological_process unknown
  misc_feature: Pfam annotation: Pfam_ID=ADH_zinc_N; Match level="Score=76.3, E-value= 8.5e-20, Copies=1"; Pfam description=Zinc-binding dehydrogenase
  misc_feature (56)..(67): Xaa can be any naturally occurring amino acid
  misc_feature (265)..(265): Xaa can be any naturally occurring amino acid
  misc_feature (274)..(274): Xaa can be any naturally occurring amino acid
  misc_feature (286)..(286): Xaa can be any naturally occurring amino acid
MEALRFTSKIKKLELVNVPIPKITQPNQVLIKVAYSGICGTDLHIIGGEFPCNDAXXXXXXXXXXXXVVETGASVNTFKKGDKVSVDPNSGCLCCDHCHSGNPHYCSIGGISNTIGIFRNGGWANYCVAPVDQVHKLSDSITLEQAALAEPLSCLAHGWDIISPVTVGQKILITGAGIIGNLWVCNLHLQGHKNVTVSEPNLARLDMIKKLNTGYNLITPDQLKKNQQADPNYLFDLVIDCSGYAPAVEHAISLLRRGGKLCIFXVAPPHAEIXIKPFEIYMKELXIYGVLVNPF

SEQ ID NO: 28576 - protein, 77 aa, Diabrotica virgifera
  misc_feature: Coding regions on vcDNA: vcDNA=SeqID_8273; Strand=+; Position=1-231
  misc_feature (1)..(50): Xaa can be any naturally occurring amino acid
  misc_feature (53)..(62): Xaa can be any naturally occurring amino acid
  misc_feature (64)..(71): Xaa can be any naturally occurring amino acid
XXXXXXXXXXXXXXXXXXXXXXXXXXXXXXXXXXXXXXXXXXXXXXXXXXKGXXXXXXXXXXLXXXXXXXXKKLKIF

SEQ ID NO: 28577 - protein, 87 aa, Diabrotica virgifera
  misc_feature: Coding regions on vcDNA: vcDNA=SeqID_8274; Strand=-; Position=87-350
  misc_feature (8)..(14): Xaa can be any naturally occurring amino acid
  misc_feature (36)..(41): Xaa can be any naturally occurring amino acid
FAYNTFFXXXXXXXNILVANKLIKHVYLYSCVTQHXXXXXXQVDHRQFLRGAVSTPRGSWRLAKPRGRCRVNERQADRHSGSYHDNE

SEQ ID NO: 28578 - protein, 59 aa, Diabrotica virgifera
  misc_feature: Coding regions on vcDNA: vcDNA=SeqID_8275; Strand=+; Position=1-180
  misc_feature (26)..(34): Xaa can be any naturally occurring amino acid
PVEKSYGGKKQNDYLSCFFLLFFWIXXXXXXXXXFTMRYFDSKFNLEQFSYRRVCTKCA

SEQ ID NO: 28579 - protein, 73 aa, Diabrotica virgifera
  misc_feature: Coding regions on vcDNA: vcDNA=SeqID_8276; Strand=+; Position=310-531
ITSNPYYNLIIEFKLKINFARIQWKHFMTPLPYKFQNLAAVSKKYRYIQHRTPLPYKFQNLSSSFKKISVYST

SEQ ID NO: 28580 - protein, 56 aa, Diabrotica virgifera
  misc_feature: Coding regions on vcDNA: vcDNA=SeqID_8277; Strand=+; Position=57-227
  misc_feature (13)..(20): Xaa can be any naturally occurring amino acid
SVRRWYIRYSYLXXXXXXXXNDISILKYFDIIYFHYCPRMILIVRAFLKYTQLMKN

SEQ ID NO: 28581 - protein, 25 aa, Diabrotica virgifera
  misc_feature: Coding regions on vcDNA: vcDNA=SeqID_8278; Strand=-; Position=1-75
  misc_feature (18)..(18): Xaa can be any naturally occurring amino acid
IINLIQHRGRNLYYRLTXSNKFTLL

SEQ ID NO: 28582 - protein, 33 aa, Diabrotica virgifera
  misc_feature: Coding regions on vcDNA: vcDNA=SeqID_8279; Strand=-; Position=1-99
  misc_feature (8)..(30): Xaa can be any naturally occurring amino acid
IKKNGSKXXXXXXXXXXXXXXXXXXXXXXXYNN

SEQ ID NO: 28583 - protein, 19 aa, Diabrotica virgifera
  misc_feature: Coding regions on vcDNA: vcDNA=SeqID_8280; Strand=-; Position=1-57
  misc_feature (2)..(2): Xaa can be any naturally occurring amino acid
  misc_feature (5)..(19): Xaa can be any naturally occurring amino acid
IXYHXXXXXXXXXXXXXXX

SEQ ID NO: 28584 - protein, 93 aa, Diabrotica virgifera
  misc_feature: Coding regions on vcDNA: vcDNA=SeqID_8281; Strand=+; Position=1-279
  misc_feature (3)..(47): Xaa can be any naturally occurring amino acid
  misc_feature (50)..(57): Xaa can be any naturally occurring amino acid
REXXXXXXXXXXXXXXXXXXXXXXXXXXXXXXXXXXXXXXXXXXXXXHSXXXXXXXXLGTPRNFYWKRPNPLIKNGDPPEWGLKVKQNGGDPA

SEQ ID NO: 28585 - protein, 67 aa, Diabrotica virgifera
  misc_feature: Coding regions on vcDNA: vcDNA=SeqID_8282; Strand=+; Position=36-239
  misc_feature (8)..(14): Xaa can be any naturally occurring amino acid
  misc_feature (17)..(33): Xaa can be any naturally occurring amino acid
CNASNKSXXXXXXXDTXXXXXXXXXXXXXXXXXVDQIHYFFCCAYSASFETFTWMLSLNVSMMIYTY

SEQ ID NO: 28586 - protein, 126 aa, Diabrotica virgifera
  misc_feature: Coding regions on vcDNA: vcDNA=SeqID_8283; Strand=+; Position=3-383
  misc_feature: Homolog annotation: Hit_ID=AAV91017.1; Match level="QueryCoverage =98%, HitCoverage=22%, E-value=3e-30, Identity=51%"; Hit description =hemolymph proteinase 19 [Manduca sexta]
  misc_feature: Gene Ontology Annotation: Molecular function=serine-type endopeptidase activity; Biological process=Tl signaling pathway
LTNIVNHTGTAVGWGRDHKNNPTTDLLMQAHMPVVDTLSCIYAYPEFYSMFTAPTNFCAGYRNGTSVCTGDSGGGLAFPKTGSNVWQLRGIVSNTVAKQDTCDPKYYVIFTDVAKYLEWISQKLKA

SEQ ID NO: 28587 - protein, 58 aa, Diabrotica virgifera
  misc_feature: Coding regions on vcDNA: vcDNA=SeqID_8284; Strand=-; Position=0-173
  misc_feature (14)..(20): Xaa can be any naturally occurring amino acid
HFTTHNIQADIAVXXXXXXXLTTKSYYHFITFFFGGNIIYLILLYDRLEGGVAALPIP

SEQ ID NO: 28588 - protein, 85 aa, Diabrotica virgifera
  misc_feature: Coding regions on vcDNA: vcDNA=SeqID_8285; Strand=-; Position=102-359
YLLSLTYPSIHLTRQYTYFLLFCKQHCVLLPTNHSLSLLKSNHYRCWIPSWSFEKRKRRIPKTCVRKPNTEPAQFATASFLIAQY

SEQ ID NO: 28589 - protein, 83 aa, Diabrotica virgifera
  misc_feature: Coding regions on vcDNA: vcDNA=SeqID_8286; Strand=-; Position=674-925
ADDPRSNLKNHRLRHHTKKNDVTCIIHMPKNHNLKTKNRLVSRFISKIVYSRNNEFKLRHSIYSLPVSVLFSMLPSLFPAAKK

SEQ ID NO: 28590 - protein, 83 aa, Diabrotica virgifera
  misc_feature: Coding regions on vcDNA: vcDNA=SeqID_8287; Strand=-; Position=1-249
  misc_feature (4)..(12): Xaa can be any naturally occurring amino acid
  misc_feature (37)..(47): Xaa can be any naturally occurring amino acid
  misc_feature (53)..(66): Xaa can be any naturally occurring amino acid
  misc_feature (68)..(83): Xaa can be any naturally occurring amino acid
GPFXXXXXXXXXIEPTWLHTGLNSDHVKSKSRTDLIXXXXXXXXXXXPTSRSXXXXXXXXXXXXXXVXXXXXXXXXXXXXXXX

SEQ ID NO: 28591 - protein, 129 aa, Diabrotica virgifera
  misc_feature: Coding regions on vcDNA: vcDNA=SeqID_8288; Strand=+; Position=2-391
  misc_feature: Homolog annotation: Hit_ID=EAL32605.1; Match level="QueryCoverage =97%, HitCoverage=25%, E-value=9e-44, Identity=67%"; Hit description =GA17061-PA [Drosophila pseudoobscura]
TCGHFLVPFWTFFGATLIGKAIIKMHLQKMFVIIAFNETLIDTALDWLKLVPVVGEKLQVPFKAFLNGQKQKLHKNAPVTTEGGNILGSIFEKFVIAMVLYFVISIVNSFAQSYHKRINKKKNTKASKD

SEQ ID NO: 28592 - protein, 283 aa, Diabrotica virgifera
  misc_feature: Coding regions on vcDNA: vcDNA=SeqID_8289; Strand=+; Position=1-850
  misc_feature: Homolog annotation: Hit_ID=XP_393173.1; Match level="QueryCoverage =99%, HitCoverage=7%, E-value=6e-57, Identity=40%"; Hit description =similar to Hypothetical protein CBG09037 [Apis mellifera]
  misc_feature: Gene Ontology Annotation: Molecular function=DNA binding; Cellular component=cellular_component unknown; Biological process=biological _process unknown
  misc_feature: Pfam annotation: Pfam_ID=DZF; Match level="Score=-59.2, E-value =0.0012, Copies=1"; Pfam description=DZF
  misc_feature (245)..(245): Xaa can be any naturally occurring amino acid
  misc_feature (275)..(275): Xaa can be any naturally occurring amino acid
QEEKMRRAAMREEFWARRNEEGYWDNRRYDDEYMGIGPFHRGRPYQSGPFFVGMPRRTESSDDKHVMARHAEIYPKEDEIQSIESIVSNTERALKIVSDQIADAKNPVKKLDPAAAAAAAAAAKAEAEAKQSDTPQKEDGRDNQLFTFQQGDNTRILKGVMRVGHLSKGLILRGEINVQLVVLCADKPTLTLLKKVVELLPPALKQIAPEEAYRVAINAPEAGLNVTGKDGNVLVQFTSPVIREXKAKALGLHSCVIIIRILRDLCERVPTWAPXTSWAMELL

SEQ ID NO: 28593 - protein, 56 aa, Diabrotica virgifera
  misc_feature: Coding regions on vcDNA: vcDNA=SeqID_8290; Strand=+; Position=1-168
  misc_feature (1)..(44): Xaa can be any naturally occurring amino acid
  misc_feature (49)..(49): Xaa can be any naturally occurring amino acid
  misc_feature (52)..(52): Xaa can be any naturally occurring amino acid
XXXXXXXXXXXXXXXXXXXXXXXXXXXXXXXXXXXXXXXXXXXXVKSLXFFXRRET

SEQ ID NO: 28594 - protein, 66 aa, Diabrotica virgifera; identical to SEQ ID NO: 26808
  misc_feature: Coding regions on vcDNA: vcDNA=SeqID_8291; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28595 - protein, 166 aa, Diabrotica virgifera
  misc_feature: Coding regions on vcDNA: vcDNA=SeqID_8292; Strand=+; Position=113-613
  misc_feature: Homolog annotation: Hit_ID=NP_729982.1; Match level="QueryCoverage =75%, HitCoverage=72%, E-value=8e-10, Identity=29%"; Hit description =CG9628-PB, isoform B [Drosophila melanogaster] gb|AAF49725.2| CG9628- PB, isoform B [Drosophila
  misc_feature: Pfam annotation: Pfam_ID=MARVEL; Match level="Score=10.4, E-value =0.009, Copies=1"; Pfam description=Membrane-associating domain
  misc_feature (20)..(32): Xaa can be any naturally occurring amino acid
MSSEVETKDDVREQQQKKPXXXXXXXXXXXXXKLLELLICAACMGFIHDPALTSGLGKSHMVHVGIMYTAFTGYMVINCVLILGRWMGDSVPYKTVALFALVGASLFLITCILLTVDRFYLMKHYFYHPNMHLLTMMTTSIVFAFINVVVFSVDALFTYIRKEDFA

SEQ ID NO: 28596 - protein, 219 aa, Diabrotica virgifera
  misc_feature: Coding regions on vcDNA: vcDNA=SeqID_8293; Strand=-; Position=3-659
  misc_feature (3)..(5): Xaa can be any naturally occurring amino acid
  misc_feature (8)..(219): Xaa can be any naturally occurring amino acid
NHXXXNNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 28597 - protein, 58 aa, Diabrotica virgifera
  misc_feature: Coding regions on vcDNA: vcDNA=SeqID_8294; Strand=-; Position=456-632
HRNESENVYKHIDLINRYTRNNTGIIINRWRVIQLDLGLPHDECRQQLSTIHIQQLLY

SEQ ID NO: 28598 - protein, 78 aa, Diabrotica virgifera
  misc_feature: Coding regions on vcDNA: vcDNA=SeqID_8295; Strand=-; Position=311-547
HHASSCIISNIVSDIRSYIHFFVSFLVRTFVPCMTLCKFLYQKLYEIRHVIGRNFVCHPVSRYIGMVVLRLQLILRIL

SEQ ID NO: 28599 - protein, 53 aa, Diabrotica virgifera
  misc_feature: Coding regions on vcDNA: vcDNA=SeqID_8296; Strand=+; Position=221-382
  misc_feature: Homolog annotation: Hit_ID=XP_320596.1; Match level="QueryCoverage =88%, HitCoverage=8%, E-value=2e-10, Identity=63%"; Hit description =ENSANGP00000022426 [Anopheles gambiae]
FRCDLNSDLKGGTRLAAVKCPTGLAFDLFRQTCDWKVNVKNCDIVESKSMQKE

SEQ ID NO: 28600 - protein, 66 aa, Diabrotica virgifera; identical to SEQ ID NO: 26808
  misc_feature: Coding regions on vcDNA: vcDNA=SeqID_8297; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28601 - protein, 66 aa, Diabrotica virgifera
  misc_feature: Coding regions on vcDNA: vcDNA=SeqID_8298; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PFXXXXXXXXXXXTNLAHTGVNXXXXXXXXSNXXXXXXXXXXXXXXPTSRSXXXXXXXXXXXXXXV

SEQ ID NO: 28602 - protein, 224 aa, Diabrotica virgifera
  misc_feature: Coding regions on vcDNA: vcDNA=SeqID_8299; Strand=+; Position=3-677
  misc_feature: Homolog annotation: Hit_ID=XP_393931.1; Match level="QueryCoverage =73%, HitCoverage=36%, E-value=8e-28, Identity=42%"; Hit description =similar to ENSANGP00000009426 [Apis mellifera]
  misc_feature: Gene Ontology Annotation: Cellular component=vacuole; Biological process=proteolysis and peptidolysis
  misc_feature (114)..(133): Xaa can be any naturally occurring amino acid
  misc_feature (159)..(167): Xaa can be any naturally occurring amino acid
MKSFLSISFGLFLFLGIESKSLNDNIVKKRVFADLYGKLNPTVRGDPGEPLILTDLIEAGKLDEAQDKARVQGLDTDIESYSGYLTVDKEHDSNLFFWFFPSQGNASFDPVVLXXXXXXXXXXXXXXXXXXXXVLLKDGKLDIRETTWNKNNSLIYIDXXXXXXXXXTTDGYASNQTKVAADLYEALHQFFTLFYQYQHQDFYVTGELVGLGEAKLMPRKRIRL

SEQ ID NO: 28603 - protein, 47 aa, Diabrotica virgifera
  misc_feature: Coding regions on vcDNA: vcDNA=SeqID_8300; Strand=-; Position=150-293
ALPNTIYNTNNIKIFNHNYTTNIQLELISRKIQHIYKLIPFHHREII

SEQ ID NO: 28604 - protein, 62 aa, Diabrotica virgifera
  misc_feature: Coding regions on vcDNA: vcDNA=SeqID_8301; Strand=-; Position=490-678
LSYCMPHVITSLPRSNNTLSRKQQLIYRAFHRLSFVSGFCHVSHNINISTSYVFGLYHWIYQ

SEQ ID NO: 28605 - protein, 222 aa, Diabrotica virgifera
  misc_feature: Coding regions on vcDNA: vcDNA=SeqID_8302; Strand=+; Position=73-738
  misc_feature: Homolog annotation: Hit_ID=XP_392420.1; Match level="QueryCoverage =44%, HitCoverage=7%, E-value=5e-14, Identity=45%"; Hit description =similar to ENSANGP00000010741 [Apis mellifera]
EQAAEENPEEEEEVTPVIEARVIVDTLLNAANNGGNTAPFEQATPSTSEASATGTSPRSSTENLASDSRPAPSSRLPENASRIGDLSELLTMLTQIQIRFAPFLERYQQFTRDDPDVTGDDVRTTQNMLNRVSEVMHLLGHAYHSLSDLIIRVRTPPGLPSRPRALLCRPILIPHSGVLPTGIPIQVEGQINLTAERNSSSNADPSAPPEPPTYTLHATPVS

SEQ ID NO: 28606 - protein, 75 aa, Diabrotica virgifera
  misc_feature: Coding regions on vcDNA: vcDNA=SeqID_8303; Strand=-; Position=52-279
HNVPTSSPRKARLYTESEMASISLRHHRKLHGSHSLKHESTLCRTTPANYAILWPGANHKSNNTIIFFDFLESNN

SEQ ID NO: 28607 - protein, 83 aa, Diabrotica virgifera
  misc_feature: Coding regions on vcDNA: vcDNA=SeqID_8304; Strand=+; Position=1-252
  misc_feature (3)..(26): Xaa can be any naturally occurring amino acid
  misc_feature (28)..(56): Xaa can be any naturally occurring amino acid
RRXXXXXXXXXXXXXXXXXXXXXXXXVXXXXXXXXXXXXXXXXXXXXXXXXXXXXXIFEFHRAPTLTLLLLYDYLKQALCYEM

SEQ ID NO: 28608 - protein, 67 aa, Diabrotica virgifera
  misc_feature: Coding regions on vcDNA: vcDNA=SeqID_8305; Strand=+; Position=3-206
  misc_feature (57)..(57): Xaa can be any naturally occurring amino acid
  misc_feature (63)..(63): Xaa can be any naturally occurring amino acid
  misc_feature (67)..(67): Xaa can be any naturally occurring amino acid
TTQPEKASQELEDLVSSDDFLGDEINNYHDVKLIERQDEPLVKEKEKSKRFGGLFSXKKSSDXEQDX

SEQ ID NO: 28609 - protein, 113 aa, Diabrotica virgifera
  misc_feature: Coding regions on vcDNA: vcDNA=SeqID_8306; Strand=+; Position=285-626
SIRSYCIILIFCEISPTFCLHTLLLYSLINIYALALAVIGRPPYCALAGLSPLNTNDCCDTSRGISDPRCQPSQCAVRHWPSGYISEFSKMYMVFPHVQHSSIQCDITDIEMM

SEQ ID NO: 28610 - protein, 226 aa, Diabrotica virgifera
  misc_feature: Coding regions on vcDNA: vcDNA=SeqID_8307; Strand=+; Position=83-763
  misc_feature: Homolog annotation: Hit_ID=NP_477065.3; Match level="QueryCoverage =84%, HitCoverage=89%, E-value=2e-78, Identity=73%"; Hit description =CG7959-PA [Drosophila melanogaster] gb|AAF47533.3| CG7959-PA [Drosophila melanogaster]
  misc_feature: Gene Ontology Annotation: Molecular function=molecular_function unknown; Cellular component=cellular_component unknown; Biological process=biological_process unknown
  misc_feature: Pfam annotation: Pfam_ID=CBF_beta; Match level="Score=385.6, E-value =6.4e-113, Copies=1"; Pfam description=Core binding factor beta subunit
MNMHSMNDPASVLSGMMSFDSISLYEQPKPRFIFKMPRVVPDQKAKFESDELFRRLSRESEVRYTGYRDRPQEERMVRFQNACREGHTEIAFAATGTNLQLVFAPPTSGYMADKECDFDKEPGKVHIKATFIMNGVCVRWRGWIDTDRLDGVGCLEYNEERAAQEDALLREQIERYNQRLREFEDKQRGYRQDRPEQDLELRMSNNIHGHHAHHGVSSRCHGPPKG

SEQ ID NO: 28611 - protein, 63 aa, Diabrotica virgifera
  misc_feature: Coding regions on vcDNA: vcDNA=SeqID_8308; Strand=-; Position=2-190
NENNVQNSTIPDNNLHSNDLILTLSSILTIMTVASVYYLCTPHWLFLYFDINKKFVTILMKIN

SEQ ID NO: 28612 - protein, 66 aa, Diabrotica virgifera; identical to SEQ ID NO: 26808
  misc_feature: Coding regions on vcDNA: vcDNA=SeqID_8309; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28613 - protein, 328 aa, Diabrotica virgifera
  misc_feature: Coding regions on vcDNA: vcDNA=SeqID_8310; Strand=-; Position=0-983
  misc_feature (1)..(18): Xaa can be any naturally occurring amino acid
  misc_feature (20)..(36): Xaa can be any naturally occurring amino acid
  misc_feature (38)..(38): Xaa can be any naturally occurring amino acid
  misc_feature (46)..(324): Xaa can be any naturally occurring amino acid
XXXXXXXXXXXXXXXXXXPXXXXXXXXXXXXXXXXXNXLLNSIGLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTLGG

SEQ ID NO: 28614 - protein, 27 aa, Diabrotica virgifera
  misc_feature: Coding regions on vcDNA: vcDNA=SeqID_8311; Strand=-; Position=1-81
  misc_feature (3)..(26): Xaa can be any naturally occurring amino acid
KKXXXXXXXXXXXXXXXXXXXXXXXXQ

SEQ ID NO: 28615 - protein, 31 aa, Diabrotica virgifera
  misc_feature: Coding regions on vcDNA: vcDNA=SeqID_8312; Strand=-; Position=50-145
SHITELRVSIEDNKLFHYTFSLKGVVLIIVK

SEQ ID NO: 28616 - protein, 154 aa, Diabrotica virgifera
  misc_feature: Coding regions on vcDNA: vcDNA=SeqID_8313; Strand=+; Position=1-466
  misc_feature: Homolog annotation: Hit_ID=BAA75470.1; Match level="QueryCoverage =100%, HitCoverage=22%, E-value=6e-62, Identity=70%"; Hit description= prophenoloxidase [Tenebrio molitor]
  misc_feature: Pfam annotation: Pfam_ID=Hemocyanin_C; Match level="Score=-35.7, E -value=3e-08, Copies=1"; Pfam description=Hemocyanin, ig-like domain
  misc_feature (7)..(7): Xaa can be any naturally occurring amino acid
VNLRQGXNTITRASTDSSVTIPFDRTFRDLDTSRPDGGNNLAQFNFCGCGWPQHMLIPMGNTDNPGFRCELFVMISNIDDDRIDQDITGICNDADSFCGVKDRLYPDRRSMGFPFDRQPRQGVDTLQQFLTPNMRVQDVVIRFSNRTFRPRQNN

SEQ ID NO: 28617 - protein, 85 aa, Diabrotica virgifera
  misc_feature: Coding regions on vcDNA: vcDNA=SeqID_8314; Strand=-; Position=139-395
  misc_feature: Homolog annotation: Hit_ID=AAK61417.1; Match level="QueryCoverage =82%, HitCoverage=20%, E-value=4e-09, Identity=42%"; Hit description =transposase [Ceratitis rosa]
  misc_feature (36)..(36): Xaa can be any naturally occurring amino acid
MIDSLIEGYFQQDGARIHTTQDFFDNRIISLNTPIXIPPRSCDLTPYNFFLWSHLKNSIFKTPVVDLEDLGQTLENRIQELNKTP

SEQ ID NO: 28618 - protein, 112 aa, Diabrotica virgifera
  misc_feature: Coding regions on vcDNA: vcDNA=SeqID_8315; Strand=+; Position=631-966
  misc_feature (45)..(45): Xaa can be any naturally occurring amino acid
  misc_feature (48)..(48): Xaa can be any naturally occurring amino acid
  misc_feature (50)..(50): Xaa can be any naturally occurring amino acid
  misc_feature (59)..(59): Xaa can be any naturally occurring amino acid
  misc_feature (71)..(71): Xaa can be any naturally occurring amino acid
  misc_feature (87)..(87): Xaa can be any naturally occurring amino acid
MKNYGSIQVNGEAVRARRLITPAERIVLSNVCPSIPHEVIIQELXHLXLXLVSPITFLXISASLPEYSHIXSFRRQSVISPHNTTIXNSILSKYDNTNYRIFISQDSMICYI

SEQ ID NO: 28619 - protein, 44 aa, Diabrotica virgifera
  misc_feature: Coding regions on vcDNA: vcDNA=SeqID_8316; Strand=+; Position=3-137
PICFMQFNEACLLIIHVRVHSGEKPYKCEIWLKWISIPNILDAV

SEQ ID NO: 28620 - protein, 206 aa, Diabrotica virgifera
  misc_feature: Coding regions on vcDNA: vcDNA=SeqID_8317; Strand=+; Position=292-909
  misc_feature: Homolog annotation: Hit_ID=XP_526189.1; Match level="QueryCoverage =96%, HitCoverage=82%, E-value=9e-39, Identity=39%"; Hit description =PREDICTED: similar to zinc finger protein 502 [Pan troglodytes]
  misc_feature: Gene Ontology Annotation: Molecular function=protein binding; Cellular component=nucleus; Biological process=regulation of transcription, DNA-dependent
  misc_feature: Pfam annotation: Pfam_ID=zf-C2H2; Match level="Score=88.0, E-value =2.5e-23, Copies=3"; Pfam description=Zinc finger, C2H2 type
  misc_feature (41)..(48): Xaa can be any naturally occurring amino acid
  misc_feature (67)..(77): Xaa can be any naturally occurring amino acid
  misc_feature (147)..(147): Xaa can be any naturally occurring amino acid
  misc_feature (150)..(159): Xaa can be any naturally occurring amino acid
MEIMETLIGHSSYDGNYMGAHDEGKTINQNMKVATGRRSYXXXXXXXXCTDRSNLTTHLRVHTGEKXXXXXXXXXXXETGNLKRHLRVHTGEKPYKCEICFKQFSGAGSLKTHLRVHTGEKPYKCKICFKQFKQSVKLKIHLRVHSXETXXXXXXXXXXFSRVDNLKRHLRVHTGDNPYKCSICFKQFTDRSILTTHLRVHTGEKP

SEQ ID NO: 28621 - protein, 83 aa, Diabrotica virgifera
  misc_feature: Coding regions on vcDNA: vcDNA=SeqID_8318; Strand=+; Position=703-951
CLEFTKPVVRFKCFFNVIALFFGNIAVIIFLVKVKFSLFTGCTNETVFFLKFCIALWNVLAFIIMPKLGSNLWPHVFLNRSVF

SEQ ID NO: 28622 - protein, 61 aa, Diabrotica virgifera
  misc_feature: Coding regions on vcDNA: vcDNA=SeqID_8319; Strand=+; Position=392-577
KGYSLMAYWIQYPYKITLEDLTEHGYTSVQTYESLLTDQNFALEIIYRVPYDDKTIVLREL

SEQ ID NO: 28623 - protein, 66 aa, Diabrotica virgifera
  misc_feature: Coding regions on vcDNA: vcDNA=SeqID_8320; Strand=+; Position=9-209
  misc_feature (6)..(19): Xaa can be any naturally occurring amino acid
YYHHYXXXXXXXXXXXXXXTLEHGHLIMFNHLFIVCAMRFSGPERKILSMFFPQIRKLPNYDFYRK

SEQ ID NO: 28624 - protein, 30 aa, Diabrotica virgifera
  misc_feature: Coding regions on vcDNA: vcDNA=SeqID_8321; Strand=-; Position=1-90
  misc_feature (1)..(26): Xaa can be any naturally occurring amino acid
XXXXXXXXXXXXXXXXXXXXXXXXXXVSRL

SEQ ID NO: 28625 - protein, 217 aa, Diabrotica virgifera
  misc_feature: Coding regions on vcDNA: vcDNA=SeqID_8322; Strand=+; Position=3-653
  misc_feature: Homolog annotation: Hit_ID=EAL40333.1; Match level="QueryCoverage =99%, HitCoverage=7%, E-value=5e-65, Identity=56%"; Hit description =ENSANGP00000027914 [Anopheles gambiae str. PEST] ref|XP_558026.1| ENSANGP00000027914 [Anopheles gambiae str
  misc_feature: Gene Ontology Annotation: Molecular function=protein binding
QLLEPHNTPFSGKSSAAAARHLWTYLVRQESVQDIFIRAVFGKRRYSGAVEEILPHPEPTVLEPVRIIHKEQDSISAFSLNQVTSGLIAIATPRELQEMDISLLLELPAWLEDECELDILNFHKEVPDPTGPPFLVIQSSTDQGKETQPGSPQAGGTAGQSGRGTSGVLKHKIDGIKRITAHPLLPLYLTGGQDGSVHLWEWGHQQPVAVPRPPGTY

SEQ ID NO: 28626 - protein, 146 aa, Diabrotica virgifera
  misc_feature: Coding regions on vcDNA: vcDNA=SeqID_8323; Strand=-; Position=181-621
  misc_feature: Homolog annotation: Hit_ID=XP_311257.1; Match level="QueryCoverage =98%, HitCoverage=29%, E-value=5e-20, Identity=40%"; Hit description =ENSANGP00000011950 [Anopheles gambiae]
  misc_feature: Gene Ontology Annotation: Molecular function=adenosylhomocysteinase activity; Cellular component=cytoplasm; Biological process =methionine metabolism
  misc_feature: Pfam annotation: Pfam_ID=AdoHcyase_NAD; Match level="Score=-34.0, E -value=0.035, Copies=1"; Pfam description=S-adenosyl-L-homocysteine hydrolase,
LGGFEVPPMEETPQKTPIFVPAPGCKEFLRGGPFPHKGGGPLVGNLGPFSWEIDVPWFEKNPQGKVPFQPPVGRYFLSPGNPRNVLAEGGLVHFGWAPGPFSFVKSNSLPPPVLGPSELWAKPGAFFPGVPLFPPPFCGEVARLPL

SEQ ID NO: 28627 - protein, 143 aa, Diabrotica virgifera
  misc_feature: Coding regions on vcDNA: vcDNA=SeqID_8324; Strand=+; Position=3-434
  misc_feature: Homolog annotation: Hit_ID=CAA75108.1; Match level="QueryCoverage =86%, HitCoverage=77%, E-value=6e-13, Identity=36%"; Hit description =beta-galactosidase [Phagemid cloning vector pTZ19U]
  misc_feature (26)..(31): Xaa can be any naturally occurring amino acid
  misc_feature (48)..(55): Xaa can be any naturally occurring amino acid
  misc_feature (79)..(79): Xaa can be any naturally occurring amino acid
  misc_feature (81)..(86): Xaa can be any naturally occurring amino acid
  misc_feature (136)..(142): Xaa can be any naturally occurring amino acid
TNPGRGSQKPSKRAPKNKSRGPVLKXXXXXXPGGTPIKPLGENPPFPXXXXXXXXPPQPPPQKLGTPKGEREPPRNGAXKXXXXXXNPTGTPKLVRAPKPPPFPFFPSFFPTIAGFPPQDLKRGGPLGSPIKGLRXXXXXXXD

SEQ ID NO: 28628 - protein, 17 aa, Diabrotica virgifera
  misc_feature: Coding regions on vcDNA: vcDNA=SeqID_8325; Strand=-; Position=6-59
  misc_feature (5)..(11): Xaa can be any naturally occurring amino acid
ELDNXXXXXXXNTKRTY

SEQ ID NO: 28629 - protein, 44 aa, Diabrotica virgifera
  misc_feature: Coding regions on vcDNA: vcDNA=SeqID_8326; Strand=+; Position=2-133
  misc_feature (17)..(29): Xaa can be any naturally occurring amino acid
  misc_feature (31)..(33): Xaa can be any naturally occurring amino acid
LLASGFLYNSNEHIRKXXXXXXXXXXXXXKXXXIQLLYHLATQK

SEQ ID NO: 28630 - protein, 270 aa, Diabrotica virgifera
  misc_feature: Coding regions on vcDNA: vcDNA=SeqID_8327; Strand=-; Position=0-809
  misc_feature (3)..(12): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(267): Xaa can be any naturally occurring amino acid
VLXXXXXXXXXXRNQPGSHRFKXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRG

SEQ ID NO: 28631 - protein, 191 aa, Diabrotica virgifera
  misc_feature: Coding regions on vcDNA: vcDNA=SeqID_8328; Strand=+; Position=2-574
  misc_feature (1)..(21): Xaa can be any naturally occurring amino acid
  misc_feature (23)..(77): Xaa can be any naturally occurring amino acid
  misc_feature (80)..(120): Xaa can be any naturally occurring amino acid
  misc_feature (132)..(144): Xaa can be any naturally occurring amino acid
  misc_feature (157)..(175): Xaa can be any naturally occurring amino acid
  misc_feature (182)..(189): Xaa can be any naturally occurring amino acid
XXXXXXXXXXXXXXXXXXXXXNXXXXXXXXXXXXXXXXXXXXXXXXXXXXXXXXXXXXXXXXXXXXXXXXXXXXXXXDHXXXXXXXXXXXXXXXXXXXXXXXXXXXXXXXXXXXXXXXXXYYKIVYLIQIYXXXXXXXXXXXXXIIINMSLCIRYTXXXXXXXXXXXXXXXXXXXIIIINFXXXXXXXXLD

SEQ ID NO: 28632 - protein, 97 aa, Diabrotica virgifera
  misc_feature: Coding regions on vcDNA: vcDNA=SeqID_8329; Strand=-; Position=55-348
TSVSIGAGFPGIKRPASISDFLAAAVGYSKSSCLNWNNILNLSDNGDTPWENVCERHIVNRRYKSPFLNLLSSNDNKIYHHPMINRCVVLHFTNKNL

SEQ ID NO: 28633 - protein, 39 aa, Diabrotica virgifera
  misc_feature: Coding regions on vcDNA: vcDNA=SeqID_8330; Strand=+; Position=3-122
AKSVLYPAGLLNGPNRSLALLMLDDYLQKQQIFIFKIVI

SEQ ID NO: 28634 - protein, 65 aa, Diabrotica virgifera
  misc_feature: Coding regions on vcDNA: vcDNA=SeqID_8331; Strand=+; Position=86-283
PDAVKTHLFPSQLDRPVTLCVLSGAVCKRVPMTQNASVSNATGPICHTMRFHRMRRKRIRSKRIM

SEQ ID NO: 28635 - protein, 25 aa, Diabrotica virgifera
  misc_feature: Coding regions on vcDNA: vcDNA=SeqID_8332; Strand=-; Position=1-75
  misc_feature (4)..(25): Xaa can be any naturally occurring amino acid
NHPXXXXXXXXXXXXXXXXXXXXXX

SEQ ID NO: 28636 - protein, 252 aa, Diabrotica virgifera
  misc_feature: Coding regions on vcDNA: vcDNA=SeqID_8333; Strand=+; Position=3-758
  misc_feature: Homolog annotation: Hit_ID=XP_392602.1; Match level="QueryCoverage =97%, HitCoverage=30%, E-value=7e-35, Identity=37%"; Hit description =similar to ENSANGP00000019854 [Apis mellifera]
  misc_feature: Gene Ontology Annotation: Molecular function=aminopeptidase activity; Cellular component=cellular_component unknown; Biological process =biological_process unknown
  misc_feature: Pfam annotation: Pfam_ID=Peptidase_M1; Match level="Score=-151.3, E -value=0.00056, Copies=1"; Pfam description=Peptidase family M1
IVSGLEKRSIDLIAAHGLISQERLPHDTSPSGYHLFLQPFPKDGYFEGRVKINVTVQHKTHEIVLHAHPDLMIMHCNITQLIPSDEELKRANLSDPLEREFPPVSVVIESAEKVRSKPLYNIVLQSPINSGALLEVYLHFTGKIFHDSSEGLFRGNYVDLMTKETKWFVDTHMRPNMARRVFPGYDEPAFKIPFVISVARHKNMTAVSNMPLDYTTPHEAIKDWYWDTFRRTPVMATFSLGIVISELSNITS

SEQ ID NO: 28637 - protein, 110 aa, Diabrotica virgifera
  misc_feature: Coding regions on vcDNA: vcDNA=SeqID_8334; Strand=+; Position=56-388
  misc_feature (52)..(61): Xaa can be any naturally occurring amino acid
  misc_feature (86)..(91): Xaa can be any naturally occurring amino acid
  misc_feature (95)..(105): Xaa can be any naturally occurring amino acid
LIIRIREIVFHLYRGQIHLLNLVYRAFSYTSRYLYISEYKRAKKLQLLSYPXXXXXXXXXXHVYAYLSISNYLTSPLDLFITYISXXXXXXIINXXXXXXXXXXXHCIKI

SEQ ID NO: 28638 - protein, 35 aa, Diabrotica virgifera
  misc_feature: Coding regions on vcDNA: vcDNA=SeqID_8335; Strand=-; Position=0-104
  misc_feature (15)..(24): Xaa can be any naturally occurring amino acid
TLNKNLFIYTTLCIXXXXXXXXXXHRARGGAGVAR

SEQ ID NO: 28639 - protein, 83 aa, Diabrotica virgifera
  misc_feature: Coding regions on vcDNA: vcDNA=SeqID_8336; Strand=-; Position=358-609
KMASSTNYQLENNADGKQSMVFDHDYEVENNYLLCRGEYITSHITESEFRERFTRRNTTVTAPSLFRLLNATNHLQLRHEASI

SEQ ID NO: 28640 - protein, 289 aa, Diabrotica virgifera
  misc_feature: Coding regions on vcDNA: vcDNA=SeqID_8337; Strand=-; Position=3-869
  misc_feature: Homolog annotation: Hit_ID=EAL41613.1; Match level="QueryCoverage =98%, HitCoverage=22%, E-value=1e-14, Identity=22%"; Hit description =ENSANGP00000026105 [Anopheles gambiae str. PEST] ref|XP_564442.1| ENSANGP00000026105 [Anopheles gambiae st
  misc_feature: Pfam annotation: Pfam_ID=rve; Match level="Score=30.7, E-value=4.5e -06, Copies=1"; Pfam description=Integrase core domain
  misc_feature (30)..(30): Xaa can be any naturally occurring amino acid
  misc_feature (230)..(243): Xaa can be any naturally occurring amino acid
MTHFLSQFDFDIKYDPEKENVEADCLSRNXVLENIENAETFIKTVNLVTLTEIKQDQNNNRQAIDKMIGTIFNQDVFYKLRKNQKKIILSKDFGVKLITKIHKFYGHICAGKLINKIRNFYYINNLDLLAKDICQKCEICCKNKTRVGPKYGLLSQLGPAKEPFEIMSLDTIGGFAGNRSTKKYLHLLVDHFTRYAFAVTSKNQMTGDFIKLISKIQDKHPIKTLLTDQXXXXXXXXXXXXXXQLNIQLVFTAVDCPFSNGLNERLNQTLVNRIRCKLNETRSRAWTKI

SEQ ID NO: 28641 - protein, 78 aa, Diabrotica virgifera
  misc_feature: Coding regions on vcDNA: vcDNA=SeqID_8338; Strand=-; Position=2-235
  misc_feature (1)..(12): Xaa can be any naturally occurring amino acid
  misc_feature (14)..(25): Xaa can be any naturally occurring amino acid
  misc_feature (35)..(42): Xaa can be any naturally occurring amino acid
  misc_feature (45)..(58): Xaa can be any naturally occurring amino acid
  misc_feature (64)..(77): Xaa can be any naturally occurring amino acid
XXXXXXXXXXXXPXXXXXXXXXXXXTNLAHTGLNXXXXXXXXSNXXXXXXXXXXXXXXPTSRSXXXXXXXXXXXXXXV

SEQ ID NO: 28642 - protein, 19 aa, Diabrotica virgifera
  misc_feature: Coding regions on vcDNA: vcDNA=SeqID_8339; Strand=-; Position=1-57
LKSSYLIFSGYKIAPPRRL

SEQ ID NO: 28643 - protein, 66 aa, Diabrotica virgifera; identical to SEQ ID NO: 26808
  misc_feature: Coding regions on vcDNA: vcDNA=SeqID_8340; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28644 - protein, 117 aa, Diabrotica virgifera
  misc_feature: Coding regions on vcDNA: vcDNA=SeqID_8341; Strand=-; Position=409-762
  misc_feature: Homolog annotation: Hit_ID=CAH04345.1; Match level="QueryCoverage =97%, HitCoverage=98%, E-value=2e-49, Identity=85%"; Hit description =S26e ribosomal protein [Cicindela campestris]
  misc_feature: Gene Ontology Annotation: Molecular function=structural constituent of ribosome; Cellular component=cytosolic ribosome (sensu Eukarya); Biological process=locomotory behavior
  misc_feature: Pfam annotation: Pfam_ID=Ribosomal_S26e; Match level="Score=255.2, E -value=1.1e-73, Copies=1"; Pfam description=Ribosomal protein S26e
  misc_feature (94)..(101): Xaa can be any naturally occurring amino acid
MTCKRRNGGRSKHGRGHVKPVRCTNCARCVPKDKAIKKFVIRNIVEAAAVRDITEASVYQAYVLPKLYAKLHYCVSCAIHSKVVRNRSKKDRRXXXXXXXXFPGRDNARVQQQQPRK

SEQ ID NO: 28645 - protein, 308 aa, Diabrotica virgifera
  misc_feature: Coding regions on vcDNA: vcDNA=SeqID_8342; Strand=+; Position=26-948
  misc_feature: Homolog annotation: Hit_ID=CAC12696.1; Match level="QueryCoverage =95%, HitCoverage=72%, E-value=4e-57, Identity=42%"; Hit description =prophenoloxidase activating factor [Tenebrio molitor]
  misc_feature: Gene Ontology Annotation: Molecular function=plasma kallikrein activity; Cellular component=integral to membrane; Biological process=proteolysis and peptidolysis
  misc_feature: Pfam annotation: Pfam_ID=Trypsin; Match level="Score=-14.2, E-value =0.004, Copies=1"; Pfam description=Trypsin
  misc_feature (197)..(197): Xaa can be any naturally occurring amino acid
  misc_feature (227)..(235): Xaa can be any naturally occurring amino acid
  misc_feature (259)..(259): Xaa can be any naturally occurring amino acid
  misc_feature (280)..(280): Xaa can be any naturally occurring amino acid
  misc_feature (294)..(295): Xaa can be any naturally occurring amino acid
MFAKIMMVNYLTLVVVLFVVADGQLDEEFNQIIKELDDETTTVQPETTTTPLSLDPYQNNKDPYAVPGNVSVSCDYQCVPFYQCNNGTLVTNGENIIDIRSKESCGNALLSCCKDEHVTHDRFTPTPPEVPVPQGCGYRRTKGVGFEITGTKDNEAQYAEFPWMVSIYRLPKDANSRPVCGGALIHPQAVITAAHCXQDKRQRFEIGAGEWDISGKIKPFPVQLSEXXXXXXXXXFYAGALFNDIALLKLTTPINLSEXIDTICLPSQNLVHKPKKRCYXTGWGKDKVGRQGVXXTILKKIDLPVVLK

SEQ ID NO: 28646 - protein, 76 aa, Diabrotica virgifera
  misc_feature: Coding regions on vcDNA: vcDNA=SeqID_8343; Strand=-; Position=6-236
  misc_feature (1)..(7): Xaa can be any naturally occurring amino acid
  misc_feature (36)..(46): Xaa can be any naturally occurring amino acid
  misc_feature (48)..(54): Xaa can be any naturally occurring amino acid
  misc_feature (62)..(72): Xaa can be any naturally occurring amino acid
XXXXXXXFLENTYLVKNFSDNYCSESFVAFFNVFVXXXXXXXXXXXYXXXXXXXKAVSSKIXXXXXXXXXXXFKVY

SEQ ID NO: 28647 - protein, 72 aa, Diabrotica virgifera
  misc_feature: Coding regions on vcDNA: vcDNA=SeqID_8344; Strand=-; Position=440-658
  misc_feature (1)..(11): Xaa can be any naturally occurring amino acid
XXXXXXXXXXXRHVISYLYKRYMKIVSHIISVTVSVIVLRLSAILILEVFSPLITLRIWHIYNLITSEVFSI

SEQ ID NO: 28648 - protein, 38 aa, Diabrotica virgifera
  misc_feature: Coding regions on vcDNA: vcDNA=SeqID_8345; Strand=-; Position=1-114
  misc_feature (4)..(4): Xaa can be any naturally occurring amino acid
  misc_feature (7)..(36): Xaa can be any naturally occurring amino acid
KKLXQKXXXXXXXXXXXXXXXXXXXXXXXXXXXXXXLK

SEQ ID NO: 28649 - protein, 158 aa, Diabrotica virgifera
  misc_feature: Coding regions on vcDNA: vcDNA=SeqID_8346; Strand=+; Position=303-779
  misc_feature (15)..(34): Xaa can be any naturally occurring amino acid
  misc_feature (42)..(49): Xaa can be any naturally occurring amino acid
  misc_feature (52)..(61): Xaa can be any naturally occurring amino acid
  misc_feature (85)..(107): Xaa can be any naturally occurring amino acid
IQMRITNFHISKYVXXXXXXXXXXXXXXXXXXXXFRSFKFRXXXXXXXXKVXXXXXXXXXXEEFDNIFFACLLITCLLVFCIKSXXXXXXXXXXXXXXXXXXXXXXXLSIESWNAGLYEQQTVSIKLIPNFISMFDSLHFFRRREHPIELYNLISKHL

SEQ ID NO: 28650 - protein, 129 aa, Diabrotica virgifera
  misc_feature: Coding regions on vcDNA: vcDNA=SeqID_8347; Strand=+; Position=1-390
  misc_feature (115)..(121): Xaa can be any naturally occurring amino acid
NDPIYYYEVPAIINNQESQEPDYYQVPIPNQELAAPIDTEWNPNNDPIYYYEVPAIINNQESPTREFPKKYNEDIHDKKKPFASQPKVEIIFEPISKQQYEEKQIELTKKFDKLXXXXXXXIIQAQQTI

SEQ ID NO: 28651 - protein, 233 aa, Diabrotica virgifera
  misc_feature: Coding regions on vcDNA: vcDNA=SeqID_8348; Strand=-; Position=183-883
  misc_feature: Homolog annotation: Hit_ID=XP_393114.1; Match level="QueryCoverage =96%, HitCoverage=25%, E-value=1e-97, Identity=73%"; Hit description =similar to CG7147-PA [Apis mellifera]
  misc_feature: Gene Ontology Annotation: Molecular function=metallopeptidase activity; Cellular component=integral to plasma membrane; Biological process=cell-cell signaling
  misc_feature: Pfam annotation: Pfam_ID=Disintegrin; Match level="Score=90.6, E -value=4.2e-24, Copies=1"; Pfam description=Disintegrin
  misc_feature (3)..(3): Xaa can be any naturally occurring amino acid
  misc_feature (31)..(31): Xaa can be any naturally occurring amino acid
SLXGRVGAIEEKKKRNCFTASAGAFCGNKIXEAGEECDCGYDDKECNDQCCYPRVISVRDKELNRSAVGCTRRAGTECSPSQGPCCSGECKFISSYRQEVCKMESDCSRSSKCNGSSAECPVPTPRADKTRCNNGTQLCIKGECSGSICLEWNLEACSLTTQDHPNIDKRKLCELACQNGTDICRSTSEFADRVGLPPGGISLRPGSPCDNFQGYCDVFLKCAPVQEPILRLT

SEQ ID NO: 28652 - protein, 151 aa, Diabrotica virgifera
  misc_feature: Coding regions on vcDNA: vcDNA=SeqID_8349; Strand=+; Position=25-480
  misc_feature: Homolog annotation: Hit_ID=XP_321836.1; Match level="QueryCoverage =80%, HitCoverage=91%, E-value=3e-46, Identity=68%"; Hit description =ENSANGP00000020916 [Anopheles gambiae]
  misc_feature: Pfam annotation: Pfam_ID=Ribosomal_L20; Match level="Score=36.8, E -value=1.3e-09, Copies=1"; Pfam description=Ribosomal protein L20
MVFTTAINFIRSRGPDEIWRKRRIFKLAAHFIGRRRNCYSIAIRNVHRALVYATKGRKLRKEDMASLWEMRIRAGCDQHNVSYETFREGLVRSDILLNRRTLADLACWEPYSFKALTDIAKRRAVDDGLAGISADSSLDRIITRGCMVKQK

SEQ ID NO: 28653 - protein, 66 aa, Diabrotica virgifera; identical to SEQ ID NO: 26808
  misc_feature: Coding regions on vcDNA: vcDNA=SeqID_8350; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28654 - protein, 21 aa, Diabrotica virgifera
  misc_feature: Coding regions on vcDNA: vcDNA=SeqID_8351; Strand=-; Position=1-66
KNHILCSHCGHLNLTSSDIGS

SEQ ID NO: 28655 - protein, 20 aa, Diabrotica virgifera
  misc_feature: Coding regions on vcDNA: vcDNA=SeqID_8352; Strand=-; Position=1-60
  misc_feature (1)..(19): Xaa can be any naturally occurring amino acid
XXXXXXXXXXXXXXXXXXXF

SEQ ID NO: 28656 - protein, 79 aa, Diabrotica virgifera
  misc_feature: Coding regions on vcDNA: vcDNA=SeqID_8353; Strand=-; Position=1-237
  misc_feature (2)..(22): Xaa can be any naturally occurring amino acid
  misc_feature (24)..(79): Xaa can be any naturally occurring amino acid
KXXXXXXXXXXXXXXXXXXXXXPXXXXXXXXXXXXXXXXXXXXXXXXXXXXXXXXXXXXXXXXXXXXXXXXXXXXXXXX

SEQ ID NO: 28657 - protein, 72 aa, Diabrotica virgifera
  misc_feature: Coding regions on vcDNA: vcDNA=SeqID_8354; Strand=+; Position=276-491
  misc_feature (40)..(71): Xaa can be any naturally occurring amino acid
EFYSQLTVIEDTYVLKKEFFTFSKSHRSNRVHSRPSDRNXXXXXXXXXXXXXXXXXXXXXXXXXXXXXXXXI

SEQ ID NO: 28658 - protein, 50 aa, Diabrotica virgifera
  misc_feature: Coding regions on vcDNA: vcDNA=SeqID_8355; Strand=-; Position=1-150
  misc_feature (24)..(48): Xaa can be any naturally occurring amino acid
RGKYQKPCYTHTVEKTLVEFLYYXXXXXXXXXXXXXXXXXXXXXXXXXRY

SEQ ID NO: 28659 - protein, 262 aa, Diabrotica virgifera
  misc_feature: Coding regions on vcDNA: vcDNA=SeqID_8356; Strand=+; Position=3-788
  misc_feature: Homolog annotation: Hit_ID=XP_309957.1; Match level="QueryCoverage =83%, HitCoverage=17%, E-value=7e-25, Identity=35%"; Hit description =ENSANGP00000004412 [Anopheles gambiae]
  misc_feature: Gene Ontology Annotation: Cellular component=endoplasmic reticulum
  misc_feature (63)..(72): Xaa can be any naturally occurring amino acid
  misc_feature (193)..(193): Xaa can be any naturally occurring amino acid
DLLSHYSSLLASQGELSTAIAYLGNSTNEKVSTLRDRLQVALGVKQVLAQDPRQPNRRGSHRXXXXXXXXXXFANTNPFQPPQSSFGAPAQPAPVPAPVPSYNQFNTGLPNPSINNQPWQPQPTQCFPQPPKAFSPAPQAPPSHPPRPTSVGSNQGGSGLPSRKYVLDPSVSSNPYGSPPNQYVPPPIHSFQXNNAFQSNPYAPPSVNSSQLPPLNNSSMLNPVEVPSNSSFNLTPLVPAQTSYGGSNLSLPPTDIAPEATT

SEQ ID NO: 28660 - protein, 132 aa, Diabrotica virgifera
  misc_feature: Coding regions on vcDNA: vcDNA=SeqID_8357; Strand=+; Position=1-399
  misc_feature: Homolog annotation: Hit_ID=BAB78478.1; Match level="QueryCoverage =90%, HitCoverage=28%, E-value=6e-13, Identity=26%"; Hit description =preproMP73 [Cucurbita maxima]
  misc_feature: Gene Ontology Annotation: Molecular function=molecular_function unknown; Cellular component=cellular_component unknown; Biological process=N-linked glycosylation
SLGAAYAAHSDNRQTPFETQRRREKKTKSRQTKNARKQKEHKKRENTERRRNHKRTGTRKNDQTHTKDKRERQSEKGTRGGAQEQAKREKRERRHKDKEEKKELQKEKTGEKEETNKETETPEGAKESQYLL

SEQ ID NO: 28661 - protein, 163 aa, Diabrotica virgifera
  misc_feature: Coding regions on vcDNA: vcDNA=SeqID_8358; Strand=+; Position=2-490
VNCNFASDTAPDCQIEFYIDTNVLKVKRNKTLDRDKGRKTYPCLFECLDNPLNVRSQGQNKANKSFTIILDDINDHAPVLMTKDLQCSENLNKDGEVGEGIIGEDIHDGDNAKIDFSVLSIVDKETKNDIQESFNISKIDSDYVLNDTLKKVHLITFEGLKGK

SEQ ID NO: 28662 - protein, 113 aa, Diabrotica virgifera
  misc_feature: Coding regions on vcDNA: vcDNA=SeqID_8359; Strand=+; Position=9-347
  misc_feature: Homolog annotation: Hit_ID=XP_311860.1; Match level="QueryCoverage =91%, HitCoverage=12%, E-value=1e-30, Identity=66%"; Hit description =ENSANGP00000018217 [Anopheles gambiae]
  misc_feature: Gene Ontology Annotation: Molecular function=protein binding; Cellular component=coated pit; Biological process=synaptic transmission
  misc_feature (20)..(21): Xaa can be any naturally occurring amino acid
  misc_feature (23)..(23): Xaa can be any naturally occurring amino acid
SGAGKYRERIPFDLNDEKKXXFXNLWYSKIEERIGTPYLQRVLNQQLTNHIRDTLPSLRDKLQKQLLQLEKDVDQFIHFRPDDPSIKTKGMLHMIQQLKVVFDRPIVGSDFFS

SEQ ID NO: 28663 - protein, 77 aa, Diabrotica virgifera
  misc_feature: Coding regions on vcDNA: vcDNA=SeqID_8360; Strand=+; Position=178-411
  misc_feature (4)..(11): Xaa can be any naturally occurring amino acid
  misc_feature (17)..(36): Xaa can be any naturally occurring amino acid
  misc_feature (40)..(52): Xaa can be any naturally occurring amino acid
GALXXXXXXXXWDGGGXXXXXXXXXXXXXXXXXXXXIKRXXXXXXXXXXXXXKRFYKTKLKQSFLAYKLIFIRKNLF

SEQ ID NO: 28664 - protein, 100 aa, Diabrotica virgifera
  misc_feature: Coding regions on vcDNA: vcDNA=SeqID_8361; Strand=-; Position=194-496
  misc_feature (2)..(58): Xaa can be any naturally occurring amino acid
  misc_feature (63)..(74): Xaa can be any naturally occurring amino acid
PXXXXXXXXXXXXXXXXXXXXXXXXXXXXXXXXXXXXXXXXXXXXXXXXXXXXXXXXXGPPFXXXXXXXXXXXXIETPPRAPPPGLNSESRKNFKKLNQT

SEQ ID NO: 28665 - protein, 43 aa, Diabrotica virgifera
  misc_feature: Coding regions on vcDNA: vcDNA=SeqID_8362; Strand=-; Position=1-129
  misc_feature (2)..(9): Xaa can be any naturally occurring amino acid
  misc_feature (11)..(37): Xaa can be any naturally occurring amino acid
  misc_feature (39)..(43): Xaa can be any naturally occurring amino acid
KXXXXXXXXLXXXXXXXXXXXXXXXXXXXXXXXXXXXQXXXXX

SEQ ID NO: 28666 - protein, 72 aa, Diabrotica virgifera
  misc_feature: Coding regions on vcDNA: vcDNA=SeqID_8363; Strand=-; Position=1-216
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PFXXXXXXXXXXXTNLAHTGLNXXXXXXXXSNXXXXXXXXXXXXXXPTSRSXXXXXXXXXXXXXXVIPKVIY

SEQ ID NO: 28667 - protein, 26 aa, Diabrotica virgifera
  misc_feature: Coding regions on vcDNA: vcDNA=SeqID_8364; Strand=+; Position=1-78
  misc_feature (2)..(20): Xaa can be any naturally occurring amino acid
NXXXXXXXXXXXXXXXXXXXKKKLPL

SEQ ID NO: 28668 - protein, 331 aa, Diabrotica virgifera
  misc_feature: Coding regions on vcDNA: vcDNA=SeqID_8365; Strand=-; Position=1-993
  misc_feature (1)..(331): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 28669 - protein, 89 aa, Diabrotica virgifera
  misc_feature: Coding regions on vcDNA: vcDNA=SeqID_8366; Strand=+; Position=631-897
LVGNHILFFKYKDEFVWDKVFDALQIQNTMFSVFGIIYCVHFVGMASKRKQLFIYGYALGWFVSFVAHFLFNIAPDISNECSPYQLFLR

SEQ ID NO: 28670 - protein, 52 aa, Diabrotica virgifera
  misc_feature: Coding regions on vcDNA: vcDNA=SeqID_8367; Strand=-; Position=1-156
  misc_feature (2)..(48): Xaa can be any naturally occurring amino acid
GXXXXXXXXXXXXXXXXXXXXXXXXXXXXXXXXXXXXXXXXXXXXXXXLYRV

SEQ ID NO: 28671 - protein, 134 aa, Diabrotica virgifera
  misc_feature: Coding regions on vcDNA: vcDNA=SeqID_8368; Strand=-; Position=49-452
  misc_feature: Homolog annotation: Hit_ID=S36442; Match level="QueryCoverage=61%, HitCoverage=57%, E-value=1e-13, Identity=48%"; Hit description =reverse transcriptase-like protein - bovine (fragment)
  misc_feature (111)..(111): Xaa can be any naturally occurring amino acid
MSHSLKLLLKIILNRINHTCEETMGNKQFGFREGLFEYLEMIGIDDKDLRLLQHQYWNQEASILVDGEETDKICIQRGVRQGCVLSSTLFNVYSEIIFNEALEGQCGVRIXGETINNIRYADDTAIMAENIEDL

SEQ ID NO: 28672 - protein, 86 aa, Diabrotica virgifera
  misc_feature: Coding regions on vcDNA: vcDNA=SeqID_8369; Strand=+; Position=3-260
  misc_feature (1)..(5): Xaa can be any naturally occurring amino acid
  misc_feature (49)..(57): Xaa can be any naturally occurring amino acid
  misc_feature (66)..(82): Xaa can be any naturally occurring amino acid
XXXXXEIIYLRDNGGIFMGKVQSKKKDGDLHGGLKFIMGGTAFFLIRSXXXXXXXXXLKPGGGPGXXXXXXXXXXXXXXXXXRGHT

SEQ ID NO: 28673 - protein, 74 aa, Diabrotica virgifera
  misc_feature: Coding regions on vcDNA: vcDNA=SeqID_8370; Strand=-; Position=0-221
  misc_feature (11)..(19): Xaa can be any naturally occurring amino acid
  misc_feature (24)..(45): Xaa can be any naturally occurring amino acid
  misc_feature (47)..(70): Xaa can be any naturally occurring amino acid
KKNFRGFSPEXXXXXXXXXKRIGXXXXXXXXXXXXXXXXXXXXXXPXXXXXXXXXXXXXXXXXXXXXXXXFIGS

SEQ ID NO: 28674 - protein, 71 aa, Diabrotica virgifera
  misc_feature: Coding regions on vcDNA: vcDNA=SeqID_8371; Strand=+; Position=548-760
  misc_feature (40)..(40): Xaa can be any naturally occurring amino acid
EGRHHYLSEIFFFRYKQSRAIDLFIHSHLFRASVMCHIIXNILRHTLLVYILHLIYLPLHVIRVIAPRRHM

SEQ ID NO: 28675 - protein, 119 aa, Diabrotica virgifera
  misc_feature: Coding regions on vcDNA: vcDNA=SeqID_8372; Strand=+; Position=3-362
  misc_feature (10)..(17): Xaa can be any naturally occurring amino acid
TNLFVFYNLXXXXXXXXVRCMVFKVVAGIRPKGCRFSVKMANFQPRMAQEVLSFQKIVIEQVLLRDRISSLFRGYFDQNIFHPEKGWEPPPRWKRTSAWGRLCFLSYSLLTVKISSKSM

SEQ ID NO: 28676 - protein, 111 aa, Diabrotica virgifera
  misc_feature: Coding regions on vcDNA: vcDNA=SeqID_8373; Strand=-; Position=1-333
  misc_feature (29)..(111): Xaa can be any naturally occurring amino acid
FQPWGSPIFIYGFDLSNKNSPVIPKVILXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 28677 - protein, 46 aa, Diabrotica virgifera
  misc_feature: Coding regions on vcDNA: vcDNA=SeqID_8374; Strand=-; Position=0-137
  misc_feature (1)..(25): Xaa can be any naturally occurring amino acid
  misc_feature (28)..(28): Xaa can be any naturally occurring amino acid
  misc_feature (30)..(45): Xaa can be any naturally occurring amino acid
XXXXXXXXXXXXXXXXXXXXXXXXXPSXPXXXXXXXXXXXXXXXXR

SEQ ID NO: 28678 - protein, 151 aa, Diabrotica virgifera
  misc_feature: Coding regions on vcDNA: vcDNA=SeqID_8375; Strand=+; Position=2-457
  misc_feature: Homolog annotation: Hit_ID=XP_391867.1; Match level="QueryCoverage =90%, HitCoverage=33%, E-value=2e-28, Identity=40%"; Hit description =similar to CG16708-PA [Apis mellifera]
  misc_feature: Gene Ontology Annotation: Molecular function=magnesium ion binding; Cellular component=integral membrane protein of membrane fraction; Biological process=protein kinase C activation
  misc_feature (70)..(70): Xaa can be any naturally occurring amino acid
ENCDKCENSRELKMNKLGCKWQTLSGKFFMVTGANISCACSRSPKGIAPFSHLGDGMVHLVLVKHTSVLXNVRLLLRLSSNDPSIEDLPLRGDFMRARICFRAIEGNSKWNCDGEVQHQINIRAKVRCQLLTIFSRGRPRDCSVDPTCCGF

SEQ ID NO: 28679 - protein, 185 aa, Diabrotica virgifera
  misc_feature: Coding regions on vcDNA: vcDNA=SeqID_8376; Strand=+; Position=680-1234
  misc_feature: Homolog annotation: Hit_ID=CAD22154.1; Match level="QueryCoverage =92%, HitCoverage=53%, E-value=1e-42, Identity=49%"; Hit description =pherophorin-dz1 protein [Volvox carteri f. nagariensis]
  misc_feature: Gene Ontology Annotation: Molecular function=RNA binding; Cellular component=nucleus; Biological process=mRNA processing
  misc_feature (79)..(79): Xaa can be any naturally occurring amino acid
  misc_feature (106)..(112): Xaa can be any naturally occurring amino acid
  misc_feature (120)..(120): Xaa can be any naturally occurring amino acid
  misc_feature (122)..(129): Xaa can be any naturally occurring amino acid
RYYQVKIHRLSKGIPAPFSLCSPARPGAPPPPPPPAFLPLPPPTQPPHASSSPSPPPTAPQIYSLPSAAPPPPLHPLHXPPRPPLPPPPPPPLPSHTPAPAPPSPXXXXXXXSPPPPPPXRXXXXXXXXPLPPPPPPQLQPPPPLSPPSSPPPSTPLPLPPPPLPPIPPPLPPTPSPAHAPLLLP

SEQ ID NO: 28680 - protein, 62 aa, Diabrotica virgifera
  misc_feature: Coding regions on vcDNA: vcDNA=SeqID_8377; Strand=-; Position=187-375
  misc_feature (8)..(24): Xaa can be any naturally occurring amino acid
  misc_feature (42)..(48): Xaa can be any naturally occurring amino acid
GSPLFCIXXXXXXXXXXXXXXXXXTHPGGSPPRVFKTHKIQXXXXXXXGTRVINKLSCFPPN

SEQ ID NO: 28681 - protein, 253 aa, Diabrotica virgifera
  misc_feature: Coding regions on vcDNA: vcDNA=SeqID_8378; Strand=-; Position=115-875
  misc_feature: Homolog annotation: Hit_ID=AAV34835.1; Match level="QueryCoverage =100%, HitCoverage=81%, E-value=5e-75, Identity=58%"; Hit description= ribosomal protein L23A [Bombyx mori]
  misc_feature: Gene Ontology Annotation: Molecular function=structural constituent of ribosome; Cellular component=cytosolic large ribosomal subunit (sensu Eukarya); Biological process=ribosomal large subunit assembly and maintenance
  misc_feature: Pfam annotation: Pfam_ID=Ribosomal_L23; Match level="Score=100.1, E -value=5.7e-27, Copies=1"; Pfam description=Ribosomal protein L23
  misc_feature (27)..(27): Xaa can be any naturally occurring amino acid
KPPRPAPKQQPNSKQPSAKKLFSQKPXSPAPKTASPKAPGKPSCSPQPKAAAVKAGKAAAKGAANPAAKAAGKNPAAAGKAKAPATLIAKPKKNVPVKQHQKGVGKKPAASAVQVARALKIQKKVIKGPNGTHSRKIRNSVHFRRPKTLRPPRSPKYPKRSVPHRSRMDAYNIIKFPLTTEAAMKKIEDNNTLVFLVHTRANKHHIKAAVKKLYDINVAKVNTLIRPDGKKKAYVRLARDYDALDVANKIGII

SEQ ID NO: 28682 - protein, 66 aa, Diabrotica virgifera; identical to SEQ ID NO: 26808
  misc_feature: Coding regions on vcDNA: vcDNA=SeqID_8379; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28683 - protein, 90 aa, Diabrotica virgifera
  misc_feature: Coding regions on vcDNA: vcDNA=SeqID_8380; Strand=+; Position=547-819
  misc_feature (77)..(77): Xaa can be any naturally occurring amino acid
  misc_feature (79)..(85): Xaa can be any naturally occurring amino acid
MFKSISVALNHHFNSPSPISPRICTTIILLEFKYVLTPPPQLLQYFFPFCLSSFIRAWYSTELNQPSNYQKRRFYNXLXXXXXXXLLLFM

SEQ ID NO: 28684 - protein, 179 aa, Diabrotica virgifera
  misc_feature: Coding regions on vcDNA: vcDNA=SeqID_8381; Strand=-; Position=0-536
  misc_feature (2)..(15): Xaa can be any naturally occurring amino acid
  misc_feature (17)..(56): Xaa can be any naturally occurring amino acid
  misc_feature (59)..(67): Xaa can be any naturally occurring amino acid
  misc_feature (69)..(93): Xaa can be any naturally occurring amino acid
  misc_feature (97)..(139): Xaa can be any naturally occurring amino acid
  misc_feature (144)..(157): Xaa can be any naturally occurring amino acid
  misc_feature (159)..(165): Xaa can be any naturally occurring amino acid
GXXXXXXXXXXXXXXGXXXXXXXXXXXXXXXXXXXXXXXXXXXXXXXXXXXXXXXXGGXXXXXXXXXHXXXXXXXXXXXXXXXXXXXXXXXXXPPPXXXXXXXXXXXXXXXXXXXXXXXXXXXXXXXXXXXXXXXXXXXPPPAXXXXXXXXXXXXXXGXXXXXXXLPPFFGGGGGRPPP

SEQ ID NO: 28685 - protein, 49 aa, Diabrotica virgifera
  misc_feature: Coding regions on vcDNA: vcDNA=SeqID_8382; Strand=-; Position=465-614
  misc_feature (3)..(10): Xaa can be any naturally occurring amino acid
CKXXXXXXXXLRLTNNFTSLNCVLFILIDKTFRNVYSVIRCTYIYSANY

SEQ ID NO: 28686 - protein, 43 aa, Diabrotica virgifera
  misc_feature: Coding regions on vcDNA: vcDNA=SeqID_8383; Strand=-; Position=2-130
  misc_feature (15)..(29): Xaa can be any naturally occurring amino acid
  misc_feature (31)..(40): Xaa can be any naturally occurring amino acid
KKSHVFNNQVQTRFXXXXXXXXXXXXXXXFXXXXXXXXXXLNN

SEQ ID NO: 28687 - protein, 168 aa, Diabrotica virgifera
  misc_feature: Coding regions on vcDNA: vcDNA=SeqID_8384; Strand=+; Position=297-801
  misc_feature: Homolog annotation: Hit_ID=EAL29441.1; Match level="QueryCoverage =98%, HitCoverage=84%, E-value=2e-70, Identity=77%"; Hit description =GA11315-PA [Drosophila pseudoobscura]
  misc_feature: Gene Ontology Annotation: Molecular function=N-acetyltransferase activity; Cellular component=nucleus; Biological process=chromosome organization and biogenesis (sensu Eukarya)
  misc_feature: Pfam annotation: Pfam_ID=Acetyltransf_1; Match level="Score=70.6, E -value=4.3e-18, Copies=1"; Pfam description=Acetyltransferase (GNAT) family
  misc_feature (57)..(68): Xaa can be any naturally occurring amino acid
  misc_feature (136)..(136): Xaa can be any naturally occurring amino acid
MNIRCAKPEDLMNMQHCNLLCLPENYQMKYYFYHGLSWPQLSYVAEDEKGNIVGYVXXXXXXXXXXXXHGHITSLAVKRSHRRLGLAQKLMDQASEAMVECFDAKYVSLHVRKSNRAALNLYKNSLKFETVEIEPXYYADGEDAYSMRRDLSEFAKKVKPKSETKNEE

SEQ ID NO: 28688 - protein, 425 aa, Diabrotica virgifera
  misc_feature: Coding regions on vcDNA: vcDNA=SeqID_8385; Strand=-; Position=84-1361
  misc_feature (10)..(76): Xaa can be any naturally occurring amino acid
  misc_feature (81)..(87): Xaa can be any naturally occurring amino acid
  misc_feature (90)..(99): Xaa can be any naturally occurring amino acid
  misc_feature (103)..(149): Xaa can be any naturally occurring amino acid
  misc_feature (162)..(189): Xaa can be any naturally occurring amino acid
  misc_feature (192)..(200): Xaa can be any naturally occurring amino acid
  misc_feature (209)..(216): Xaa can be any naturally occurring amino acid
  misc_feature (219)..(226): Xaa can be any naturally occurring amino acid
  misc_feature (228)..(353): Xaa can be any naturally occurring amino acid
  misc_feature (359)..(380): Xaa can be any naturally occurring amino acid
  misc_feature (387)..(398): Xaa can be any naturally occurring amino acid
  misc_feature (406)..(423): Xaa can be any naturally occurring amino acid
  misc_feature (425)..(425): Xaa can be any naturally occurring amino acid
GGGGDGGGLXXXXXXXXXXXXXXXXXXXXXXXXXXXXXXXXXXXXXXXXXXXXXXXXXXXXXXXXXXXXXXXXXXXLNTAXXXXXXXLLXXXXXXXXXXPFLXXXXXXXXXXXXXXXXXXXXXXXXXXXXXXXXXXXXXXXXXXXXXXXGGGKKNPPPPLYXXXXXXXXXXXXXXXXXXXXXXXXXXXXRGXXXXXXXXXAPPPLSHPXXXXXXXXKTXXXXXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRKPLSXXXXXXXXXXXXXXXXXXXXXXVFFKFRXXXXXXXXXXXXIPRKPPKXXXXXXXXXXXXXXXXXXQX

SEQ ID NO: 28689 - protein, 29 aa, Diabrotica virgifera
  misc_feature: Coding regions on vcDNA: vcDNA=SeqID_8386; Strand=-; Position=1-87
  misc_feature (1)..(1): Xaa can be any naturally occurring amino acid
XTRKYKVTSQSHSVSLVVRSENSCCDVLS

SEQ ID NO: 28690 - protein, 70 aa, Diabrotica virgifera
  misc_feature: Coding regions on vcDNA: vcDNA=SeqID_8387; Strand=-; Position=167-379
INEKFSGTKVTKHLDAISAPYFFLAPQLKLPLSQSSHISKFVRLDTLKLLTNFQLAINQLFFICGNQTYY

SEQ ID NO: 28691 - protein, 73 aa, Diabrotica virgifera
  misc_feature: Coding regions on vcDNA: vcDNA=SeqID_8388; Strand=+; Position=1-219
  misc_feature (1)..(29): Xaa can be any naturally occurring amino acid
  misc_feature (32)..(51): Xaa can be any naturally occurring amino acid
XXXXXXXXXXXXXXXXXXXXXXXXXXXXXGVXXXXXXXXXXXXXXXXXXXXTPILFNYYKQISPQAKRGNFFS

SEQ ID NO: 28692 - protein, 61 aa, Diabrotica virgifera
  misc_feature: Coding regions on vcDNA: vcDNA=SeqID_8389; Strand=+; Position=93-278
  misc_feature (10)..(22): Xaa can be any naturally occurring amino acid
  misc_feature (39)..(50): Xaa can be any naturally occurring amino acid
LLLVSTYTYXXXXXXXXXXXXXYYHSIFIFILVIVSIMXXXXXXXXXXXXNSEKRLNTLIK

SEQ ID NO: 28693 - protein, 195 aa, Diabrotica virgifera
  misc_feature: Coding regions on vcDNA: vcDNA=SeqID_8390; Strand=+; Position=21-608
  misc_feature: Homolog annotation: Hit_ID=XP_310955.1; Match level="QueryCoverage =90%, HitCoverage=41%, E-value=8e-57, Identity=58%"; Hit description =ENSANGP00000019418 [Anopheles gambiae]
  misc_feature: Pfam annotation: Pfam_ID=AIRC; Match level="Score=161.5, E-value=1.8e- 45, Copies=1"; Pfam description=AIR carboxylase
SAIHSKFLFTVSRSLSVTVKRNFEWIADQLDHLIPPNNHLVVIIMGSPADKDHCNKIKQQCEDLGLNVEIRVASAHKTTDFALELVSYYEGMNIPLIFIAVAGRSNGLGPVISGNTDYPVINCPPGSRDDLSRDIWSSVNVPSGLGCSTVIYPETAALCAATNIAMTNYIVWSRLCLRRLGYFESLPKADKAMRS

SEQ ID NO: 28694 - protein, 43 aa, Diabrotica virgifera
  misc_feature: Coding regions on vcDNA: vcDNA=SeqID_8391; Strand=-; Position=14-145
  misc_feature (34)..(40): Xaa can be any naturally occurring amino acid
LVRYFHDQLLGHFDLLLHIGCFSLFLCFIVLCFXXXXXXXASK

SEQ ID NO: 28695 - protein, 111 aa, Diabrotica virgifera
  misc_feature: Coding regions on vcDNA: vcDNA=SeqID_8392; Strand=-; Position=0-332
  misc_feature (67)..(67): Xaa can be any naturally occurring amino acid
PPESVISSQNRGAERSVFRAVWGRFVEGGPTCSFSVVLPWPATICGGRVKEMIFFLHPPIYLSILGXEKILPPFPRSFFEDFFTKYCASCARKGASRLLVVISGARKGALA

SEQ ID NO: 28696 - protein, 148 aa, Diabrotica virgifera
  misc_feature: Coding regions on vcDNA: vcDNA=SeqID_8393; Strand=-; Position=2-445
FPSPFIRKIGVGHVFLLWDRFSGVADDAIIRRDVQSHLWLQLLRPCRAPDINDFSCRVTGAAFRRYVPACCIAVMRCSLIQFCPVLSSSGSWHTLLPKEPLMWTGSEAYIYYEDWHIPRSHRYQSLVLYSNEKCHRVLFFSSSGPFRG

SEQ ID NO: 28697 - protein, 97 aa, Diabrotica virgifera
  misc_feature: Coding regions on vcDNA: vcDNA=SeqID_8394; Strand=+; Position=2-295
  misc_feature (1)..(54): Xaa can be any naturally occurring amino acid
XXXXXXXXXXXXXXXXXXXXXXXXXXXXXXXXXXXXXXXXXXXXXXXXXXXXXXPLGENSGNFIWERFQTGIIKKWATPSRVGFKRFNKLGGKPSLN

SEQ ID NO: 28698 - protein, 61 aa, Diabrotica virgifera
  misc_feature: Coding regions on vcDNA: vcDNA=SeqID_8395; Strand=-; Position=587-772
LTNVCAKKLRIRLYRTLMAPAFTYRSEAWTLTKTDESSLLILKKNVLRKISERSVETESVT

SEQ ID NO: 28699 - protein, 161 aa, Diabrotica virgifera
  misc_feature: Coding regions on vcDNA: vcDNA=SeqID_8396; Strand=+; Position=2-487
  misc_feature (59)..(69): Xaa can be any naturally occurring amino acid
LTRPLRVRTGWSKARGLYDAEGRFCHGGGCRPILGVEIFYCVLTAKVGKDIHFEQKMFXXXXXXXXXXXICSLSRVLVLYRGNQWFSILYSFTILSIVVVKGFCLKIYSCKLYILSLLIKTVSRITICTSIYLDPRGVLLKMKGKPLSGLQDRLYKLIDAR

SEQ ID NO: 28700 - protein, 93 aa, Diabrotica virgifera
  misc_feature: Coding regions on vcDNA: vcDNA=SeqID_8397; Strand=-; Position=1-279
  misc_feature (1)..(93): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 28701 - protein, 318 aa, Diabrotica virgifera
  misc_feature: Coding regions on vcDNA: vcDNA=SeqID_8398; Strand=+; Position=3-956
  misc_feature: Homolog annotation: Hit_ID=AAM78590.1; Match level="QueryCoverage =100%, HitCoverage=18%, E-value=3e-35, Identity=35%"; Hit description= midgut cadherin-like protein [Chilo suppressalis]
  misc_feature: Gene Ontology Annotation: Molecular function=G-protein coupled receptor activity; Cellular component=integral to membrane; Biological process=G-protein coupled receptor protein signaling pathway
  misc_feature: Pfam annotation: Pfam_ID=Cadherin; Match level="Score=22.7, E-value =0.0011, Copies=1"; Pfam description=Cadherin domain
  misc_feature (300)..(300): Xaa can be any naturally occurring amino acid
LEDYNDELPIFEKESYTTEINETVANGTQILYTHATDRDAEDFELKMNIVGTYAENRLSIDKDGNIKVKVVNAFDYDVLNSVYFQVTATDKVNHVTRVPVTINILDVNNKAPVINQVDHIQIEENQQNGVVLNVTITATDVDTTANLTATINWEDSKVTKTNGAVVKTDAVIKAMQFLEIENTQTDDGLEMKLKVINNNDDNPDKPDFETFDTLYLSIVVEDRNTDPDFEQNRYTEGQIVINILDVNDNPPYFPPSNDDTRQVQEMSLKGVSVGSIKAVDVDLNSEITYHCTPEYEKFDXVDVNLTTGAITGKNDKQV

SEQ ID NO: 28702 - protein, 138 aa, Diabrotica virgifera
  misc_feature: Coding regions on vcDNA: vcDNA=SeqID_8399; Strand=+; Position=3-419
  misc_feature (5)..(5): Xaa can be any naturally occurring amino acid
  misc_feature (7)..(14): Xaa can be any naturally occurring amino acid
  misc_feature (16)..(86): Xaa can be any naturally occurring amino acid
  misc_feature (88)..(118): Xaa can be any naturally occurring amino acid
  misc_feature (121)..(134): Xaa can be any naturally occurring amino acid
LTRPXIXXXXXXXXFXXXXXXXXXXXXXXXXXXXXXXXXXXXXXXXXXXXXXXXXXXXXXXXXXXXXXXXXXXXXXXXXXXXXXXXCXXXXXXXXXXXXXXXXXXXXXXXXXXXXXXXIHXXXXXXXXXXXXXXLVSK

SEQ ID NO: 28703 - protein, 28 aa, Diabrotica virgifera
  misc_feature: Coding regions on vcDNA: vcDNA=SeqID_8400; Strand=-; Position=1-84
  misc_feature (15)..(27): Xaa can be any naturally occurring amino acid
DYKNKLPLIQHRGRXXXXXXXXXXXXXL

SEQ ID NO: 28704 - protein, 251 aa, Diabrotica virgifera
  misc_feature: Coding regions on vcDNA: vcDNA=SeqID_8401; Strand=+; Position=38-790
  misc_feature: Homolog annotation: Hit_ID=NP_777225.1; Match level="QueryCoverage =98%, HitCoverage=41%, E-value=7e-16, Identity=26%"; Hit description =p97 protein [Bos taurus] dbj|BAA20065.1| bucentaur [Bos taurus]
  misc_feature: Pfam annotation: Pfam_ID=Exo_endo_phos; Match level="Score=-16.7, E -value=0.043, Copies=1"; Pfam description =Endonuclease/Exonuclease/phosphatase f
  misc_feature (107)..(116): Xaa can be any naturally occurring amino acid
  misc_feature (152)..(160): Xaa can be any naturally occurring amino acid
  misc_feature (191)..(197): Xaa can be any naturally occurring amino acid
  misc_feature (228)..(228): Xaa can be any naturally occurring amino acid
CQYKKLDKLTARKRKCKDHKETTRQEIGNDNGKQDKKNIWRLATWNIRGLNGKETELSYEFDKNKIEILGITETKKKGIGEIYLEGGHLLIYSGVPPEKRAAAGVGXXXXXXXXXXIQDWKGWSERIVALEMKDEQGEPQTIITAYGPDENXXXXXXXXXWTDLNIAIENSKGRIYVIGDFNGRVGIKDEXXXXXXXRYGEEVRNDNGKRLIEFCVLNNLIVTNTHYXHKDIHKFTRQGPRESEKSIIDYI

SEQ ID NO: 28705 - protein, 92 aa, Diabrotica virgifera
  misc_feature: Coding regions on vcDNA: vcDNA=SeqID_8402; Strand=+; Position=60-338
NVYSCKQFSGHLRFKQFSQNGDLKTHLRVHFSEACSLKTHLRYKCEICCKQFREHFRFSETCSLKTHLRYKCVICFKQFSGHLRMHTVFSKW

SEQ ID NO: 28706 - protein, 130 aa, Diabrotica virgifera
  misc_feature: Coding regions on vcDNA: vcDNA=SeqID_8403; Strand=-; Position=3-395
RYLSVQGHQLAFDGSSRFGLSTSLIFCLLRSFSVLLPCSGLACSLGLVSLLVRLFVRFAASLAMAPPLCFACLLCVVCVGLRSRWGFSALRRWVVLCVLSFSLVFLCLCFRCGLRLVKASAVFLRVFPAA

SEQ ID NO: 28707 - protein, 72 aa, Diabrotica virgifera
  misc_feature: Coding regions on vcDNA: vcDNA=SeqID_8404; Strand=-; Position=2-217
TKVSLSTLRGVALKRLSMQVLSRECPVDATYLVLLSDSEPVNDSIHTLTGGGRRDLQHVGPHDGGAGGTSIY

SEQ ID NO: 28708 - protein, 115 aa, Diabrotica virgifera
  misc_feature: Coding regions on vcDNA: vcDNA=SeqID_8405; Strand=+; Position=553-897
  misc_feature (12)..(18): Xaa can be any naturally occurring amino acid
  misc_feature (72)..(96): Xaa can be any naturally occurring amino acid
  misc_feature (101)..(114): Xaa can be any naturally occurring amino acid
GLFLIFKCYIFXXXXXXXGLREEEVEVDEKRKMMRKRRRINGQEMDKILYILNEWNLRISIKNKNQVLPIIXXXXXXXXXXXXXXXXXXXXXXXXXDWNIXXXXXXXXXXXXXXV

SEQ ID NO: 28709 - protein, 189 aa, Diabrotica virgifera
  misc_feature: Coding regions on vcDNA: vcDNA=SeqID_8406; Strand=-; Position=3-570
  misc_feature: Homolog annotation: Hit_ID=CAB40769.1; Match level="QueryCoverage =90%, HitCoverage=26%, E-value=4e-14, Identity=32%"; Hit description =extensin-like protein [Arabidopsis thaliana] emb|CAB78376.1| extensin-like protein [Arabidopsis thaliana]
  misc_feature (84)..(84): Xaa can be any naturally occurring amino acid
NQNSPPFVSRSRNIWWGILPVEPKPYPAPSTERPIVIVYTPPTPPQNPEPTTKGPTVIIYPPEPTHRPIPPPPNPRTVFITFNXISSRVLSYFPYPEPPPPPNPRPVIIIPPRPCSANPQRPIYIPNWPQYRNIWEYYQYIQQPCTRMQPQPPVSIDPVPLPVPNLPRPSCSTPGYTLIYRLRPQSTPR

SEQ ID NO: 28710 - protein, 105 aa, Diabrotica virgifera
  misc_feature: Coding regions on vcDNA: vcDNA=SeqID_8407; Strand=+; Position=680-994
  misc_feature (28)..(43): Xaa can be any naturally occurring amino acid
  misc_feature (46)..(53): Xaa can be any naturally occurring amino acid
  misc_feature (56)..(70): Xaa can be any naturally occurring amino acid
  misc_feature (73)..(80): Xaa can be any naturally occurring amino acid
  misc_feature (86)..(102): Xaa can be any naturally occurring amino acid
NDRAILIVLKYHYPLLFLLKAVMKAGVXXXXXXXXXXXXXXXXKKXXXXXXXXKTXXXXXXXXXXXXXXXFTXXXXXXXXGEKHTXXXXXXXXXXXXXXXXXNFF

SEQ ID NO: 28711 - protein, 56 aa, Diabrotica virgifera
  misc_feature: Coding regions on vcDNA: vcDNA=SeqID_8408; Strand=-; Position=0-167
  misc_feature (7)..(37): Xaa can be any naturally occurring amino acid
  misc_feature (39)..(55): Xaa can be any naturally occurring amino acid
LRVILFXXXXXXXXXXXXXXXXXXXXXXXXXXXXXXXPXXXXXXXXXXXXXXXXXP

SEQ ID NO: 28712 - protein, 166 aa, Diabrotica virgifera
  misc_feature: Coding regions on vcDNA: vcDNA=SeqID_8409; Strand=+; Position=202-702
  misc_feature: Homolog annotation: Hit_ID=XP_393971.1; Match level="QueryCoverage =95%, HitCoverage=32%, E-value=3e-22, Identity=36%"; Hit description =similar to cytochrome P450 [Apis mellifera]
FVNELGMLQLVLIAVVIVLFYYCAIRPMKYWKERGVIQGRPIWLFGDNWRAFFRLETFGQPYHTAYKLDPDARYVGFYQFTVPTLMIRDPELLKQITVKDSDYFTNHRAIVPDEGDPLWTNNLLGLKDQKWKDMRHILTPSFTSTLMVECAENFVTHFLKKNQDVF

SEQ ID NO: 28713 - protein, 34 aa, Diabrotica virgifera
  misc_feature: Coding regions on vcDNA: vcDNA=SeqID_8410; Strand=+; Position=1-102
  misc_feature (30)..(30): Xaa can be any naturally occurring amino acid
VYCIFLGINISLSFHLSVSLVVLKLNHDCXKNRL

SEQ ID NO: 28714 - protein, 90 aa, Diabrotica virgifera
  misc_feature: Coding regions on vcDNA: vcDNA=SeqID_8411; Strand=+; Position=567-839
  misc_feature (48)..(48): Xaa can be any naturally occurring amino acid
KPNKTPWFRLQQEIKTKCNEKQEANLKNRSQQAPEAYNNYKRIRNETXALVKKTKDEILAGFLIKNGSRLLGTAKQIWRFILTQKKEISD

SEQ ID NO: 28715 - protein, 202 aa, Diabrotica virgifera
  misc_feature: Coding regions on vcDNA: vcDNA=SeqID_8412; Strand=+; Position=75-679
  misc_feature: Homolog annotation: Hit_ID=AAR01309.1; Match level="QueryCoverage =96%, HitCoverage=26%, E-value=5e-26, Identity=37%"; Hit description =elongation factor-2 [Periplaneta americana]
  misc_feature: Gene Ontology Annotation: Molecular function=ATP binding; Biological process=protein biosynthesis
  misc_feature (57)..(57): Xaa can be any naturally occurring amino acid
  misc_feature (73)..(73): Xaa can be any naturally occurring amino acid
  misc_feature (99)..(99): Xaa can be any naturally occurring amino acid
  misc_feature (117)..(117): Xaa can be any naturally occurring amino acid
  misc_feature (137)..(137): Xaa can be any naturally occurring amino acid
TIQLQSAYLCQTFLRIEAPCNGCIASYKDDSRPTLVDLGDPDHGLPACVSRLHDWAXFSLKHFSEPNADKIEXFDVVEQLIRLWMNNLFNATNDQMNRXNDDDDDGSFCMYVLDIVXKILDCIVNLPRDKYDYLLPXWTLSQNMKTSTTRELTYSALLCATVCQLSEMLVQIISILLASPVEPSKYIMHAVYTGAHAYDIRL

SEQ ID NO: 28716 - protein, 33 aa, Diabrotica virgifera
  misc_feature: Coding regions on vcDNA: vcDNA=SeqID_8413; Strand=+; Position=1-99
KNQRYVQMGNIFPGPATLPFIANANLTMGKSRS

SEQ ID NO: 28717 - protein, 216 aa, Diabrotica virgifera
  misc_feature: Coding regions on vcDNA: vcDNA=SeqID_8414; Strand=+; Position=230-882
  misc_feature: Homolog annotation: Hit_ID=NP_733202.1; Match level="QueryCoverage =94%, HitCoverage=98%, E-value=2e-57, Identity=50%"; Hit description =CG31063-PA [Drosophila melanogaster] gb|AAF56679.2| CG31063-PA [Drosophila melanogaster]
  misc_feature: Pfam annotation: Pfam_ID=NUDIX; Match level="Score=21.5, E-value =0.0026, Copies=1"; Pfam description=NUDIX domain
  misc_feature (94)..(99): Xaa can be any naturally occurring amino acid
  misc_feature (160)..(160): Xaa can be any naturally occurring amino acid
  misc_feature (196)..(196): Xaa can be any naturally occurring amino acid
  misc_feature (199)..(199): Xaa can be any naturally occurring amino acid
MDDVSKIVIQPLRESIYLKPYTMHFVQNGTKRTWDLLTVHDSVAIILFNVSRNVLILVKQFRPAVYYGSIPEKDRIMGEELDTKKYPPELGITXXXXXXIIDKNKSEAEIAKEEVLEECGYDVPVSSMQKIGSYRSGVGTSASLQTAFYCEVTDDMKVSXGGGVDDEIIDVVEMTVEEMKKYVTQNYIKSPPSFMXCMXWFLYNKQSDVTMILDNL

SEQ ID NO: 28718 - protein, 34 aa, Diabrotica virgifera
  misc_feature: Coding regions on vcDNA: vcDNA=SeqID_8415; Strand=-; Position=0-101
  misc_feature (1)..(33): Xaa can be any naturally occurring amino acid
XXXXXXXXXXXXXXXXXXXXXXXXXXXXXXXXXG

SEQ ID NO: 28719 - protein, 35 aa, Diabrotica virgifera
  misc_feature: Coding regions on vcDNA: vcDNA=SeqID_8416; Strand=-; Position=0-104
  misc_feature (1)..(17): Xaa can be any naturally occurring amino acid
  misc_feature (20)..(34): Xaa can be any naturally occurring amino acid
XXXXXXXXXXXXXXXXXNNXXXXXXXXXXXXXXXA

SEQ ID NO: 28720 - protein, 37 aa, Diabrotica virgifera
  misc_feature: Coding regions on vcDNA: vcDNA=SeqID_8417; Strand=-; Position=1-111
  misc_feature (2)..(2): Xaa can be any naturally occurring amino acid
  misc_feature (5)..(5): Xaa can be any naturally occurring amino acid
  misc_feature (8)..(36): Xaa can be any naturally occurring amino acid
SXPNXIIXXXXXXXXXXXXXXXXXXXXXXXXXXXXXL

SEQ ID NO: 28721 - protein, 348 aa, Diabrotica virgifera
  misc_feature: Coding regions on vcDNA: vcDNA=SeqID_8418; Strand=+; Position=81-1118
  misc_feature: Homolog annotation: Hit_ID=XP_308283.1; Match level="QueryCoverage =96%, HitCoverage=31%, E-value=1e-75, Identity=52%"; Hit description =ENSANGP00000010728 [Anopheles gambiae]
  misc_feature: Gene Ontology Annotation: Molecular function=protein kinase activity; Biological process=signal transduction
  misc_feature: Pfam annotation: Pfam_ID=HR1; Match level="Score=33.1, E-value=8.1e -07, Copies=1"; Pfam description=Hr1 repeat
  misc_feature (200)..(200): Xaa can be any naturally occurring amino acid
  misc_feature (217)..(217): Xaa can be any naturally occurring amino acid
  misc_feature (221)..(221): Xaa can be any naturally occurring amino acid
  misc_feature (234)..(234): Xaa can be any naturally occurring amino acid
  misc_feature (244)..(244): Xaa can be any naturally occurring amino acid
  misc_feature (259)..(259): Xaa can be any naturally occurring amino acid
  misc_feature (272)..(272): Xaa can be any naturally occurring amino acid
  misc_feature (283)..(283): Xaa can be any naturally occurring amino acid
MIQSITGRDKKLLLEAQQMLQDKLKHDIDSKSRGSIQDLTDNGDLSHGELDPLLDDRIEDLKHRLRVEAAVVEGAKNVIKLLQNNNKDKSEKKALIEAQESLRASSMKLDLLKKSLEIRKSELPEDSPVAIHLKEELANAQAFSPTTMHYTSLQPFREGSENSRHLTSFSMLSRCAAVTGTLEVRLMGCQDLLEEVPGRXKKESDVPSSPMEFSFFXKTKXYSVKEEVSDDIMXAVVKLDNTTXVGQTSWRPCSQQAWXDQKFSIELEQSRXELGIDIYWEGXDPSGAAKFLKVEDFLNDEGDGMGLAFGTQKDYFLAKIKFLNPYEFQKRAPKAQKGQKKGFLAVLK

SEQ ID NO: 28722 - protein, 100 aa, Diabrotica virgifera
  misc_feature: Coding regions on vcDNA: vcDNA=SeqID_8419; Strand=+; Position=586-885
  misc_feature (59)..(69): Xaa can be any naturally occurring amino acid
  misc_feature (75)..(75): Xaa can be any naturally occurring amino acid
  misc_feature (88)..(88): Xaa can be any naturally occurring amino acid
MLLGALPSHNLQCIYIVNPKSWFPKFIHCKLLFGSAPSIIWCFLVCLLILHLECKFSIXXXXXXXXXXXFIYPRXTKCVKNFDPDAGXVIYKRMVALEGE

SEQ ID NO: 28723 - protein, 100 aa, Diabrotica virgifera
  misc_feature: Coding regions on vcDNA: vcDNA=SeqID_8420; Strand=-; Position=350-652
  misc_feature (48)..(83): Xaa can be any naturally occurring amino acid
IGGHVVLLICTLGLIFNKHLQQIFSNYLFILRSILLSERHFIVIHRAXXXXXXXXXXXXXXXXXXXXXXXXXXXXXXXXXXXXPNLLSKSKSNYVSYLHI

SEQ ID NO: 28724 - protein, 65 aa, Diabrotica virgifera
  misc_feature: Coding regions on vcDNA: vcDNA=SeqID_8421; Strand=-; Position=36-233
  misc_feature (10)..(16): Xaa can be any naturally occurring amino acid
CKLLICNFPXXXXXXXELDMVTKVLLTNSLHQWFSTILSNVPQNYHMYHRWYIYHKLRTTDVDYK

SEQ ID NO: 28725 - protein, 205 aa, Diabrotica virgifera
  misc_feature: Coding regions on vcDNA: vcDNA=SeqID_8422; Strand=-; Position=379-996
  misc_feature (19)..(51): Xaa can be any naturally occurring amino acid
  misc_feature (53)..(88): Xaa can be any naturally occurring amino acid
  misc_feature (91)..(111): Xaa can be any naturally occurring amino acid
  misc_feature (117)..(161): Xaa can be any naturally occurring amino acid
  misc_feature (166)..(183): Xaa can be any naturally occurring amino acid
  misc_feature (187)..(196): Xaa can be any naturally occurring amino acid
LLFFDLFPIKISACYPLRXXXXXXXXXXXXXXXXXXXXXXXXXXXXXXXXXPXXXXXXXXXXXXXXXXXXXXXXXXXXXXXXXXXXXXFLXXXXXXXXXXXXXXXXXXXXXPASNKXXXXXXXXXXXXXXXXXXXXXXXXXXXXXXXXXXXXXXXXXXXXXTFIKXXXXXXXXXXXXXXXXXXLNLXXXXXXXXXXFINNKDSHI

SEQ ID NO: 28726 - protein, 83 aa, Diabrotica virgifera
  misc_feature: Coding regions on vcDNA: vcDNA=SeqID_8423; Strand=-; Position=2-250
  misc_feature (1)..(17): Xaa can be any naturally occurring amino acid
  misc_feature (20)..(30): Xaa can be any naturally occurring amino acid
  misc_feature (40)..(47): Xaa can be any naturally occurring amino acid
  misc_feature (50)..(63): Xaa can be any naturally occurring amino acid
  misc_feature (69)..(82): Xaa can be any naturally occurring amino acid
XXXXXXXXXXXXXXXXXPFXXXXXXXXXXXTNLAHTGLNXXXXXXXXSNXXXXXXXXXXXXXXPTSRSXXXXXXXXXXXXXXV

SEQ ID NO: 28727 - protein, 215 aa, Diabrotica virgifera
  misc_feature: Coding regions on vcDNA: vcDNA=SeqID_8424; Strand=-; Position=538-1185
  misc_feature (3)..(24): Xaa can be any naturally occurring amino acid
  misc_feature (29)..(70): Xaa can be any naturally occurring amino acid
  misc_feature (75)..(111): Xaa can be any naturally occurring amino acid
  misc_feature (114)..(185): Xaa can be any naturally occurring amino acid
GGXXXXXXXXXXXXXXXXXXXXXXGFSGXXXXXXXXXXXXXXXXXXXXXXXXXXXXXXXXXXXXXXXXXXKCYSXXXXXXXXXXXXXXXXXXXXXXXXXXXXXXXXXXXXXGMXXXXXXXXXXXXXXXXXXXXXXXXXXXXXXXXXXXXXXXXXXXXXXXXXXXXXXXXXXXXXXXXXXXXXXXXLIKEFGNIFFTCLLKTCLFVLNIKSRLPTD

SEQ ID NO: 28728 - protein, 66 aa, Diabrotica virgifera
  misc_feature: Coding regions on vcDNA: vcDNA=SeqID_8425; Strand=-; Position=2-199
  misc_feature (3)..(13): Xaa can be any naturally occurring amino acid
  misc_feature (23)..(30): Xaa can be any naturally occurring amino acid
  misc_feature (33)..(40): Xaa can be any naturally occurring amino acid
  misc_feature (45)..(45): Xaa can be any naturally occurring amino acid
  misc_feature (52)..(65): Xaa can be any naturally occurring amino acid
PFXXXXXXXXXXXTNLAHTGLNXXXXXXXXSNXXXXXXXXPIINXNPTSRSXXXXXXXXXXXXXXV

SEQ ID NO: 28729 - protein, 68 aa, Diabrotica virgifera
  misc_feature: Coding regions on vcDNA: vcDNA=SeqID_8426; Strand=-; Position=2-205
  misc_feature (3)..(27): Xaa can be any naturally occurring amino acid
  misc_feature (29)..(67): Xaa can be any naturally occurring amino acid
LSXXXXXXXXXXXXXXXXXXXXXXXXXLXXXXXXXXXXXXXXXXXXXXXXXXXXXXXXXXXXXXXXXI

SEQ ID NO: 28730 - protein, 91 aa, Diabrotica virgifera
  misc_feature: Coding regions on vcDNA: vcDNA=SeqID_8427; Strand=+; Position=84-359
  misc_feature (16)..(28): Xaa can be any naturally occurring amino acid
DENMLFLWTKCMFCPXXXXXXXXXXXXXSFSTSKELQISKSILPPHTFVHFYVTSCLAYLNISNFVRIKLNIFIIHICIIKYSYITNIKNS

SEQ ID NO: 28731 - protein, 57 aa, Diabrotica virgifera
  misc_feature: Coding regions on vcDNA: vcDNA=SeqID_8428; Strand=-; Position=3-173
  misc_feature (1)..(14): Xaa can be any naturally occurring amino acid
  misc_feature (16)..(16): Xaa can be any naturally occurring amino acid
  misc_feature (18)..(42): Xaa can be any naturally occurring amino acid
  misc_feature (47)..(47): Xaa can be any naturally occurring amino acid
  misc_feature (50)..(50): Xaa can be any naturally occurring amino acid
  misc_feature (54)..(55): Xaa can be any naturally occurring amino acid
XXXXXXXXXXXXXXHXQXXXXXXXXXXXXXXXXXXXXXXXXXVSRLXKKXKLLXXKN

SEQ ID NO: 28732 - protein, 109 aa, Diabrotica virgifera
  misc_feature: Coding regions on vcDNA: vcDNA=SeqID_8429; Strand=-; Position=589-918
  misc_feature (3)..(4): Xaa can be any naturally occurring amino acid
  misc_feature (35)..(35): Xaa can be any naturally occurring amino acid
  misc_feature (59)..(59): Xaa can be any naturally occurring amino acid
SKXXYSFFCIARVHEVDGLFSTLFSKWSPRAILAXISVSMPRFTVTTLPLSRERLHNKXFIHCCLGYRNTSEQTKDPVHKVSRCRYMHVTVAWRGRAVVYSHASYTNYI

SEQ ID NO: 28733 - protein, 42 aa, Diabrotica virgifera
  misc_feature: Coding regions on vcDNA: vcDNA=SeqID_8430; Strand=-; Position=87-215
  misc_feature (25)..(36): Xaa can be any naturally occurring amino acid
TVRFMINFENLFIKTLFSDSGETYXXXXXXXXXXXXQCMIYL

SEQ ID NO: 28734 - protein, 70 aa, Diabrotica virgifera
  misc_feature: Coding regions on vcDNA: vcDNA=SeqID_8431; Strand=+; Position=2-211
  misc_feature (2)..(68): Xaa can be any naturally occurring amino acid
MXXXXXXXXXXXXXXXXXXXXXXXXXXXXXXXXXXXXXXXXXXXXXXXXXXXXXXXXXXXXXXXXXXXLF

SEQ ID NO: 28735 - protein, 67 aa, Diabrotica virgifera
  misc_feature: Coding regions on vcDNA: vcDNA=SeqID_8432; Strand=-; Position=2-202
  misc_feature (4)..(14): Xaa can be any naturally occurring amino acid
  misc_feature (24)..(31): Xaa can be any naturally occurring amino acid
  misc_feature (34)..(47): Xaa can be any naturally occurring amino acid
  misc_feature (53)..(66): Xaa can be any naturally occurring amino acid
GPFXXXXXXXXXXXTNLAHTGLNXXXXXXXXSNXXXXXXXXXXXXXXPTSRSXXXXXXXXXXXXXXV

SEQ ID NO: 28736 - protein, 182 aa, Diabrotica virgifera
  misc_feature: Coding regions on vcDNA: vcDNA=SeqID_8433; Strand=+; Position=92-640
  misc_feature: Homolog annotation: Hit_ID=XP_310684.1; Match level="QueryCoverage =97%, HitCoverage=53%, E-value=5e-54, Identity=58%"; Hit description =ENSANGP00000020750 [Anopheles gambiae]
  misc_feature: Gene Ontology Annotation: Molecular function=molecular_function unknown; Cellular component=cellular_component unknown; Biological process=biological_process unknown
MVKGKRFVLNKVFEGFPKEDDFKMEEYELPSIKDGEFLTEAVYLSVDPYMRAYISEMSVVGKTMMGTQVAQIIESKNAKYPPGKYVVGTFGWQTHTVSNDERLRLVPDLEGLPPSLSLGVLGMPGNTAYFGFLEICQPKPGETVVVSGAAGAVGSLVGQIAKIKGCSVIGIAGSDEKGKGGT

SEQ ID NO: 28737 - protein, 263 aa, Diabrotica virgifera
  misc_feature: Coding regions on vcDNA: vcDNA=SeqID_8434; Strand=+; Position=117-906
  misc_feature: Homolog annotation: Hit_ID=XP_307856.1; Match level="QueryCoverage =90%, HitCoverage=48%, E-value=1e-62, Identity=50%"; Hit description =ENSANGP00000018072 [Anopheles gambiae]
  misc_feature: Gene Ontology Annotation: Molecular function=neutral amino acid transporter activity; Cellular component=integral to plasma membrane; Biological process=neutral amino acid transport
  misc_feature: Pfam annotation: Pfam_ID=SDF; Match level="Score=-94.0, E-value=2.9e -06, Copies=1"; Pfam description=Sodium:dicarboxylate symporter family
  misc_feature (125)..(125): Xaa can be any naturally occurring amino acid
  misc_feature (230)..(236): Xaa can be any naturally occurring amino acid
MAHLHHNFDMIEVESDRGKPRKKQSCLRQNALTIATMLGVILGAVVGIILRYSREKWTEREVVYIGLAGQIFLRMLKALILPLIVSSLVSAIASLDLSLSGKIAFRAIAYYMTTTFAAVVLGMVXVVTMRPGVGHKSEDSDGKEEKREVLTVDTLLDLIRNMFPPNVVEATIFQTRTKLHPTNTSGTDLYKYSIDNEIIQSTNILGLVVVAAALGIAIAQLGKEAKVIAXXXXXXXAVSMKITSWVIFLSPVGIVFLVSSKIM

SEQ ID NO: 28738 - protein, 23 aa, Diabrotica virgifera
  misc_feature: Coding regions on vcDNA: vcDNA=SeqID_8435; Strand=-; Position=1-69
  misc_feature (1)..(23): Xaa can be any naturally occurring amino acid
XXXXXXXXXXXXXXXXXXXXXXX

SEQ ID NO: 28739 - protein, 302 aa, Diabrotica virgifera
  misc_feature: Coding regions on vcDNA: vcDNA=SeqID_8436; Strand=+; Position=2-907
  misc_feature: Homolog annotation: Hit_ID=CAB39733.1; Match level="QueryCoverage =94%, HitCoverage=24%, E-value=6e-47, Identity=34%"; Hit description =protease, reverse transcriptase, ribonuclease H, integrase [Drosophila buzzatii]
  misc_feature (166)..(171): Xaa can be any naturally occurring amino acid
  misc_feature (259)..(259): Xaa can be any naturally occurring amino acid
  misc_feature (288)..(288): Xaa can be any naturally occurring amino acid
LNIEAIFGRITGSHIFSKIDLKHSFWLIPLAEKCRNYTAFSIDGIVYRFKVVPFGLQSACAALVRALHTILNRHEDFIVHYIDDLLIFSQDTQSHLEHIEIILEELDTAGLKLNIEKCQFFQKEVIYLGFQLDIKTVRLAEDRVKLIDEYPRPTNLKTLRGFLGTXXXXXXLIPDLSQKEIPPIKLLKKGIKWNWKEEQEEAFETLKREFAKGTKIYHPIYNLPFILRTDASIQKFAGVLSQIQNDQEVPICFISRVTXKHERKYSVTELEFASVLYCVTKLRFYLLXAKSQSNRPCSSTYH

SEQ ID NO: 28740 - protein, 65 aa, Diabrotica virgifera
  misc_feature: Coding regions on vcDNA: vcDNA=SeqID_8437; Strand=-; Position=567-764
LLSLYIFLFIVSFLYCIYFFVLSLLGFILWYMSFVGRFIALLFLIYLASFLCSFLSFLACFFLLR

SEQ ID NO: 28741 - protein, 31 aa, Diabrotica virgifera
  misc_feature: Coding regions on vcDNA: vcDNA=SeqID_8438; Strand=+; Position=2-97
AAILLTLIQHRGRNLYYRFELSNKITLLSLR

SEQ ID NO: 28742 - protein, 111 aa, Diabrotica virgifera
  misc_feature: Coding regions on vcDNA: vcDNA=SeqID_8439; Strand=+; Position=3-338
  misc_feature: Homolog annotation: Hit_ID=P48810; Match level="QueryCoverage=97%, HitCoverage=42%, E-value=3e-22, Identity=47%"; Hit description =Heterogeneous nuclear ribonucleoprotein 87F (HRP36.1 protein) (P11 protein) pir||S22315
  misc_feature: Gene Ontology Annotation: Molecular function=heterogeneous nuclear ribonucleoprotein; Cellular component=nuclear speck; Biological process=RNA processing
QGGAGGYGGGGGGGPWSQGPWDNSQGGQDGGQGVSGGWNQGGYNNQGAAGPWGQGGQDNFGNNYQQGYGGGAMRNNFQQPRPGPYNNTGGGYGGGGFNAGNQGGPGGNRRY

SEQ ID NO: 28743 - protein, 148 aa, Diabrotica virgifera
  misc_feature: Coding regions on vcDNA: vcDNA=SeqID_8440; Strand=+; Position=2-448
  misc_feature (26)..(33): Xaa can be any naturally occurring amino acid
ELYFFEPGHTFMSADSFHHQVELSLXXXXXXXXFSDFVNAVGATCSGKTVVKSMQHEDFAVWPSCVSNYKLNKFVNRPYLNDLVYIKAERGKDTLLYRFCYDEYCPLQELDFMTKKGAEKAKSPLFSELHLEASAWRRNKILLQNCFP

SEQ ID NO: 28744 - protein, 195 aa, Diabrotica virgifera
  misc_feature: Coding regions on vcDNA: vcDNA=SeqID_8441; Strand=+; Position=323-907
  misc_feature: Homolog annotation: Hit_ID=XP_315535.1; Match level="QueryCoverage =23%, HitCoverage=9%, E-value=3e-10, Identity=69%"; Hit description =ENSANGP00000021760 [Anopheles gambiae]
  misc_feature (190)..(195): Xaa can be any naturally occurring amino acid
VIRLQTAQKIASLSSWCTVACCRDVERDQLTEGKSKDSGRRQGDHLDGRRQCGLCSLVARAFRRAVCGAVSRRSSDDSYRILTGQPQDEENAIYRESQVTLDVVEGNVIYMRALSETPTMQHVFSKEDWALLDAMTTVPVPVCHGKFLTMHKRRRKKLTTRSLSQDHAILDDIHHGQVPENLDRCTKWGXXXXXX

SEQ ID NO: 28745 - protein, 99 aa, Diabrotica virgifera
  misc_feature: Coding regions on vcDNA: vcDNA=SeqID_8442; Strand=-; Position=69-368
AADKNQCFSRLAVKNTSSPRNKFQLKERMCSLWSNFITYQDPTPSRDRKLLHLKWPSVKPSSTNYVSINKRFRTYSNPRRYNHIKSILLKYLENPKIVY

SEQ ID NO: 28746 - protein, 56 aa, Diabrotica virgifera
  misc_feature: Coding regions on vcDNA: vcDNA=SeqID_8443; Strand=+; Position=689-856
  misc_feature (35)..(56): Xaa can be any naturally occurring amino acid
LIRMPPHYDRANVTLFLVILLRTGRKNLYRTITCXXXXXXXXXXXXXXXXXXXXXX

SEQ ID NO: 28747 - protein, 93 aa, Diabrotica virgifera
  misc_feature: Coding regions on vcDNA: vcDNA=SeqID_8444; Strand=-; Position=447-728
  misc_feature (1)..(37): Xaa can be any naturally occurring amino acid
XXXXXXXXXXXXXXXXXXXXXXXXXXXXXXXXXXXXXNIFYCMYITTTMYYLHLPFLSIYKTTNSTKTKTQKCILRKTKYEATLISISLSILV

SEQ ID NO: 28748 - protein, 86 aa, Diabrotica virgifera
  misc_feature: Coding regions on vcDNA: vcDNA=SeqID_8445; Strand=+; Position=476-733
  misc_feature: Homolog annotation: Hit_ID=CAA73739.1; Match level="QueryCoverage =95%, HitCoverage=20%, E-value=3e-14, Identity=43%"; Hit description =cytochrome b [Hylobates syndactylus]
FAGDNAAYTATFTLHFILPFIIPAIIIAHLIILHLSGPRNRLRTPLSTDRITFHPYFPPYDILGDHTCIIIIIIIIFNITLFITIS

SEQ ID NO: 28749 - protein, 230 aa, Diabrotica virgifera
  misc_feature: Coding regions on vcDNA: vcDNA=SeqID_8446; Strand=+; Position=1-690
  misc_feature (2)..(209): Xaa can be any naturally occurring amino acid
  misc_feature (214)..(227): Xaa can be any naturally occurring amino acid
FXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQTCLXXXXXXXXXXXXXXLNV

SEQ ID NO: 28750 - protein, 77 aa, Diabrotica virgifera
  misc_feature: Coding regions on vcDNA: vcDNA=SeqID_8447; Strand=-; Position=2-232
  misc_feature (2)..(13): Xaa can be any naturally occurring amino acid
  misc_feature (15)..(21): Xaa can be any naturally occurring amino acid
  misc_feature (35)..(42): Xaa can be any naturally occurring amino acid
  misc_feature (44)..(52): Xaa can be any naturally occurring amino acid
  misc_feature (63)..(76): Xaa can be any naturally occurring amino acid
IXXXXXXXXXXXXLXXXXXXXNKDRTNLASTGLTXXXXXXXXDXXXXXXXXXNYKLNPTSRSXXXXXXXXXXXXXXV

SEQ ID NO: 28751 - protein, 66 aa, Diabrotica virgifera; identical to SEQ ID NO: 26808
  misc_feature: Coding regions on vcDNA: vcDNA=SeqID_8448; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28752 - protein, 283 aa, Diabrotica virgifera
  misc_feature: Coding regions on vcDNA: vcDNA=SeqID_8449; Strand=+; Position=3-851
  misc_feature: Homolog annotation: Hit_ID=EAL39892.1; Match level="QueryCoverage =93%, HitCoverage=15%, E-value=2e-66, Identity=55%"; Hit description =ENSANGP00000028211 [Anopheles gambiae str. PEST] ref|XP_556341.1| ENSANGP00000028211 [Anopheles gambiae st
  misc_feature: Gene Ontology Annotation: Molecular function=transcription co -activator activity; Biological process=regulation of transcription from Pol II promoter
  misc_feature (212)..(237): Xaa can be any naturally occurring amino acid
RPQVPVQTFTIMAQSCTLLRLAYQGMYCLELRIRGSGLVSLRDGAYSRFDRSNVVDVFSPTQGLKTFLSKYVDETAVFRRRSQSEDDNPPSPMEVEGSGFLGHHRGPQSPAGQREPGLRFHPPLTPPSGSNPHTPASPHTSMNQPTTHTSFGSSPATSFNLASPTSLQPNINPSPMPHPRPGGLVANSPLNPQLASPGGLLSNSSPGPQSTXXXXXXXXXXXXXXXXXXXXXXXXXXLSSPAASTNWPGSPGMPRPSPGRPGQSPGGPSFMHSPQQSFGSQTW

SEQ ID NO: 28753 - protein, 92 aa, Diabrotica virgifera
  misc_feature: Coding regions on vcDNA: vcDNA=SeqID_8450; Strand=+; Position=622-900
  misc_feature (47)..(47): Xaa can be any naturally occurring amino acid
  misc_feature (66)..(66): Xaa can be any naturally occurring amino acid
  misc_feature (73)..(73): Xaa can be any naturally occurring amino acid
  misc_feature (78)..(79): Xaa can be any naturally occurring amino acid
IKGFFVRNDILKNEDCIPLLNKSENTVSKFNKVGSDSTGCQCADALXTCQQFKLYNSKSFLMNHKXTEIIILXINLSXXGKVKICRIEINGL

SEQ ID NO: 28754 - protein, 75 aa, Diabrotica virgifera
  misc_feature: Coding regions on vcDNA: vcDNA=SeqID_8451; Strand=-; Position=130-357
  misc_feature (56)..(63): Xaa can be any naturally occurring amino acid
IHIFGGILKKPSTKVDFFFEKLLFSSANTSKILFFRRKGKKHSFLISILFPSNFRXXXXXXXXHPEMGWPPPLRF

SEQ ID NO: 28755 - protein, 30 aa, Diabrotica virgifera
  misc_feature: Coding regions on vcDNA: vcDNA=SeqID_8452; Strand=+; Position=77-166
  misc_feature (1)..(1): Xaa can be any naturally occurring amino acid
  misc_feature (9)..(27): Xaa can be any naturally occurring amino acid
XYLNLGVIXXXXXXXXXXXXXXXXXXXPIF

SEQ ID NO: 28756 - protein, 63 aa, Diabrotica virgifera
  misc_feature: Coding regions on vcDNA: vcDNA=SeqID_8453; Strand=-; Position=98-289
CLLYNSLCVTRPWIPLPDLCQYAFSPFYLPITCIFLISLLLHIYWCIIISFLGRSLASTILEI

SEQ ID NO: 28757 - protein, 33 aa, Diabrotica virgifera
  misc_feature: Coding regions on vcDNA: vcDNA=SeqID_8454; Strand=-; Position=1-99
  misc_feature (1)..(15): Xaa can be any naturally occurring amino acid
  misc_feature (17)..(17): Xaa can be any naturally occurring amino acid
  misc_feature (27)..(33): Xaa can be any naturally occurring amino acid
XXXXXXXXXXXXXXXLXIIYKLYRVSXXXXXXX

SEQ ID NO: 28758 - protein, 313 aa, Diabrotica virgifera
  misc_feature: Coding regions on vcDNA: vcDNA=SeqID_8455; Strand=+; Position=3-944
  misc_feature: Homolog annotation: Hit_ID=AAN71087.1; Match level="QueryCoverage =95%, HitCoverage=45%, E-value=3e-45, Identity=31%"; Hit description =AT18855p [Drosophila melanogaster]
  misc_feature: Gene Ontology Annotation: Molecular function=protein binding
  misc_feature (278)..(278): Xaa can be any naturally occurring amino acid
KRRSRSTSRDRKDKQKRSKIEDTSDRERDRHRRHSRDREHTRERDKERHRDTSRSRDKDKDKDRDYYNGRDRNKDRYRERQRSRDRHRDEYSRDLEDYRRSKGRHKDDDFYKREDTNEKWFMRDRYRGYDSRSKHRSPSNERDSKFDKKKLLEIARRNAITMMKSGSLPAALTLGPQAQEKVIAAIKSGGKTIEELTDFCKTLSKKEELGELSSLSEGDDSDSDTDKPFHHPFQIKDRPTSITMNIKNSVPLPVKSAFERTSELRIQFPVSSGQHHRXGEEWMPVSHHQPKNSTVYLLSCYSCCYSCCYKHGL

SEQ ID NO: 28759 - protein, 200 aa, Diabrotica virgifera
  misc_feature: Coding regions on vcDNA: vcDNA=SeqID_8456; Strand=+; Position=108-791
  misc_feature: Homolog annotation: Hit_ID=XP_283816.2; Match level="QueryCoverage =51%, HitCoverage=99%, E-value=5e-18, Identity=44%"; Hit description =similar to zinc finger protein 97 [Mus musculus]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=49.8, E-value =7.7e-12, Copies=2"; Pfam description=Zinc finger, C2H2 type
  misc_feature (197)..(197): Xaa can be any naturally occurring amino acid
MDMKVEVNVKVEKEEKYMDNQLSTSTDLPDIKDEPEDNKPDMDMKVEVNVKVEKEEKYMDNQLSTSTDLPDIKDEPEENKPGCSFQKEDLDGYVEEKTLNKKMKVETGKKSHLMTHTGKKPYFTAAYSLKLHLMTHTGKKPYECEFCLKRFPQRTGHFKRHLITHTGVKPYECDICFKQCTRASDLKRHLTTHTKEXAVY

SEQ ID NO: 28760 - protein, 60 aa, Diabrotica virgifera
  misc_feature: Coding regions on vcDNA: vcDNA=SeqID_8457; Strand=-; Position=0-179
  misc_feature (3)..(59): Xaa can be any naturally occurring amino acid
KKXXXXXXXXXXXXXXXXXXXXXXXXXXXXXXXXXXXXXXXXXXXXXXXXXXXXXXXXXT

SEQ ID NO: 28761 - protein, 287 aa, Diabrotica virgifera
  misc_feature: Coding regions on vcDNA: vcDNA=SeqID_8458; Strand=+; Position=4-862
  misc_feature: Homolog annotation: Hit_ID=EAL23708.1; Match level="QueryCoverage =92%, HitCoverage=81%, E-value=3e-64, Identity=45%"; Hit description =chromosome 7 open reading frame 20 [Homo sapiens] ref|NP_057033.2| chromosome 7 open reading frame 20 [Hom
  misc_feature: Gene Ontology Annotation: Molecular function=molecular_function unknown; Cellular component=cellular_component unknown; Biological process=biological_process unknown
  misc_feature: Pfam annotation: Pfam_ID=DUF410; Match level="Score=200.4, E-value =3.6e-57, Copies=1"; Pfam description=Protein of unknown function (DUF410)
  misc_feature (39)..(46): Xaa can be any naturally occurring amino acid
  misc_feature (89)..(89): Xaa can be any naturally occurring amino acid
  misc_feature (153)..(160): Xaa can be any naturally occurring amino acid
  misc_feature (169)..(174): Xaa can be any naturally occurring amino acid
  misc_feature (236)..(236): Xaa can be any naturally occurring amino acid
  misc_feature (265)..(265): Xaa can be any naturally occurring amino acid
MATQGVRGVSRVLQKLEKSVIDGKFYEAHQMYRTLYFRXXXXXXXXELKDMLYNGAVLFLEREQQLSGSDLGILLIEVLEQSEDSNYEXVGSKLTNIFRQINISTPERDTFLAHAVRWSSKGSSHGHPQLHRSVALVYWAEKNYSQARHHFIXXXXXXXXAKLLIEFHXXXXXXEEADLFIAQTVFQYLCLKNKSTANQTFTSYTEHHPRIQGSGPPYLFPLLNFIWFLLQAIETXSTIHTFLLLIGKYEPSLKRDPGYIQYLDXIGQNFFGIHHNNNTDNSFFGHL

SEQ ID NO: 28762 - protein, 38 aa, Diabrotica virgifera
  misc_feature: Coding regions on vcDNA: vcDNA=SeqID_8459; Strand=-; Position=1-114
  misc_feature (2)..(13): Xaa can be any naturally occurring amino acid
  misc_feature (15)..(36): Xaa can be any naturally occurring amino acid
HXXXXXXXXXXXXIXXXXXXXXXXXXXXXXXXXXXXAF

SEQ ID NO: 28763 - protein, 121 aa, Diabrotica virgifera
  misc_feature: Coding regions on vcDNA: vcDNA=SeqID_8460; Strand=+; Position=285-650
TYTKRPYKISKNRQHEQVGRFCFDTLLTLGANIYNPGQSTLPFLLYNGSQQFLTFAWGISLKTIFHRNLRSNHGGIIFPNTILKLKKQQRKQNFNFRGIKKARDWINPGFSTFVYKVIITI

SEQ ID NO: 28764 - protein, 37 aa, Diabrotica virgifera
  misc_feature: Coding regions on vcDNA: vcDNA=SeqID_8461; Strand=-; Position=1-111
  misc_feature (1)..(37): Xaa can be any naturally occurring amino acid
XXXXXXXXXXXXXXXXXXXXXXXXXXXXXXXXXXXXX

SEQ ID NO: 28765 - protein, 34 aa, Diabrotica virgifera; identical to SEQ ID NO: 27603
  misc_feature: Coding regions on vcDNA: vcDNA=SeqID_8462; Strand=-; Position=80-184

SEQ ID NO: 28766 - protein, 57 aa, Diabrotica virgifera
  misc_feature: Coding regions on vcDNA: vcDNA=SeqID_8463; Strand=-; Position=2-172
  misc_feature (1)..(16): Xaa can be any naturally occurring amino acid
  misc_feature (21)..(47): Xaa can be any naturally occurring amino acid
  misc_feature (52)..(52): Xaa can be any naturally occurring amino acid
  misc_feature (55)..(55): Xaa can be any naturally occurring amino acid
XXXXXXXXXXXXXXXXFLITXXXXXXXXXXXXXXXXXXXXXXXXXXXSLVFXKNXSF

SEQ ID NO: 28767 - protein, 210 aa, Diabrotica virgifera
  misc_feature: Coding regions on vcDNA: vcDNA=SeqID_8464; Strand=-; Position=1-630
  misc_feature (1)..(9): Xaa can be any naturally occurring amino acid
  misc_feature (11)..(210): Xaa can be any naturally occurring amino acid
XXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 28768 - protein, 152 aa, Diabrotica virgifera
  misc_feature: Coding regions on vcDNA: vcDNA=SeqID_8465; Strand=-; Position=172-626
  misc_feature: Homolog annotation: Hit_ID=AAV34835.1; Match level="QueryCoverage =94%, HitCoverage=40%, E-value=4e-21, Identity=41%"; Hit description =ribosomal protein L23A [Bombyx mori]
  misc_feature (25)..(25): Xaa can be any naturally occurring amino acid
  misc_feature (91)..(97): Xaa can be any naturally occurring amino acid
PVLHPQKGVGGPGGGALKIQKKVVXGPHGPPPRENPFPVPFRRLKAPPPPRGPQFPQGGVPPRSPQGGFNFLKFPLAPGAPRGKVDDYPPXXXXXXXWATHPPLKAAAKKLFGFHVAQVPPLIWPAGKKKAFVRFAWGFDPFDVSPQMGPGR

SEQ ID NO: 28769 - protein, 70 aa, Diabrotica virgifera
  misc_feature: Coding regions on vcDNA: vcDNA=SeqID_8466; Strand=-; Position=0-209
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PFXXXXXXXXXXXTNLAHTGLNXXXXXXXXSNXXXXXXXXXXXXXXPTSRSXXXXXXXXXXXXXXVIPKV

SEQ ID NO: 28770 - protein, 55 aa, Diabrotica virgifera
  misc_feature: Coding regions on vcDNA: vcDNA=SeqID_8467; Strand=-; Position=128-295
FLSSKDLRYREKEYHCLAEKSLCKVFFNNNIITLVALCTWIIMILLLFTNPSCST

SEQ ID NO: 28771 - protein, 223 aa, Diabrotica virgifera
  misc_feature: Coding regions on vcDNA: vcDNA=SeqID_8468; Strand=-; Position=1-669
  misc_feature (5)..(21): Xaa can be any naturally occurring amino acid
  misc_feature (59)..(66): Xaa can be any naturally occurring amino acid
  misc_feature (79)..(89): Xaa can be any naturally occurring amino acid
  misc_feature (91)..(111): Xaa can be any naturally occurring amino acid
  misc_feature (113)..(157): Xaa can be any naturally occurring amino acid
  misc_feature (159)..(167): Xaa can be any naturally occurring amino acid
  misc_feature (169)..(196): Xaa can be any naturally occurring amino acid
  misc_feature (202)..(202): Xaa can be any naturally occurring amino acid
  misc_feature (204)..(223): Xaa can be any naturally occurring amino acid
WRRSXXXXXXXXXXXXXXXXXAPAPGFTPPKEKFIKCATPYKKYRSPHKIKTFNHPRGXXXXXXXXGLPKKKIPRFSLXXXXXXXXXXXGXXXXXXXXXXXXXXXXXXXXXPXXXXXXXXXXXXXXXXXXXXXXXXXXXXXXXXXXXXXXXXXXXXXNXXXXXXXXXPXXXXXXXXXXXXXXXXXXXXXXXXXXXXSGQARXYXXXXXXXXXXXXXXXXXXXX

SEQ ID NO: 28772 - protein, 253 aa, Diabrotica virgifera
  misc_feature: Coding regions on vcDNA: vcDNA=SeqID_8469; Strand=-; Position=3-761
  misc_feature (1)..(11): Xaa can be any naturally occurring amino acid
  misc_feature (16)..(32): Xaa can be any naturally occurring amino acid
  misc_feature (93)..(125): Xaa can be any naturally occurring amino acid
  misc_feature (129)..(182): Xaa can be any naturally occurring amino acid
  misc_feature (188)..(205): Xaa can be any naturally occurring amino acid
  misc_feature (210)..(220): Xaa can be any naturally occurring amino acid
  misc_feature (226)..(240): Xaa can be any naturally occurring amino acid
  misc_feature (247)..(253): Xaa can be any naturally occurring amino acid
XXXXXXXXXXXPVFFXXXXXXXXXXXXXXXXXPYPGQIPPAIQIIRWPAEPYYLIQKARFLLTGGKKGGGFPLLTLYIFLNYPIFYSYYYLHXXXXXXXXXXXXXXXXXXXXXXXXXXXXXXXXXENFXXXXXXXXXXXXXXXXXXXXXXXXXXXXXXXXXXXXXXXXXXXXXXXXXXXXXXEYHSIXXXXXXXXXXXXXXXXXXSFKLXXXXXXXXXXXSRIPRXXXXXXXXXXXXXXXPILITYXXXXXXX

SEQ ID NO: 28773 - protein, 222 aa, Diabrotica virgifera
  misc_feature: Coding regions on vcDNA: vcDNA=SeqID_8470; Strand=+; Position=70-738
  misc_feature: Homolog annotation: Hit_ID=AAG27458.1; Match level="QueryCoverage =96%, HitCoverage=29%, E-value=4e-14, Identity=21%"; Hit description =latent nuclear antigen [Human herpesvirus 8]
  misc_feature (36)..(42): Xaa can be any naturally occurring amino acid
  misc_feature (200)..(208): Xaa can be any naturally occurring amino acid
MSVTRSQSKDNKKQKEYSNQENNSDQEDILNTTIMXXXXXXXSELEKILQLMQLQSKKMDEAKRTMDDNQRETKQAMEEAKRTMEKNQEETKLAMDEASKKMDKVDQKMDETQQKMDETQQKLDQKMDETQQKMKQAIEENNKKMEERIGKYEMKIKDHMQPQEMRMKDHMKEQEMKIQNKMKELTNCQKKEMESLENKXXXXXXXXXEEVERKIAEINTPI

SEQ ID NO: 28774 - protein, 20 aa, Diabrotica virgifera
  misc_feature: Coding regions on vcDNA: vcDNA=SeqID_8471; Strand=-; Position=2-61
SIQNVSTQSHHHNHHIHKIA

SEQ ID NO: 28775 - protein, 108 aa, Diabrotica virgifera
  misc_feature: Coding regions on vcDNA: vcDNA=SeqID_8472; Strand=-; Position=1-324
  misc_feature (5)..(47): Xaa can be any naturally occurring amino acid
  misc_feature (49)..(96): Xaa can be any naturally occurring amino acid
  misc_feature (99)..(107): Xaa can be any naturally occurring amino acid
KKIDXXXXXXXXXXXXXXXXXXXXXXXXXXXXXXXXXXXXXXXXXXXSXXXXXXXXXXXXXXXXXXXXXXXXXXXXXXXXXXXXXXXXXXXXXXXXHQXXXXXXXXXY

SEQ ID NO: 28776 - protein, 221 aa, Diabrotica virgifera
  misc_feature: Coding regions on vcDNA: vcDNA=SeqID_8473; Strand=+; Position=228-890
  misc_feature: Homolog annotation: Hit_ID=XP_396871.1; Match level="QueryCoverage =100%, HitCoverage=13%, E-value=2e-41, Identity=45%"; Hit description= similar to CG12214-PA [Apis mellifera]
  misc_feature (61)..(66): Xaa can be any naturally occurring amino acid
MPSLLEALEQKYGESSTDSDGSEDEGISVSIFVPCKSPRAVVPALLVLNDCDIATAGEKDXXXXXXAGVEELDLAKNKLQEWPEVFGILEQMPRLKFVNLSFNVLSTPLRSEVELNKETKWQQLKNLVLNSTYIGWESVQEILDHLPSLEELHLSLNEYSNVHLHDDKSKNCDSVKNDNETQEETLPCTQTCACTPYKLHKHSKLRVLHFHNPVEEWKEVT

SEQ ID NO: 28777 - protein, 224 aa, Diabrotica virgifera
  misc_feature: Coding regions on vcDNA: vcDNA=SeqID_8474; Strand=+; Position=3-677
  misc_feature: Homolog annotation: Hit_ID=AAV63977.1; Match level="QueryCoverage =89%, HitCoverage=60%, E-value=1e-44, Identity=43%"; Hit description =cathepsin L precursor [Artemia franciscana]
  misc_feature: Gene Ontology Annotation: Molecular function=cathepsin K activity; Cellular component=lysosome; Biological process=proteolysis and peptidolysis
  misc_feature: Pfam annotation: Pfam_ID=Peptidase_C1; Match level="Score=203.0, E -value=5.9e-58, Copies=1"; Pfam description=Papain family cysteine protease
  misc_feature (21)..(27): Xaa can be any naturally occurring amino acid
EFLDWSKTGAVTPAKDQGTCXXXXXXXAVGALESYNFRKTGKLISFSEQNIVDCFSNDTCEGGVPEYAAKYIYNHGIHLESDYPYTAGQDACKILIKPTIRIDFNDTSFTKGTDEDLKQGVKEHGPLSVCLYVTANWRFYGRGVWYHNKCSYESNHCVLLVGYGTEKGNDYWIFKNSWGPNWGQNGFIKVARNKHENYCGIGYGMFLIDQKSEGIPDSVAENSI

SEQ ID NO: 28778 - protein, 252 aa, Diabrotica virgifera
  misc_feature: Coding regions on vcDNA: vcDNA=SeqID_8475; Strand=-; Position=2-757
  misc_feature (13)..(29): Xaa can be any naturally occurring amino acid
  misc_feature (46)..(53): Xaa can be any naturally occurring amino acid
  misc_feature (57)..(248): Xaa can be any naturally occurring amino acid
VFVYTSNRVFFVXXXXXXXXXXXXXXXXXDSNKRQLFISSHPFIPXXXXXXXXIIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRPGR

SEQ ID NO: 28779 - protein, 86 aa, Diabrotica virgifera
  misc_feature: Coding regions on vcDNA: vcDNA=SeqID_8476; Strand=+; Position=68-328
  misc_feature: Homolog annotation: Hit_ID=XP_311138.1; Match level="QueryCoverage =95%, HitCoverage=20%, E-value=9e-15, Identity=50%"; Hit description =ENSANGP00000017373 [Anopheles gambiae]
MTKSSINRMATLTKYPAPKKKEDVTTMLGDNKHSEFPVFVDYPGSYVKTVAVGIFDCNAKTWSIYSDNPSKNEPIVVLPLVLKENK

SEQ ID NO: 28780 - protein, 239 aa, Diabrotica virgifera
  misc_feature: Coding regions on vcDNA: vcDNA=SeqID_8477; Strand=-; Position=247-965
  misc_feature: Homolog annotation: Hit_ID=BAD86655.1; Match level="QueryCoverage =100%, HitCoverage=17%, E-value=2e-58, Identity=46%"; Hit description= reverse transcriptase [Bombyx mori]
  misc_feature: Pfam annotation: Pfam_ID=RVT_1; Match level="Score=104.5, E-value =2.7e-28, Copies=1"; Pfam description=Reverse transcriptase (RNA -dependent
  misc_feature (20)..(20): Xaa can be any naturally occurring amino acid
KVEAELESLVNQGVLKKVAXSDWATPIVPVVKQNGDIRICGDFKITLTPCMKVDEYPLPTPDDLLSQLAGGDKYTKIDITKAYLHLPIKDEMKHLLTLNTHKALFQPNRLMFGIASAPAKWQRLMEQMLQGIDGISIFQDDIRITAPNNTLHLQRLEQVLKKLSEHNLHINLDKSEFFKDEIDYCGYKMSKAGVSTSTYKVTAIANAPIPTNRTQVRSFCGLINYYRGFLKDASTILQP

SEQ ID NO: 28781 - protein, 59 aa, Diabrotica virgifera
  misc_feature: Coding regions on vcDNA: vcDNA=SeqID_8478; Strand=-; Position=20-199
YLISVYQNRGKIPYQYIFMIIHAQGARSNYVCHKNTVSSQKTQYLSLNKTQMKQLHSNY

SEQ ID NO: 28782 - protein, 119 aa, Diabrotica virgifera
  misc_feature: Coding regions on vcDNA: vcDNA=SeqID_8479; Strand=+; Position=3-362
  misc_feature: Homolog annotation: Hit_ID=CAF95339.1; Match level="QueryCoverage =91%, HitCoverage=37%, E-value=1e-16, Identity=35%"; Hit description =unnamed protein product [Tetraodon nigroviridis]
  misc_feature: Gene Ontology Annotation: Molecular function=transcription factor activity; Cellular component=nucleus; Biological process=regulation of transcription, DNA-dependent
  misc_feature (5)..(12): Xaa can be any naturally occurring amino acid
  misc_feature (31)..(40): Xaa can be any naturally occurring amino acid
  misc_feature (59)..(68): Xaa can be any naturally occurring amino acid
  misc_feature (89)..(96): Xaa can be any naturally occurring amino acid
EKPYXXXXXXXXFRQKFALDEHTKVHTGDKXXXXXXXXXXFSQKSNLKIHLRLHTGETXXXXXXXXXXFAQKSNLNGHMRVHTREKPYXXXXXXXXFRQKFALDEHTKVVQEIYKKYNV

SEQ ID NO: 28783 - protein, 257 aa, Diabrotica virgifera
  misc_feature: Coding regions on vcDNA: vcDNA=SeqID_8480; Strand=+; Position=129-899
  misc_feature: Homolog annotation: Hit_ID=XP_396640.1; Match level="QueryCoverage =99%, HitCoverage=34%, E-value=1e-111, Identity=75%"; Hit description= similar to CG1776-PA [Apis mellifera]
  misc_feature: Gene Ontology Annotation: Molecular function=calcium/calmodulin -dependent protein kinase activity; Cellular component=nucleus; Biological process=induction of apoptosis
  misc_feature: Pfam annotation: Pfam_ID=Pkinase; Match level="Score=174.1, E-value =3e-49, Copies=1"; Pfam description=Protein kinase domain
  misc_feature (200)..(206): Xaa can be any naturally occurring amino acid
MIKVDENDPVGEVQLSFPHREVQIQRGKDPKDFYTLEEEIGRGKFGTVYRCKEKSTGLCLAAKFIGCPKKEDRRNVEREIDIMRSLQHPRLIQIYDAFENGKIMTVILELIEGGELFERVIDDDFILTEKSCTVFMRQICEGVDFIHKQRILHLDMKPENILCLTKTGNRIKIIDFGLARKFDPNKKLQVLFGTPEFVAXXXXXXXEIGYGTDMWSVGVICYVLLSGLSPFMGHTDVETMANVTIAKYDFEDEAFDE

SEQ ID NO: 28784 - protein, 72 aa, Diabrotica virgifera
  misc_feature: Coding regions on vcDNA: vcDNA=SeqID_8481; Strand=+; Position=73-291
  misc_feature (10)..(20): Xaa can be any naturally occurring amino acid
RLAYISVSQXXXXXXXXXXXITRPWGRRSVRMTMGLPRIYRPTLDMIKRMHDNDLRGRPTPLGSVFGSLCHG

SEQ ID NO: 28785 - protein, 133 aa, Diabrotica virgifera
  misc_feature: Coding regions on vcDNA: vcDNA=SeqID_8482; Strand=+; Position=261-662
  misc_feature: Homolog annotation: Hit_ID=XP_311544.1; Match level="QueryCoverage =95%, HitCoverage=78%, E-value=9e-44, Identity=66%"; Hit description =ENSANGP00000010253 [Anopheles gambiae]
  misc_feature: Gene Ontology Annotation: Molecular function=transcription factor activity; Cellular component=chromatin; Biological process =regulation of transcription, DNA-dependent
  misc_feature: Pfam annotation: Pfam_ID=bZIP_Maf; Match level="Score=179.3, E-value =7.9e-51, Copies=1"; Pfam description=bZIP Maf transcription factor
MSSEHPKKAGKLAPLSPPPIVDISDDELVTISVRDLNRQLKLRGLSRDEIVRMKQRRRTLKNRGYAASCRIKRIEQKDELETEKTQEWKDMENMQDDVVSYRNEMNEIKDRYEALKRFAVTNKISIPPELEQL

SEQ ID NO: 28786 - protein, 127 aa, Diabrotica virgifera
  misc_feature: Coding regions on vcDNA: vcDNA=SeqID_8483; Strand=+; Position=449-832
  misc_feature (70)..(70): Xaa can be any naturally occurring amino acid
YLDTWNRDRRNLSLSHQPVERSTSTTRHEGETFSPLRPFRRVNPGTAHLLSVQPFFWAEKNNSNTYTDSXFGSDAIHDFATFKTRGTWYGNSNSYVTVSVVRTGFTLDRLFITINNVCINLYTPTEQ

SEQ ID NO: 28787 - protein, 59 aa, Diabrotica virgifera
  misc_feature: Coding regions on vcDNA: vcDNA=SeqID_8484; Strand=-; Position=1-177
  misc_feature (1)..(59): Xaa can be any naturally occurring amino acid
XXXXXXXXXXXXXXXXXXXXXXXXXXXXXXXXXXXXXXXXXXXXXXXXXXXXXXXXXXX

SEQ ID NO: 28788 - protein, 62 aa, Diabrotica virgifera
  misc_feature: Coding regions on vcDNA: vcDNA=SeqID_8485; Strand=-; Position=105-293
  misc_feature (9)..(20): Xaa can be any naturally occurring amino acid
  misc_feature (28)..(35): Xaa can be any naturally occurring amino acid
  misc_feature (55)..(61): Xaa can be any naturally occurring amino acid
APQREPKKXXXXXXXXXXXXHVVINPEXXXXXXXXNLIFKWPSESFMTFFRFFSXXXXXXXP

SEQ ID NO: 28789 - protein, 105 aa, Diabrotica virgifera
  misc_feature: Coding regions on vcDNA: vcDNA=SeqID_8486; Strand=+; Position=169-486
  misc_feature (8)..(28): Xaa can be any naturally occurring amino acid
  misc_feature (30)..(40): Xaa can be any naturally occurring amino acid
  misc_feature (57)..(68): Xaa can be any naturally occurring amino acid
  misc_feature (71)..(82): Xaa can be any naturally occurring amino acid
  misc_feature (85)..(98): Xaa can be any naturally occurring amino acid
WFWGVNIXXXXXXXXXXXXXXXXXXXXXYXXXXXXXXXXXREEIVLLFDFYIIFRIXXXXXXXXXXXXVLXXXXXXXXXXXXVKXXXXXXXXXXXXXXGISKLFI

SEQ ID NO: 28790 - protein, 96 aa, Diabrotica virgifera
  misc_feature: Coding regions on vcDNA: vcDNA=SeqID_8487; Strand=+; Position=3-293
FCLLWMNKSSFTMNSSSFYFMVTSYSWEIILQSYKTMIDLLLLENLGLLFNTYIYMIFILLWIKNSYSYCLMDNMNNLFEMLRYTSPDLSNFFRST

SEQ ID NO: 28791 - protein, 171 aa, Diabrotica virgifera
  misc_feature: Coding regions on vcDNA: vcDNA=SeqID_8488; Strand=+; Position=167-682
  misc_feature (42)..(49): Xaa can be any naturally occurring amino acid
MVNMQGTKKKTRNHTNVRKYHGLTYTREQKIVATVWYHERLXXXXXXXXLCQNFRTRFNLEYPSYNTLKRWERKLFKDGSEIISNKKKPIHRSVSRWVYIPYVKESLIRNPDMSLMARAKYLGITQATLHTILKSDLKEFHLAILTNFKTEDVADKAEVDVKNNESKDDNT

SEQ ID NO: 28792 - protein, 123 aa, Diabrotica virgifera
  misc_feature: Coding regions on vcDNA: vcDNA=SeqID_8489; Strand=-; Position=3-371
  misc_feature (104)..(111): Xaa can be any naturally occurring amino acid
DNFYFYLHTQKVNVTKTIFKRNNIQNSQVRKYKNRFIKTPVWWLLLYPTCLEISTALAQRTKNCFNPSRGRLGCVTLFNSINVSINIFWLFHHSIGVTFEVTLXXXXXXXXKWYTFCLKLYQL

SEQ ID NO: 28793 - protein, 213 aa, Diabrotica virgifera
  misc_feature: Coding regions on vcDNA: vcDNA=SeqID_8490; Strand=-; Position=3-641
  misc_feature (9)..(35): Xaa can be any naturally occurring amino acid
  misc_feature (39)..(100): Xaa can be any naturally occurring amino acid
  misc_feature (103)..(176): Xaa can be any naturally occurring amino acid
  misc_feature (183)..(212): Xaa can be any naturally occurring amino acid
GDYAALARXXXXXXXXXXXXXXXXXXXXXXXXXXXAGEXXXXXXXXXXXXXXXXXXXXXXXXXXXXXXXXXXXXXXXXXXXXXXXXXXXXXXXXXXXXXXLNXXXXXXXXXXXXXXXXXXXXXXXXXXXXXXXXXXXXXXXXXXXXXXXXXXXXXXXXXXXXXXXXXXXXXXXXXXLSSFKLXXXXXXXXXXXXXXXXXXXXXXXXXXXXXXV

SEQ ID NO: 28794 - protein, 261 aa, Diabrotica virgifera
  misc_feature: Coding regions on vcDNA: vcDNA=SeqID_8491; Strand=+; Position=3-788
  misc_feature: Homolog annotation: Hit_ID=BAD17898.1; Match level="QueryCoverage =27%, HitCoverage=15%, E-value=9e-25, Identity=73%"; Hit description =glucose-6-phosphate 1-dehydrogenase [Oryzias latipes]
  misc_feature: Gene Ontology Annotation: Molecular function=glucose-6-phosphate 1 -dehydrogenase activity; Cellular component=cytoplasm; Biological process=pentose-phosphate shunt
  misc_feature: Pfam annotation: Pfam_ID=G6PD_C; Match level="Score=-163.4, E-value =0.0037, Copies=1"; Pfam description=Glucose-6-phosphate dehydrogenase, C-t
  misc_feature (1)..(20): Xaa can be any naturally occurring amino acid
  misc_feature (23)..(179): Xaa can be any naturally occurring amino acid
  misc_feature (239)..(239): Xaa can be any naturally occurring amino acid
  misc_feature (243)..(243): Xaa can be any naturally occurring amino acid
  misc_feature (245)..(245): Xaa can be any naturally occurring amino acid
  misc_feature (254)..(254): Xaa can be any naturally occurring amino acid
XXXXXXXXXXXXXXXXXXXXVPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIRDVMQNHILQILALVAMEKPASVQPDDIRNEKVKVLKSIAPIKLKDVVLGQYVGNPDGXGNAXLXYLDDPSVLXICYTTMP

SEQ ID NO: 28795 - protein, 88 aa, Diabrotica virgifera
  misc_feature: Coding regions on vcDNA: vcDNA=SeqID_8492; Strand=-; Position=1-264
LRMYCASLTILSVPLVETMFINNQYRIRIFVPVPRYSFISAQLLLHSSCSSSMYVHFMLSRETVRFLIVNKAPVATIREAISTITFIV

SEQ ID NO: 28796 - protein, 262 aa, Diabrotica virgifera
  misc_feature: Coding regions on vcDNA: vcDNA=SeqID_8493; Strand=-; Position=1-786
  misc_feature (1)..(1): Xaa can be any naturally occurring amino acid
  misc_feature (8)..(262): Xaa can be any naturally occurring amino acid
XYRGFSSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 28797 - protein, 294 aa, Diabrotica virgifera
  misc_feature: Coding regions on vcDNA: vcDNA=SeqID_8494; Strand=+; Position=1-885
  misc_feature: Homolog annotation: Hit_ID=NP_004225.2; Match level="QueryCoverage =99%, HitCoverage=68%, E-value=2e-96, Identity=53%"; Hit description =zinc finger protein 93 homolog [Homo sapiens]
  misc_feature: Gene Ontology Annotation: Molecular function=DNA binding; Cellular component=nucleus; Biological process=regulation of transcription, DNA-dependent
  misc_feature: Pfam annotation: Pfam_ID=zf-C2H2; Match level="Score=289.2, E-value =6.7e-84, Copies=10"; Pfam description=Zinc finger, C2H2 type
  misc_feature (249)..(249): Xaa can be any naturally occurring amino acid
GTLGEKPYKCETCFKQFCTSSEAKRHFLRVHTVEKPYECDICLKQFRTTSELKSHLRTHTGEKLYKCEICFKQFSQTCSLKKHLRVHTGEKPHKCEICFKQFNEAGHLKTHLRVHTGEKPHKCEICFKRFSRAVNLTTHLRVHTGEKPYKCETCLKQFLSSSDLKIHFRVHTEEKPYECDICLKQFRTTSELKTHLRTHTGEKPYKCEICFKQFSQKCSLKKHLRVHTGEKPHKCEICFKQFSEAGHLXTHLRVHTGEKTHKCEICFKRFSRADNLTTHVRVHTGEKTYKCETC

SEQ ID NO: 28798 - protein, 66 aa, Diabrotica virgifera; identical to SEQ ID NO: 26808
  misc_feature: Coding regions on vcDNA: vcDNA=SeqID_8495; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28799 - protein, 50 aa, Diabrotica virgifera
  misc_feature: Coding regions on vcDNA: vcDNA=SeqID_8496; Strand=+; Position=2-151
  misc_feature (5)..(5): Xaa can be any naturally occurring amino acid
  misc_feature (7)..(14): Xaa can be any naturally occurring amino acid
  misc_feature (26)..(26): Xaa can be any naturally occurring amino acid
  misc_feature (28)..(50): Xaa can be any naturally occurring amino acid
KNLFXKXXXXXXXXERPIEFIKYYKXFXXXXXXXXXXXXXXXXXXXXXXX

SEQ ID NO: 28800 - protein, 64 aa, Diabrotica virgifera
  misc_feature: Coding regions on vcDNA: vcDNA=SeqID_8497; Strand=-; Position=2-193
  misc_feature (2)..(9): Xaa can be any naturally occurring amino acid
  misc_feature (22)..(29): Xaa can be any naturally occurring amino acid
  misc_feature (32)..(39): Xaa can be any naturally occurring amino acid
  misc_feature (42)..(42): Xaa can be any naturally occurring amino acid
  misc_feature (50)..(63): Xaa can be any naturally occurring amino acid
LXXXXXXXXKDRTNLAHTGLTXXXXXXXXRTXXXXXXXXNYXLIHPSRSXXXXXXXXXXXXXXV

SEQ ID NO: 28801 - protein, 168 aa, Diabrotica virgifera
  misc_feature: Coding regions on vcDNA: vcDNA=SeqID_8498; Strand=-; Position=288-794
  misc_feature (8)..(27): Xaa can be any naturally occurring amino acid
FSIGFYDXXXXXXXXXXXXXXXXXXXXHIICHSTGHSTSTKIADDYRSLARAKSRGYPNQSVVTNVFMANTSLHLIHTPVNTSWFNSFSCQKPDNAPLLLNRRILQCERHDVLTRTVASIGRLSYKSLYSLLRMRAPGNAPIESEGYICLPGCLTTLSHNGIGNYVCG

SEQ ID NO: 28802 - protein, 219 aa, Diabrotica virgifera
  misc_feature: Coding regions on vcDNA: vcDNA=SeqID_8499; Strand=-; Position=0-656
  misc_feature (15)..(215): Xaa can be any naturally occurring amino acid
LNKDRFIFIQTINCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGLKG

SEQ ID NO: 28803 - protein, 58 aa, Diabrotica virgifera
  misc_feature: Coding regions on vcDNA: vcDNA=SeqID_8500; Strand=+; Position=406-582
  misc_feature (8)..(15): Xaa can be any naturally occurring amino acid
ILIRTTTXXXXXXXXIYSYIPPFLFFINFSLKYRFILFLFIPDRHQYNHSSAYLAQIY

SEQ ID NO: 28804 - protein, 229 aa, Diabrotica virgifera
  misc_feature: Coding regions on vcDNA: vcDNA=SeqID_8501; Strand=+; Position=188-874
  misc_feature: Homolog annotation: Hit_ID=AAH78208.1; Match level="QueryCoverage =92%, HitCoverage=69%, E-value=1e-41, Identity=46%"; Hit description =Zgc:100754 [Danio rerio] ref|NP_001009912.1| zgc:100754 [Danio rerio]
  misc_feature: Gene Ontology Annotation: Molecular function=electron transporter activity; Cellular component=nucleus; Biological process=induction of apoptosis
  misc_feature: Pfam annotation: Pfam_ID=adh_short; Match level="Score=25.1, E-value =1.2e-07, Copies=1"; Pfam description=short chain dehydrogenase
  misc_feature (53)..(61): Xaa can be any naturally occurring amino acid
MGQIFTTKCDSDVRLDGKTAVITGANCGIGKETARDLYLRGATVILACRSVSXXXXXXXXXKTQCVWEKNVRQLKAIELDLSRLKSVRDCAAKLLETEKEINILVNNAGVFAVPFALTEDGNETTFQVNHLGHFLFTLLLMPLLKKSTPARIVTVASSLHSAVWNLDLSDMKCEKRKYGSINAYNESKVCNILFTRELPRKLERHNINGITVYSVHPCAVKLMPQISGF

SEQ ID NO: 28805 - protein, 148 aa, Diabrotica virgifera
  misc_feature: Coding regions on vcDNA: vcDNA=SeqID_8502; Strand=+; Position=8-454
  misc_feature: Homolog annotation: Hit_ID=XP_394931.1; Match level="QueryCoverage =93%, HitCoverage=57%, E-value=1e-31, Identity=53%"; Hit description =similar to CG2746-PA [Apis mellifera]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_L19e; Match level="Score=74.6, E -value=2.7e-19, Copies=1"; Pfam description=Ribosomal protein L19e
  misc_feature (9)..(9): Xaa can be any naturally occurring amino acid
  misc_feature (16)..(17): Xaa can be any naturally occurring amino acid
  misc_feature (20)..(21): Xaa can be any naturally occurring amino acid
  misc_feature (24)..(28): Xaa can be any naturally occurring amino acid
  misc_feature (31)..(31): Xaa can be any naturally occurring amino acid
  misc_feature (36)..(36): Xaa can be any naturally occurring amino acid
  misc_feature (45)..(45): Xaa can be any naturally occurring amino acid
  misc_feature (60)..(60): Xaa can be any naturally occurring amino acid
  misc_feature (66)..(66): Xaa can be any naturally occurring amino acid
  misc_feature (78)..(79): Xaa can be any naturally occurring amino acid
  misc_feature (81)..(81): Xaa can be any naturally occurring amino acid
  misc_feature (94)..(96): Xaa can be any naturally occurring amino acid
  misc_feature (103)..(103): Xaa can be any naturally occurring amino acid
  misc_feature (110)..(110): Xaa can be any naturally occurring amino acid
  misc_feature (113)..(114): Xaa can be any naturally occurring amino acid
  misc_feature (125)..(125): Xaa can be any naturally occurring amino acid
  misc_feature (132)..(132): Xaa can be any naturally occurring amino acid
  misc_feature (134)..(134): Xaa can be any naturally occurring amino acid
PYKAELVDXEKDPWLXXNEXXEIXXXXXRKXICKLXKDGIIIKKXVDVYWGGSVSKKIEXWRKGRXWGFGKRKGNGNXXSXEKELWIEWMRVLXXXFKKYREXKKIERDXYEXXYMKGKGNVFKXKCVFMEXYXKKKVEKGCVKMLVD

SEQ ID NO: 28806 - protein, 282 aa, Diabrotica virgifera
  misc_feature: Coding regions on vcDNA: vcDNA=SeqID_8503; Strand=+; Position=1-846
  misc_feature: Homolog annotation: Hit_ID=XP_316656.1; Match level="QueryCoverage =100%, HitCoverage=44%, E-value=7e-55, Identity=40%"; Hit description= ENSANGP00000011485 [Anopheles gambiae]
  misc_feature: Pfam annotation: Pfam_ID=Arm; Match level="Score=51.9, E-value=1.8e -12, Copies=3"; Pfam description=Armadillo/beta-catenin-like repeat
  misc_feature (208)..(208): Xaa can be any naturally occurring amino acid
  misc_feature (230)..(230): Xaa can be any naturally occurring amino acid
  misc_feature (233)..(233): Xaa can be any naturally occurring amino acid
  misc_feature (242)..(242): Xaa can be any naturally occurring amino acid
DDLYSKDPSKCLASIVCIKNSVIGSNRQKESVIAQGIVPRLLFLLRDKGTKTNVRIEAAVTIGSLAKGTEDHVELLINSGTSQILLEVLEENEPRLIDACLCCLRTLSQHSISSDVKYNVKNLQKLLSFAGPKDTLQRQSCVANIITSACRGPAEQNILCSIGAPATLASLLSVQNYSVTIPIVTCLATMCFNNSVVAGVIVNTSCKXIRIPDYLEILISRDRPIDMQLXAAXCLTNLYRAXAISAYDPIITYRTLPCLVRLCQIEHQETHRAAAADTLAYL

SEQ ID NO: 28807 - protein, 164 aa, Diabrotica virgifera
  misc_feature: Coding regions on vcDNA: vcDNA=SeqID_8504; Strand=+; Position=106-600
  misc_feature: Homolog annotation: Hit_ID=XP_310541.1; Match level="QueryCoverage =87%, HitCoverage=80%, E-value=6e-31, Identity=44%"; Hit description =ENSANGP00000017334 [Anopheles gambiae]
  misc_feature: Pfam annotation: Pfam_ID=VKOR; Match level="Score=139.6, E-value=7.5e- 39, Copies=1"; Pfam description=Vitamin K epoxide reductase family
YLISLPRINSLLTLSCICGAGLSLYGYYIGLELERNENYKPMCDINPQVSCSKAMTSKYGKGLGIFGEDSQFYKPNSLFGIMFYSMIATLVQSNSKFIAWVSLVLIALSNFLSIYFAYILYFVLYDLCIVCVAIYAVNVINLLLIKLKLKTIDAIREQEEEKNK

SEQ ID NO: 28808 - protein, 76 aa, Diabrotica virgifera
  misc_feature: Coding regions on vcDNA: vcDNA=SeqID_8505; Strand=-; Position=3-230
  misc_feature (9)..(21): Xaa can be any naturally occurring amino acid
  misc_feature (30)..(38): Xaa can be any naturally occurring amino acid
  misc_feature (41)..(57): Xaa can be any naturally occurring amino acid
  misc_feature (59)..(59): Xaa can be any naturally occurring amino acid
  misc_feature (62)..(76): Xaa can be any naturally occurring amino acid
KLNPNSRSXXXXXXXXXXXXXLLSPKVIIXXXXXXXXXIYXXXXXXXXXXXXXXXXXNXINXXXXXXXXXXXXXXX

SEQ ID NO: 28809 - protein, 294 aa, Diabrotica virgifera
  misc_feature: Coding regions on vcDNA: vcDNA=SeqID_8506; Strand=-; Position=1-882
  misc_feature (1)..(24): Xaa can be any naturally occurring amino acid
  misc_feature (26)..(293): Xaa can be any naturally occurring amino acid
XXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 28810 - protein, 59 aa, Diabrotica virgifera
  misc_feature: Coding regions on vcDNA: vcDNA=SeqID_8507; Strand=-; Position=0-176
  misc_feature (2)..(25): Xaa can be any naturally occurring amino acid
  misc_feature (28)..(36): Xaa can be any naturally occurring amino acid
  misc_feature (38)..(51): Xaa can be any naturally occurring amino acid
PXXXXXXXXXXXXXXXXXXXXXXXXLWXXXXXXXXXGXXXXXXXXXXXXXXSFFSIQPS

SEQ ID NO: 28811 - protein, 189 aa, Diabrotica virgifera
  misc_feature: Coding regions on vcDNA: vcDNA=SeqID_8508; Strand=-; Position=89-658
  misc_feature (1)..(127): Xaa can be any naturally occurring amino acid
  misc_feature (136)..(143): Xaa can be any naturally occurring amino acid
  misc_feature (154)..(164): Xaa can be any naturally occurring amino acid
  misc_feature (178)..(184): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTNTVSLQKXXXXXXXXYINSNSLARLXXXXXXXXXXXNNPGYARYKYHFFXXXXXXXSLITN

SEQ ID NO: 28812 - protein, 66 aa, Diabrotica virgifera
  misc_feature: Coding regions on vcDNA: vcDNA=SeqID_8509; Strand=-; Position=2-199
  misc_feature (3)..(13): Xaa can be any naturally occurring amino acid
  misc_feature (15)..(15): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PFXXXXXXXXXXXTXLAHTGLNXXXXXXXXSNXXXXXXXXXXXXXXPTSRSXXXXXXXXXXXXXXV

SEQ ID NO: 28813 - protein, 66 aa, Diabrotica virgifera; identical to SEQ ID NO: 26808
  misc_feature: Coding regions on vcDNA: vcDNA=SeqID_8510; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28814 - protein, 297 aa, Diabrotica virgifera
  misc_feature: Coding regions on vcDNA: vcDNA=SeqID_8511; Strand=+; Position=36-929
  misc_feature: Homolog annotation: Hit_ID=EAL28356.1; Match level="QueryCoverage =90%, HitCoverage=37%, E-value=5e-53, Identity=42%"; Hit description =GA15158-PA [Drosophila pseudoobscura]
  misc_feature: Gene Ontology Annotation: Molecular function=DNA binding; Cellular component=nucleus; Biological process=regulation of transcription, DNA-dependent
  misc_feature (43)..(50): Xaa can be any naturally occurring amino acid
  misc_feature (81)..(91): Xaa can be any naturally occurring amino acid
MSLFRKPKKTIQRRVFTENDDEDDDVTQPMEVCQSIPVEKKSXXXXXXXXTPKTLLSFDEEEEGEVFQVKKSSHSKKVLRXXXXXXXXXXXKQEKEEIKSKEKTEIVTDDFVLVVNASHKKPPTPPLILSGRDALCAGKDDLSSEEDEPQNHKFNKPDNFKRILESGAIPDAAMIHAARKRRQRARELGDFIPTEEEEPEDKGRLLREDEHEGSDEERIDMEINLNLRDQERRREQFLAAQESDHEVLEWEDQQIRKGVTGAAMEAAREMFYPVEPPSPPRISAPGPFIEPGIPELH

SEQ ID NO: 28815 - protein, 47 aa, Diabrotica virgifera
  misc_feature: Coding regions on vcDNA: vcDNA=SeqID_8512; Strand=+; Position=13-156
GKQGNFFGKGQIQNKEWEPPMGGLKFNNGGKQLILFKVWSDFLKFLH

SEQ ID NO: 28816 - protein, 250 aa, Diabrotica virgifera
  misc_feature: Coding regions on vcDNA: vcDNA=SeqID_8513; Strand=+; Position=1-750
  misc_feature (1)..(21): Xaa can be any naturally occurring amino acid
  misc_feature (23)..(248): Xaa can be any naturally occurring amino acid
XXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKA

SEQ ID NO: 28817 - protein, 86 aa, Diabrotica virgifera
  misc_feature: Coding regions on vcDNA: vcDNA=SeqID_8514; Strand=-; Position=83-343
  misc_feature (46)..(54): Xaa can be any naturally occurring amino acid
MHHFPFSLFSSILYLFISFLNCSFLCISEQEASERRTISVFNINIXXXXXXXXXDMNLQLIDFSFTVTGIYRKNTYIKIPLYNNVP

SEQ ID NO: 28818 - protein, 19 aa, Diabrotica virgifera
  misc_feature: Coding regions on vcDNA: vcDNA=SeqID_8515; Strand=-; Position=1-60
  misc_feature (5)..(17): Xaa can be any naturally occurring amino acid
YYINXXXXXXXXXXXXXTL

SEQ ID NO: 28819 - protein, 244 aa, Diabrotica virgifera
  misc_feature: Coding regions on vcDNA: vcDNA=SeqID_8516; Strand=+; Position=134-864
  misc_feature: Homolog annotation: Hit_ID=XP_315858.1; Match level="QueryCoverage =95%, HitCoverage=54%, E-value=2e-58, Identity=50%"; Hit description =ENSANGP00000017428 [Anopheles gambiae]
  misc_feature: Pfam annotation: Pfam_ID=TPR_2; Match level="Score=30.6, E-value=4.6e- 06, Copies=3"; Pfam description=Tetratricopeptide repeat
  misc_feature (61)..(67): Xaa can be any naturally occurring amino acid
  misc_feature (212)..(212): Xaa can be any naturally occurring amino acid
MILFEQNTSHALALFDKILQKSPSSPRALYGKALTLDLLADQRRSNDILEKALQLYITLLXXXXXXXALFLEASERCINRMRFLGQYRTALQIHKLVIDKFPNAPQHLNSLAVTYLTINRIEEARSVLKEVLAKWPNNGFALVHYGFILKTTDNALEKAVRYLKKGINTKDEGVIDGRFYFHLGDALVRLGRREEADKVYEEGTNNKVFFSXYQRSLYNVPKLSGKPWWNPEDIPYPKFFNVLQ

SEQ ID NO: 28820 - protein, 291 aa, Diabrotica virgifera
  misc_feature: Coding regions on vcDNA: vcDNA=SeqID_8517; Strand=-; Position=1-873
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(290): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXP

SEQ ID NO: 28821 - protein, 371 aa, Diabrotica virgifera
  misc_feature: Coding regions on vcDNA: vcDNA=SeqID_8518; Strand=-; Position=6-1121
  misc_feature (14)..(41): Xaa can be any naturally occurring amino acid
  misc_feature (66)..(141): Xaa can be any naturally occurring amino acid
  misc_feature (143)..(143): Xaa can be any naturally occurring amino acid
  misc_feature (149)..(311): Xaa can be any naturally occurring amino acid
  misc_feature (315)..(352): Xaa can be any naturally occurring amino acid
  misc_feature (354)..(362): Xaa can be any naturally occurring amino acid
PPPRPAPRAVLKHXXXXXXXXXXXXXXXXXXXXXXXXXXXXPRGGGRIFIWGCPHKKKIRCFQGVXXXXXXXXXXXXXXXXXXXXXXXXXXXXXXXXXXXXXXXXXXXXXXXXXXXXXXXXXXXXXXXXXXXXXXXXXXXXSXQPFHSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDFIXXXXXXXXXXXXXXXXXXXXXXXXXXXXXXXXXXXXXXGXXXXXXXXXNEIFSHDTD

SEQ ID NO: 28822 - protein, 115 aa, Diabrotica virgifera
  misc_feature: Coding regions on vcDNA: vcDNA=SeqID_8519; Strand=-; Position=2-346
  misc_feature (4)..(49): Xaa can be any naturally occurring amino acid
  misc_feature (51)..(115): Xaa can be any naturally occurring amino acid
PLKXXXXXXXXXXXXXXXXXXXXXXXXXXXXXXXXXXXXXXXXXXXXXXQXXXXXXXXXXXXXXXXXXXXXXXXXXXXXXXXXXXXXXXXXXXXXXXXXXXXXXXXXXXXXXXXX

SEQ ID NO: 28823 - protein, 145 aa, Diabrotica virgifera
  misc_feature: Coding regions on vcDNA: vcDNA=SeqID_8520; Strand=-; Position=1-435
  misc_feature (6)..(145): Xaa can be any naturally occurring amino acid
MTDVHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 28824 - protein, 62 aa, Diabrotica virgifera
  misc_feature: Coding regions on vcDNA: vcDNA=SeqID_8521; Strand=-; Position=1-186
  misc_feature (3)..(61): Xaa can be any naturally occurring amino acid
FCXXXXXXXXXXXXXXXXXXXXXXXXXXXXXXXXXXXXXXXXXXXXXXXXXXXXXXXXXXXY

SEQ ID NO: 28825 - protein, 66 aa, Diabrotica virgifera; identical to SEQ ID NO: 26808
  misc_feature: Coding regions on vcDNA: vcDNA=SeqID_8522; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28826 - protein, 77 aa, Diabrotica virgifera
  misc_feature: Coding regions on vcDNA: vcDNA=SeqID_8523; Strand=-; Position=75-308
  misc_feature (46)..(52): Xaa can be any naturally occurring amino acid
VSSEAKNIAIHKTSNTNLLKKLQWSSCVKSCYQKLVLFNYVKRGIXXXXXXXCFCFKFVHVEIILSKIFIILLFSAI

SEQ ID NO: 28827 - protein, 194 aa, Diabrotica virgifera
  misc_feature: Coding regions on vcDNA: vcDNA=SeqID_8524; Strand=-; Position=1-585
  misc_feature (10)..(23): Xaa can be any naturally occurring amino acid
  misc_feature (25)..(194): Xaa can be any naturally occurring amino acid
ITLIHHRGSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 28828 - protein, 36 aa, Diabrotica virgifera
  misc_feature: Coding regions on vcDNA: vcDNA=SeqID_8525; Strand=-; Position=93-203
  misc_feature (4)..(23): Xaa can be any naturally occurring amino acid
VLFXXXXXXXXXXXXXXXXXXXXLNSDHVNFKSGQT

SEQ ID NO: 28829 - protein, 34 aa, Diabrotica virgifera
  misc_feature: Coding regions on vcDNA: vcDNA=SeqID_8526; Strand=-; Position=1-102
  misc_feature (8)..(16): Xaa can be any naturally occurring amino acid
  misc_feature (21)..(30): Xaa can be any naturally occurring amino acid
RGPNLYIXXXXXXXXXVSLKXXXXXXXXXXSKKL

SEQ ID NO: 28830 - protein, 212 aa, Diabrotica virgifera; identical to SEQ ID NO: 20382
  misc_feature: Coding regions on vcDNA: vcDNA=SeqID_8527; Strand=+; Position=51-689
  misc_feature: Homolog annotation: Hit_ID=EAL34231.1; Match level="QueryCoverage =100%, HitCoverage=100%, E-value=2e-99, Identity=83%"; Hit description=GA18717-PA [Drosophila pseudoobscura]
  misc_feature: Gene Ontology Annotation: Molecular function=KDEL sequence binding; Cellular component=integral to membrane; Biological process =intracellular protein transport
  misc_feature: Pfam annotation: Pfam_ID=ER_lumen_recept; Match level="Score=511.1, E- value=1.1e-150, Copies=1"; Pfam description=ER lumen protein retaining receptor

SEQ ID NO: 28831 - protein, 220 aa, Diabrotica virgifera
  misc_feature: Coding regions on vcDNA: vcDNA=SeqID_8528; Strand=+; Position=20-682
  misc_feature: Homolog annotation: Hit_ID=XP_309520.1; Match level="QueryCoverage =89%, HitCoverage=65%, E-value=7e-59, Identity=57%"; Hit description =ENSANGP00000012620 [Anopheles gambiae]
  misc_feature: Gene Ontology Annotation: Molecular function=spermidine synthase activity; Cellular component=cellular_component unknown; Biological process=cell organization and biogenesis
  misc_feature: Pfam annotation: Pfam_ID=Spermine_synth; Match level="Score=94.9, E -value=2.1e-25, Copies=1"; Pfam description=Spermine/spermidine synthase
  misc_feature (163)..(175): Xaa can be any naturally occurring amino acid
MDQGMENITHCETRRDETSGDGGVAREVQKHPLVKEIVQVEIDEKVVNASKKHLPFMAKGFDSAKLTLKICDGFEYMKKHKNEFDVIITDSSDPIGPAVNLFTESYYKLAKEALKPNGIISCQAGTVWSDLPHVKKTLTNCRKHFKTVRYGFSTIPSYPDGQXXXXXXXXXXXXXLRTPKFKFTQEQLDNLNLRFYNDEMHSAAFVLPNFVKRELRELAE

SEQ ID NO: 28832 - protein, 301 aa, Diabrotica virgifera
  misc_feature: Coding regions on vcDNA: vcDNA=SeqID_8529; Strand=-; Position=2-904
  misc_feature (15)..(24): Xaa can be any naturally occurring amino acid
  misc_feature (33)..(41): Xaa can be any naturally occurring amino acid
  misc_feature (87)..(299): Xaa can be any naturally occurring amino acid
PCPGFVKLWVLFRAXXXXXXXXXXPVFFFPLFXXXXXXXXXINLIFAWTKGLTFFSFPIKDVLTPVHETFSEAPNASVRKTALKEVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHQ

SEQ ID NO: 28833 - protein, 65 aa, Diabrotica virgifera
  misc_feature: Coding regions on vcDNA: vcDNA=SeqID_8530; Strand=-; Position=81-278
  misc_feature (50)..(57): Xaa can be any naturally occurring amino acid
LFQYIIAPLPKDIDLIISLLKRQVSLYTGCNNDSSLLPQSLEHPVEYSSXXXXXXXXLNCSNRLS

SEQ ID NO: 28834 - protein, 273 aa, Diabrotica virgifera
  misc_feature: Coding regions on vcDNA: vcDNA=SeqID_8531; Strand=+; Position=77-897
  misc_feature: Homolog annotation: Hit_ID=NP_729735.1; Match level="QueryCoverage =99%, HitCoverage=60%, E-value=7e-95, Identity=62%"; Hit description =CG11652-PB, isoform B [Drosophila melanogaster] ref|NP_648496.1| CG11652-PA, isoform A [Drosophila
  misc_feature: Gene Ontology Annotation: Molecular function=molecular_function unknown; Cellular component=cytoplasm; Biological process=biological_ process unknown
  misc_feature: Pfam annotation: Pfam_ID=Diphthamide_syn; Match level="Score=136.7, E- value=5.4e-38, Copies=1"; Pfam description=Putative diphthamide synthesis protei
  misc_feature (226)..(226): Xaa can be any naturally occurring amino acid
  misc_feature (235)..(235): Xaa can be any naturally occurring amino acid
MSETAVVVKAKPERKVFKATKVTKIPQSLLNNPKLQSAIEGLPKNYNFEIPKTIWRIQELKAKTVALQMPEGLLLFSTTIADIIKEFSGADSIIMGDVTYGACCIDDLTAKALGVELLVHYGHSCLVPANQTCGIKVLYVFVDIKIDPLHFIETVKLNFKKTTKIGLVSTIQFVTTIQAAATRLKEMEYDVSIPQFKPLSPGEILGCTAPVLNGAEVLIYIGGWKXHLEAAMIAXSRGSAYKYDPYSKEFTREYYSHSDMGKIRQSSIQEATK

SEQ ID NO: 28835 - protein, 66 aa, Diabrotica virgifera
  misc_feature: Coding regions on vcDNA: vcDNA=SeqID_8532; Strand=-; Position=106-306
LSLPVHSINSFHHHQPRVTSYPIPYSQEQKTQDIVSSKHDHNLFLSDIRMKSTYYHYFNIPWPPAR

SEQ ID NO: 28836 - protein, 90 aa, Diabrotica virgifera
  misc_feature: Coding regions on vcDNA: vcDNA=SeqID_8533; Strand=+; Position=507-779
  misc_feature (62)..(69): Xaa can be any naturally occurring amino acid
KFKVKITVWRPRADRRSRGRPPTRWTDDVKRIAGNWLQKAQDRQNWKKLGEAYVQLWMQKAXXXXXXXXILKSRVMESSACGLPIIVAVI

SEQ ID NO: 28837 - protein, 161 aa, Diabrotica virgifera
  misc_feature: Coding regions on vcDNA: vcDNA=SeqID_8534; Strand=-; Position=195-680
  misc_feature: Homolog annotation: Hit_ID=XP_317949.1; Match level="QueryCoverage =90%, HitCoverage=29%, E-value=3e-30, Identity=44%"; Hit description =ENSANGP00000020548 [Anopheles gambiae]
EISQSVYQITIYKTLIQPVLTYGSEAWTISNADENLLLIFERRILRGIFRGICENGVSEVQLRGMVYHRYKQKFGGNDVVSLIRIGRLRWAEHLARSQQNNPPRIILISQPVGSRNRGKPKLRWKDGVDEDGRQIGAANWQRLAMDRTDWRNRLGKVEALS

SEQ ID NO: 28838 - protein, 311 aa, Diabrotica virgifera
  misc_feature: Coding regions on vcDNA: vcDNA=SeqID_8535; Strand=+; Position=17-949
  misc_feature: Homolog annotation: Hit_ID=CAD91693.1; Match level="QueryCoverage =90%, HitCoverage=63%, E-value=1e-44, Identity=35%"; Hit description =acid phosphatase 1 [Drosophila subobscura]
  misc_feature: Gene Ontology Annotation: Molecular function=protein tyrosine phosphatase activity; Cellular component=extracellular; Biological process=regulation of cell cycle
  misc_feature: Pfam annotation: Pfam_ID=Acid_phosphat_A; Match level="Score=-72.1, E- value=0.00038, Copies=1"; Pfam description=Histidine acid phosphatase
  misc_feature (302)..(302): Xaa can be any naturally occurring amino acid
TIPTNIILLLCLIFDAVNDCNSELVALVQIFRHGERSPITFYSTDPYANAAYWEDLGGELANRGKRQHEALGQHTRNVYSDFLPTRFNSNVLYATTTDVHRTHMSGQCNLYGMFPAVGNNIWKENLNWQPIPLHQADPYIFNGNPVDCPNYDLVYADLWLRKPYAALLNKYQSVFEYLTEHTGDNVTDFLSALTVHDCLLIEDGVGYELPEWASEVYPEPLATIAGIGYKSLTDTLELQQFYCGTLVNDIVEYLDAKISNPLDVEQYRIYSGHDSNIAALLNTFGAFDEPYSPAFCSTIYIXLRQRESDDL

SEQ ID NO: 28839 - protein, 269 aa, Diabrotica virgifera
  misc_feature: Coding regions on vcDNA: vcDNA=SeqID_8536; Strand=-; Position=58-862
  misc_feature: Homolog annotation: Hit_ID=AAR37015.1; Match level="QueryCoverage =99%, HitCoverage=50%, E-value=8e-63, Identity=47%"; Hit description =cytochrome P450 [Helicoverpa armigera]
  misc_feature: Gene Ontology Annotation: Molecular function=cytochrome P450 activity; Cellular component=membrane; Biological process=electron transport
  misc_feature: Pfam annotation: Pfam_ID=p450; Match level="Score=-82.3, E-value=1.7e- 07, Copies=1"; Pfam description=Cytochrome P450
  misc_feature (23)..(23): Xaa can be any naturally occurring amino acid
  misc_feature (58)..(58): Xaa can be any naturally occurring amino acid
  misc_feature (84)..(84): Xaa can be any naturally occurring amino acid
KKKTMFSPDMLNFLIEAKKGYTXHKDEQNGVDEGFYTVQEHLPGKHMQDSKEITNEDXTAHALIFFFGGFDSVSSTMCFAAHEXLATHPRFQSRLREEIDRGFEEGKGKMTYEVLMKMKYLDMVISECLRKWPNFPGIDRECSKEYVIQPESPDEKPLIVEKGSILVLPIMSIHHDAKYFPDPERFDPERFSDENKEKIGEYTYFPFGLGPRNCIGSRFALLEMKALFSHLLHHFEIVPIADTLIPPQLMKRNFNLMPVNGMRLGLKRL

SEQ ID NO: 28840 - protein, 103 aa, Diabrotica virgifera
  misc_feature: Coding regions on vcDNA: vcDNA=SeqID_8537; Strand=+; Position=418-729
  misc_feature (79)..(79): Xaa can be any naturally occurring amino acid
  misc_feature (82)..(82): Xaa can be any naturally occurring amino acid
  misc_feature (85)..(85): Xaa can be any naturally occurring amino acid
MKSLLCNSRINISLRCGFLHCYVSLLLYVMEVWRLNITLMNKLEAFELWLNRRILKISWITHTNENVLRRIGIDKELLXVFXVRXYSYMGHIMRNEKSTASRN

SEQ ID NO: 28841 - protein, 130 aa, Diabrotica virgifera
  misc_feature: Coding regions on vcDNA: vcDNA=SeqID_8538; Strand=-; Position=1-390
  misc_feature (16)..(50): Xaa can be any naturally occurring amino acid
  misc_feature (53)..(63): Xaa can be any naturally occurring amino acid
  misc_feature (73)..(80): Xaa can be any naturally occurring amino acid
  misc_feature (83)..(96): Xaa can be any naturally occurring amino acid
  misc_feature (102)..(115): Xaa can be any naturally occurring amino acid
  misc_feature (117)..(129): Xaa can be any naturally occurring amino acid
NKKFHLGGYKWGGLWXXXXXXXXXXXXXXXXXXXXXXXXXXXXXXXXXXXPFXXXXXXXXXXXTNLAHTGLNXXXXXXXXSNXXXXXXXXXXXXXXPTSRSXXXXXXXXXXXXXXVXXXXXXXXXXXXXG

SEQ ID NO: 28842 - protein, 45 aa, Diabrotica virgifera
  misc_feature: Coding regions on vcDNA: vcDNA=SeqID_8539; Strand=+; Position=9-146
  misc_feature (1)..(1): Xaa can be any naturally occurring amino acid
XIQRNFYGRSQIEYKDCDLDGGIKFNNWCNSYFIKPVRLLKFYLD

SEQ ID NO: 28843 - protein, 218 aa, Diabrotica virgifera
  misc_feature: Coding regions on vcDNA: vcDNA=SeqID_8540; Strand=+; Position=201-854
  misc_feature: Homolog annotation: Hit_ID=XP_395244.1; Match level="QueryCoverage =46%, HitCoverage=17%, E-value=4e-30, Identity=68%"; Hit description =similar to CG17255-PA [Apis mellifera]
  misc_feature: Pfam annotation: Pfam_ID=BAT2_N; Match level="Score=28.0, E-value =8.1e-09, Copies=1"; Pfam description=BAT2 N-terminus
MSTLPGQASKGEKTKSKFQSLDINNLYRVSRGENLEKQQQKSSSVYIKHGMQSLGKVPNARRAPANLPSLKAEHSGTDAAVPLVPPGAPGWGKQDTSATGTSQSPNNNHQTVAQSQDSNVPPLNAPNQTGVSPQLSSHQAAIALPVTNTIPPQTHKQLTPTAQPVPTDKLWSSVMTGPESHPPYIRVYSNTNSPACHLEMAPPHALGPMLPSILQGSV

SEQ ID NO: 28844 - protein, 227 aa, Diabrotica virgifera
  misc_feature: Coding regions on vcDNA: vcDNA=SeqID_8541; Strand=+; Position=95-778
  misc_feature: Homolog annotation: Hit_ID=NP_609630.1; Match level="QueryCoverage =91%, HitCoverage=18%, E-value=4e-25, Identity=35%"; Hit description =CG6108-PA [Drosophila melanogaster] gb|AAF53275.1| CG6108-PA [Drosophila melanogaster]
NTYNKRIFSDDTKELSKDKISINDSSNRSKTASSKSSLKSFEEFSEEEEVDSGVTSDMSRHISDTEEFPELRKLTKYQRAATHSRLFKLLQEECNNEDVEEDAEESKQALDLNLNDAKNPVNERLVNELVDSLLKLKKGQAFKNLPKEKLYAAAVKILQEDMEVTDTLSGYSTSVQTPQEFGTNSDDYKQYYDTWDRSEESFDIFPSKAFKVLQELSSKQQGGGIGA

SEQ ID NO: 28845 - protein, 111 aa, Diabrotica virgifera
  misc_feature: Coding regions on vcDNA: vcDNA=SeqID_8542; Strand=+; Position=95-430
LVQNLIVGNTSTVGKAFPIAFTIKRPVTCSPLSADVTCPTCFSPRLGLAQIEPKPDTTCTGGTGDPCIYLSGVPHIEHNPTQPLAIDVANRGGQNQCGHVTVTFDTGSQWY

SEQ ID NO: 28846 - protein, 219 aa, Diabrotica virgifera
  misc_feature: Coding regions on vcDNA: vcDNA=SeqID_8543; Strand=+; Position=1-660
  misc_feature: Homolog annotation: Hit_ID=XP_313350.1; Match level="QueryCoverage =100%, HitCoverage=35%, E-value=5e-59, Identity=49%"; Hit description= ENSANGP00000011379 [Anopheles gambiae]
  misc_feature: Gene Ontology Annotation: Molecular function=protein-arginine N -methyltransferase activity; Cellular component=nucleus; Biological process=protein-nucleus import
GQLEKLNLPVEKVDILVSEWMGYFLLFEGMLDSVVHARDTFLKPDGLILPNRWNISLIGVSDIDRYNSVINFWDDVYGFSMKCMKPDVLQEPFVEIVPVEKLLTDSQVVTEIDIKTCDMNACVFSSKFNLTSARDGILTAIAGYFDTFFDLENKVEFSTGPNSTRTHWQQTLFFLPNTIDMKAGDTVEGTISCKRLPKNVRGLSVTITIGSNKYQYIMD

SEQ ID NO: 28847 - protein, 24 aa, Diabrotica virgifera
  misc_feature: Coding regions on vcDNA: vcDNA=SeqID_8544; Strand=-; Position=2-76
  misc_feature (16)..(23): Xaa can be any naturally occurring amino acid
TTIYILSLNNQVVNPXXXXXXXXK

SEQ ID NO: 28848 - protein, 163 aa, Diabrotica virgifera
  misc_feature: Coding regions on vcDNA: vcDNA=SeqID_8545; Strand=+; Position=602-1090
  misc_feature (6)..(14): Xaa can be any naturally occurring amino acid
  misc_feature (20)..(29): Xaa can be any naturally occurring amino acid
  misc_feature (86)..(94): Xaa can be any naturally occurring amino acid
  misc_feature (108)..(117): Xaa can be any naturally occurring amino acid
  misc_feature (131)..(142): Xaa can be any naturally occurring amino acid
ILMTLXXXXXXXXXQSLPKXXXXXXXXXXDIIYSKSRIRKLVQNLRDFLMIVSSHIYAGTFWIPLIFPNPPKKNNDMVLILPKRVXXXXXXXXXLLFIWQKKTPLFPXXXXXXXXXXPLLTILNFKKLRLXXXXXXXXXXXXRLGTLKKFWVGAKRIFPKRGA

SEQ ID NO: 28849 - protein, 75 aa, Diabrotica virgifera
  misc_feature: Coding regions on vcDNA: vcDNA=SeqID_8546; Strand=+; Position=485-712
  misc_feature (65)..(65): Xaa can be any naturally occurring amino acid
LGSPSLLVTLAPNVSHVRFFRYTGAPTHLSYPKNRAVSVWFGSRQQALINTIFIYFIFIFNFCSXSIYIIYFGTF

SEQ ID NO: 28850 - protein, 60 aa, Diabrotica virgifera
  misc_feature: Coding regions on vcDNA: vcDNA=SeqID_8547; Strand=-; Position=351-533
PFQVSETYLSQFTTMRSNGRSYESREDQFIALASKEVDMHPENVTFCFGFRASDVIGPYS

SEQ ID NO: 28851 - protein, 42 aa, Diabrotica virgifera
  misc_feature: Coding regions on vcDNA: vcDNA=SeqID_8548; Strand=+; Position=3-131
  misc_feature (2)..(14): Xaa can be any naturally occurring amino acid
TXXXXXXXXXXXXXCDLDVGLKFIIGVEAILLSLSELFHFLL

SEQ ID NO: 28852 - protein, 125 aa, Diabrotica virgifera
  misc_feature: Coding regions on vcDNA: vcDNA=SeqID_8549; Strand=-; Position=30-407
  misc_feature (59)..(64): Xaa can be any naturally occurring amino acid
ISKEEWDSTNILSSSSIFNMGYINNIKISIVNMLGFINIRHLLIKSRSAERVIPHQTKXXXXXXAKSRKDPNSQLSPSAASYIAICFPVTNDSHDAQGESSSGRGKVWFPDKNWQAANKMKAEII

SEQ ID NO: 28853 - protein, 87 aa, Diabrotica virgifera
  misc_feature: Coding regions on vcDNA: vcDNA=SeqID_8550; Strand=-; Position=416-679
TLKVKKCGYDHLPEHLLNSPRTKQWVQLQFNPHHVVVILNRPNADVKRYNLREHGETLPGNPINHLRPTLTTKCQKPVRNCSERHRQ

SEQ ID NO: 28854 - protein, 60 aa, Diabrotica virgifera
  misc_feature: Coding regions on vcDNA: vcDNA=SeqID_8551; Strand=-; Position=0-179
  misc_feature (4)..(47): Xaa can be any naturally occurring amino acid
  misc_feature (53)..(59): Xaa can be any naturally occurring amino acid
KNGXXXXXXXXXXXXXXXXXXXXXXXXXXXXXXXXXXXXXXXXXXXXLYGVFXXXXXXXP

SEQ ID NO: 28855 - protein, 30 aa, Diabrotica virgifera
  misc_feature: Coding regions on vcDNA: vcDNA=SeqID_8552; Strand=-; Position=1-90
  misc_feature (5)..(28): Xaa can be any naturally occurring amino acid
FIPPXXXXXXXXXXXXXXXXXXXXXXXXFF

SEQ ID NO: 28856 - protein, 285 aa, Diabrotica virgifera
  misc_feature: Coding regions on vcDNA: vcDNA=SeqID_8553; Strand=+; Position=59-913
  misc_feature: Homolog annotation: Hit_ID=XP_310833.1; Match level="QueryCoverage =86%, HitCoverage=69%, E-value=3e-70, Identity=53%"; Hit description =ENSANGP00000012490 [Anopheles gambiae]
  misc_feature: Gene Ontology Annotation: Molecular function=molecular_function unknown; Cellular component=cellular_component unknown; Biological process=biological_process unknown
  misc_feature: Pfam annotation: Pfam_ID=ADH_zinc_N; Match level="Score=-31.1, E -value=7.1e-06, Copies=1"; Pfam description=Zinc-binding dehydrogenase
  misc_feature (230)..(230): Xaa can be any naturally occurring amino acid
  misc_feature (232)..(232): Xaa can be any naturally occurring amino acid
  misc_feature (266)..(266): Xaa can be any naturally occurring amino acid
MTACNKLLKKSRLFSQTNKFIKRHVSAKAFIFEKQFDGFPKESDFKLVTEELPALKDGEFLAAAEYLSVDPYMRAYAPRVKTGRTFMGSQVAKIVESKNSKFPEGTYIVGEYGWRTHTISNGKGAVNGLPSVWIIPDIEDLPHSLALGVLGMPGNTAYFGFLELCQPKVGETVIVTGAAGAVGSHVGQIAKIKGCRTVGVAGSDEKGKWLVDELGFDHFINYKKDDLRSXIXEFAPYDCYFDNVGGEISSMIMLYMSLFRRISVCXAISGYNDTSLPKAPIVPYP

SEQ ID NO: 28857 - protein, 269 aa, Diabrotica virgifera
  misc_feature: Coding regions on vcDNA: vcDNA=SeqID_8554; Strand=-; Position=3-809
  misc_feature (11)..(26): Xaa can be any naturally occurring amino acid
  misc_feature (33)..(254): Xaa can be any naturally occurring amino acid
  misc_feature (256)..(266): Xaa can be any naturally occurring amino acid
IKKLLAFSSPXXXXXXXXXXXXXXXXLIINLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXALK

SEQ ID NO: 28858 - protein, 87 aa, Diabrotica virgifera
  misc_feature: Coding regions on vcDNA: vcDNA=SeqID_8555; Strand=-; Position=131-394
LKCHVRINVINVYYHGLTLFPIICYALKNDHEKYCTYISFKYSNIEMIFANRKQNFRYDNARILSLFLDLILSLCYRFDITSDPQLL

SEQ ID NO: 28859 - protein, 80 aa, Diabrotica virgifera
  misc_feature: Coding regions on vcDNA: vcDNA=SeqID_8556; Strand=-; Position=2-241
  misc_feature (10)..(80): Xaa can be any naturally occurring amino acid
KKFPRFSLKXXXXXXXXXXXXXXXXXXXXXXXXXXXXXXXXXXXXXXXXXXXXXXXXXXXXXXXXXXXXXXXXXXXXXXX

SEQ ID NO: 28860 - protein, 109 aa, Diabrotica virgifera
  misc_feature: Coding regions on vcDNA: vcDNA=SeqID_8557; Strand=+; Position=65-394
  misc_feature: Homolog annotation: Hit_ID=AAR31140.1; Match level="QueryCoverage =83%, HitCoverage=30%, E-value=2e-09, Identity=41%"; Hit description =GH27591p [Drosophila melanogaster] ref|NP_727450.1| CG16944-PB, isoform B [Drosophila melanogaster] ref|NP
HIATDILPDAKNPPHGPFCAIRRTAAAVVVILSYPFYSAPKRMMMLAALKNIKTVYIMTGLCSDTMANINGTDALFKGALSSGLRGNGATNALDMDYENLNVSVSLGFH

SEQ ID NO: 28861 - protein, 28 aa, Diabrotica virgifera
  misc_feature: Coding regions on vcDNA: vcDNA=SeqID_8558; Strand=-; Position=0-83
  misc_feature (5)..(26): Xaa can be any naturally occurring amino acid
KKLGXXXXXXXXXXXXXXXXXXXXXXTP

SEQ ID NO: 28862 - protein, 59 aa, Diabrotica virgifera
  misc_feature: Coding regions on vcDNA: vcDNA=SeqID_8559; Strand=+; Position=323-502
MKLKSMGIETSLLMVTIKSSQFMLYGGGCESAGITGTWYGGWFSINTKVNWFHFLSGQW

SEQ ID NO: 28863 - protein, 239 aa, Diabrotica virgifera
  misc_feature: Coding regions on vcDNA: vcDNA=SeqID_8560; Strand=+; Position=83-799
  misc_feature: Homolog annotation: Hit_ID=XP_312380.1; Match level="QueryCoverage =87%, HitCoverage=63%, E-value=2e-29, Identity=33%"; Hit description =ENSANGP00000012173 [Anopheles gambiae]
  misc_feature (80)..(88): Xaa can be any naturally occurring amino acid
MGSSDLLMNDREKVLQAFEKTEKDLAEDVIVIKEWIKSQPHLPEVPSTSIIESFLVTNKFSIEKTKNKLDMYYSIRTMIXXXXXXXXXNLPHMIEITKYVQYIPLPKLTKDMFRVNISKLSGNPKYFDVYNFFAHQININEIRLHEELILGDVLLVDLKDVSLGHMVKVTPQHIKKAVLVLEKVFSNRIKQIHLVNPSTSVDMLVSVLKSTLKQKLADRIQVHNNIETLLNHMSSEIFA

SEQ ID NO: 28864 - protein, 54 aa, Diabrotica virgifera
  misc_feature: Coding regions on vcDNA: vcDNA=SeqID_8561; Strand=+; Position=371-535
LPYRVLMTKIMIYYDHMLASTYETHTSLIPHGSYVPATKWMIDPGPEILCPTAD

SEQ ID NO: 28865 - protein, 51 aa, Diabrotica virgifera
  misc_feature: Coding regions on vcDNA: vcDNA=SeqID_8562; Strand=-; Position=1-153
  misc_feature (17)..(49): Xaa can be any naturally occurring amino acid
RFEPFPNKNFARYSLKXXXXXXXXXXXXXXXXXXXXXXXXXXXXXXXXXHP

SEQ ID NO: 28866 - protein, 111 aa, Diabrotica virgifera
  misc_feature: Coding regions on vcDNA: vcDNA=SeqID_8563; Strand=+; Position=55-389
  misc_feature: Homolog annotation: Hit_ID=CAH81944.1; Match level="QueryCoverage =87%, HitCoverage=92%, E-value=7e-15, Identity=31%"; Hit description =conserved hypothetical protein [Plasmodium chabaudi]
  misc_feature (6)..(6): Xaa can be any naturally occurring amino acid
  misc_feature (11)..(11): Xaa can be any naturally occurring amino acid
  misc_feature (13)..(13): Xaa can be any naturally occurring amino acid
  misc_feature (63)..(63): Xaa can be any naturally occurring amino acid
  misc_feature (75)..(75): Xaa can be any naturally occurring amino acid
  misc_feature (96)..(96): Xaa can be any naturally occurring amino acid
  misc_feature (98)..(98): Xaa can be any naturally occurring amino acid
KEQRKXEKKGXKXETREKSKEAKKKKGAKRTRRKREQEGRERQKTRKERRRGKKEKGTREKKXRERRGRKERRRXKKQNEVTKKETKGNQEQQKQXQXVTFFSTYIVSFCH

SEQ ID NO: 28867 - protein, 29 aa, Diabrotica virgifera
  misc_feature: Coding regions on vcDNA: vcDNA=SeqID_8564; Strand=-; Position=1-87
  misc_feature (18)..(27): Xaa can be any naturally occurring amino acid
PAPPKARLLKSVHPWEKXXXXXXXXXXFF

SEQ ID NO: 28868 - protein, 20 aa, Diabrotica virgifera
  misc_feature: Coding regions on vcDNA: vcDNA=SeqID_8565; Strand=-; Position=0-59
  misc_feature (7)..(15): Xaa can be any naturally occurring amino acid
  misc_feature (17)..(18): Xaa can be any naturally occurring amino acid
SKNYNYXXXXXXXXXIXXIT

SEQ ID NO: 28869 - protein, 104 aa, Diabrotica virgifera
  misc_feature: Coding regions on vcDNA: vcDNA=SeqID_8566; Strand=-; Position=1-312
  misc_feature (72)..(77): Xaa can be any naturally occurring amino acid
KYFYVSSTVCRITDNCEEDQDEIQFGFRNGLGTRDTLFALNVLLQKCRDQRKDVFAVFIDYDKAFDRQQHHXXXXXXKDKGVDSQNVQIIEKFYWRQTATACIN

SEQ ID NO: 28870 - protein, 76 aa, Diabrotica virgifera
  misc_feature: Coding regions on vcDNA: vcDNA=SeqID_8567; Strand=-; Position=632-862
  misc_feature (26)..(40): Xaa can be any naturally occurring amino acid
  misc_feature (44)..(44): Xaa can be any naturally occurring amino acid
ILQRAIYYSIGVRFQICRACIYVLGXXXXXXXXXXXXXXXGYVXNIYFSLFIVVFCLFWISFAVFCELYKLYHNAK

SEQ ID NO: 28871 - protein, 35 aa, Diabrotica virgifera
  misc_feature: Coding regions on vcDNA: vcDNA=SeqID_8568; Strand=-; Position=0-104
  misc_feature (1)..(33): Xaa can be any naturally occurring amino acid
XXXXXXXXXXXXXXXXXXXXXXXXXXXXXXXXXPS

SEQ ID NO: 28872 - protein, 230 aa, Diabrotica virgifera
  misc_feature: Coding regions on vcDNA: vcDNA=SeqID_8569; Strand=+; Position=137-829
  misc_feature (193)..(193): Xaa can be any naturally occurring amino acid
  misc_feature (200)..(200): Xaa can be any naturally occurring amino acid
  misc_feature (203)..(203): Xaa can be any naturally occurring amino acid
  misc_feature (212)..(212): Xaa can be any naturally occurring amino acid
FTLLNVIQIRMAIATNVVFKIPQEPCPLTTLESDEESFVVLGQSIPDASTELYPEPIGLSVIAEAKRLINFELEAIDQAKNNDEKKGCLESNKDVFKLSSSTMDTSENFPMMANINRGVELSSVISIASFTPDMSSEEVQKKIAHIIDENIRLKDTVLQNNLSLKSQYERIVAWQEDVQKVHQAHKDKLLEAXAFIETLXREXDSLKRELTXDIEFGDSQASQIEEFEND

SEQ ID NO: 28873 - protein, 206 aa, Diabrotica virgifera
  misc_feature: Coding regions on vcDNA: vcDNA=SeqID_8570; Strand=+; Position=184-801
  misc_feature (12)..(19): Xaa can be any naturally occurring amino acid
  misc_feature (37)..(191): Xaa can be any naturally occurring amino acid
  misc_feature (193)..(199): Xaa can be any naturally occurring amino acid
SIHTLTTFESSXXXXXXXXFHRKIKYFKSIFFVIETXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXXXWNVKGGM

SEQ ID NO: 28874 - protein, 56 aa, Diabrotica virgifera
  misc_feature: Coding regions on vcDNA: vcDNA=SeqID_8571; Strand=-; Position=1-168
  misc_feature (16)..(27): Xaa can be any naturally occurring amino acid
  misc_feature (30)..(56): Xaa can be any naturally occurring amino acid
FNKKPNDYTTISRAKXXXXXXXXXXXXDLXXXXXXXXXXXXXXXXXXXXXXXXXXX

SEQ ID NO: 28875 - protein, 56 aa, Diabrotica virgifera
  misc_feature: Coding regions on vcDNA: vcDNA=SeqID_8572; Strand=-; Position=0-167
  misc_feature (19)..(50): Xaa can be any naturally occurring amino acid
INLIHLPITIHNSQSITLXXXXXXXXXXXXXXXXXXXXXXXXXXXXXXXXYLVYQG

SEQ ID NO: 28876 - protein, 77 aa, Diabrotica virgifera
  misc_feature: Coding regions on vcDNA: vcDNA=SeqID_8573; Strand=-; Position=45-278
  misc_feature (23)..(42): Xaa can be any naturally occurring amino acid
  misc_feature (48)..(58): Xaa can be any naturally occurring amino acid
  misc_feature (63)..(70): Xaa can be any naturally occurring amino acid
QRDYLKISYFDNQKILDSLSSLXXXXXXXXXXXXXXXXXXXXAKMNVXXXXXXXXXXXLIIYXXXXXXXXFYYKIFY

SEQ ID NO: 28877 - protein, 123 aa, Diabrotica virgifera
  misc_feature: Coding regions on vcDNA: vcDNA=SeqID_8574; Strand=+; Position=3-374
  misc_feature: Homolog annotation: Hit_ID=XP_393995.1; Match level="QueryCoverage =69%, HitCoverage=33%, E-value=3e-23, Identity=62%"; Hit description =similar to CG4858-PA [Apis mellifera]
  misc_feature: Gene Ontology Annotation: Molecular function=molecular_function unknown; Cellular component=cellular_component unknown; Biological process=cell growth and/or maintenance
LVLSGKGGVGKSTVSTQLSLILAEKGYKVGLLDVDLCGPSVPYLLKLEGKDVHLGNEGWIPVPLDHGQDAYLDMLQPLLHVTGDGLTTVSEHAANPVHLLLLNLLHANTGPEFDDRKERDPRW

SEQ ID NO: 28878 - protein, 283 aa, Diabrotica virgifera
  misc_feature: Coding regions on vcDNA: vcDNA=SeqID_8575; Strand=+; Position=1-849
  misc_feature (36)..(47): Xaa can be any naturally occurring amino acid
  misc_feature (127)..(133): Xaa can be any naturally occurring amino acid
QKVENFHLAAHSSVLVMTQPPKLGSAERKDHFQVTXXXXXXXXXXXXHVEKIVHPGPRHLVTVLPGESHTFDLSGSHYNMTVLQVTNHEDGEAVFSAEGGNVIPDMEQTIQEELPEHVEHKVDNVHXXXXXXXLVMSQPINEGEEGRQDHFLVSNKGNVKIDAEVIHVERIVHLGPSHLVTILPGQSHTFDLTGVHFRRALLKVINHEEGEAVFSAQGGNVLKDFEETVQKLDHDVQAAQEVENFHLPAHSSVLVMSQLPKQGTEERRDHFQSTNNGNVTIDA

SEQ ID NO: 28879 - protein, 62 aa, Diabrotica virgifera
  misc_feature: Coding regions on vcDNA: vcDNA=SeqID_8576; Strand=-; Position=266-454
ISAGSRMLSFIIRNLCLMLEVYELCIRTIGGSTRFYRQILDIYSHLICFFLVNVQDIMHVPI

SEQ ID NO: 28880 - protein, 169 aa, Diabrotica virgifera
  misc_feature: Coding regions on vcDNA: vcDNA=SeqID_8577; Strand=+; Position=436-942
  misc_feature: Homolog annotation: Hit_ID=BAA08868.1; Match level="QueryCoverage =83%, HitCoverage=32%, E-value=2e-52, Identity=68%"; Hit description =ornithine aminotransferase [Drosophila ananassae] sp|P49724|OAT _DROAN Ornithine aminotransferase, mitochon
  misc_feature: Gene Ontology Annotation: Molecular function=ornithine-oxo-acid aminotransferase activity; Cellular component=mitochondrial matrix; Biological process=ornithine metabolism
  misc_feature (85)..(85): Xaa can be any naturally occurring amino acid
  misc_feature (122)..(122): Xaa can be any naturally occurring amino acid
  misc_feature (139)..(139): Xaa can be any naturally occurring amino acid
  misc_feature (145)..(145): Xaa can be any naturally occurring amino acid
  misc_feature (153)..(153): Xaa can be any naturally occurring amino acid
MLPSSRRATRLSKNLERCIKLLEKRSLSSQEVFDKEAKYAAHNYHPLPVALTKGQGVFVWDVEGKKYFDFLSGYSANNFGHCHPXLKALHEQSAVLHHTSRAFFSDQLGQYAEAITKLFGYXQLMPMNTGCEAGDTALXLARKWXYRKKKIPXNQAKIIFAADNFWGRS

SEQ ID NO: 28881 - protein, 110 aa, Diabrotica virgifera
  misc_feature: Coding regions on vcDNA: vcDNA=SeqID_8578; Strand=+; Position=139-471
  misc_feature (32)..(39): Xaa can be any naturally occurring amino acid
RALYSLQFYLQDARKLFKGMRSMSSVDYCMRXXXXXXXXVWCHFLCKFACKCRGICRKFDFSTMSNVIITDLLGYMPISCFLFMKYQHFSHDATRPRLRMNNEMALSEIL

SEQ ID NO: 28882 - protein, 32 aa, Diabrotica virgifera
  misc_feature: Coding regions on vcDNA: vcDNA=SeqID_8579; Strand=-; Position=2-97
IVYSANVFSLLIFDILLKEIFPRPRVTIFIRC

SEQ ID NO: 28883 - protein, 69 aa, Diabrotica virgifera
  misc_feature: Coding regions on vcDNA: vcDNA=SeqID_8580; Strand=-; Position=201-410
TVCFLNSHSVVKGMSLRNIQSYSRGLKPFHLQGLVMYSPLSSLLCVNVMITCRFPSSYTPGTCLFVREG

SEQ ID NO: 28884 - protein, 54 aa, Diabrotica virgifera
  misc_feature: Coding regions on vcDNA: vcDNA=SeqID_8581; Strand=-; Position=336-500
LKLCKKYNSNTILRIALQKIGNIHNHKCLFIINSFGQSTGYKTNIEPGSCTKTG

SEQ ID NO: 28885 - protein, 79 aa, Diabrotica virgifera
  misc_feature: Coding regions on vcDNA: vcDNA=SeqID_8582; Strand=-; Position=1-237
  misc_feature (3)..(14): Xaa can be any naturally occurring amino acid
  misc_feature (16)..(26): Xaa can be any naturally occurring amino acid
  misc_feature (36)..(43): Xaa can be any naturally occurring amino acid
  misc_feature (46)..(58): Xaa can be any naturally occurring amino acid
  misc_feature (65)..(77): Xaa can be any naturally occurring amino acid
ILXXXXXXXXXXXXFXXXXXXXXXXXTQPGSHRLNXXXXXXXXRTXXXXXXXXXXXXXIQHRGRXXXXXXXXXXXXXLL

SEQ ID NO: 28886 - protein, 62 aa, Diabrotica virgifera
  misc_feature: Coding regions on vcDNA: vcDNA=SeqID_8583; Strand=+; Position=198-386
FMMSLMVTELLTQNFHVSERIDVNKISIISITYLNKKFARQSDILYAGDNRNVSVTKEDTKS

SEQ ID NO: 28887 - protein, 31 aa, Diabrotica virgifera
  misc_feature: Coding regions on vcDNA: vcDNA=SeqID_8584; Strand=-; Position=36-131
FNSERFLYMVIKHSFLYVDELTSCIRMSTHK

SEQ ID NO: 28888 - protein, 30 aa, Diabrotica virgifera
  misc_feature: Coding regions on vcDNA: vcDNA=SeqID_8585; Strand=-; Position=2-91
  misc_feature (4)..(29): Xaa can be any naturally occurring amino acid
YINXXXXXXXXXXXXXXXXXXXXXXXXXXL

SEQ ID NO: 28889 - protein, 98 aa, Diabrotica virgifera
  misc_feature: Coding regions on vcDNA: vcDNA=SeqID_8586; Strand=+; Position=114-411
  misc_feature: Homolog annotation: Hit_ID=AAV34812.1; Match level="QueryCoverage =84%, HitCoverage=20%, E-value=1e-20, Identity=61%"; Hit description =ribosomal protein L3 [Bombyx mori]
  misc_feature: Gene Ontology Annotation: Molecular function=structural constituent of ribosome; Cellular component=cytosolic ribosome (sensu Eukarya); Biological process=protein biosynthesis
  misc_feature (27)..(27): Xaa can be any naturally occurring amino acid
  misc_feature (42)..(42): Xaa can be any naturally occurring amino acid
  misc_feature (66)..(66): Xaa can be any naturally occurring amino acid
  misc_feature (70)..(70): Xaa can be any naturally occurring amino acid
QLTISFYLSSLTGLIGYKVGMTHVLRXVDRPGSKMNKKEIVXVVIILETPTMVIDGVDVYIETPHXLNAXHTDCYEDVMENCIRYFYTIWYYCLIYGI

SEQ ID NO: 28890 - protein, 207 aa, Diabrotica virgifera
  misc_feature: Coding regions on vcDNA: vcDNA=SeqID_8587; Strand=+; Position=3-626
  misc_feature (1)..(169): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIRKITLGITAPFNLRVQIKKRMRPRCWIKVKIGDATIY

SEQ ID NO: 28891 - protein, 153 aa, Diabrotica virgifera
  misc_feature: Coding regions on vcDNA: vcDNA=SeqID_8588; Strand=+; Position=50-508
  misc_feature: Homolog annotation: Hit_ID=XP_325646.1; Match level="QueryCoverage =82%, HitCoverage=15%, E-value=1e-08, Identity=33%"; Hit description =hypothetical protein [Neurospora crassa] gb|EAA30815.1| hypothetical protein [Neurospora crassa]
RDTDRPAETTQKEKAKEKRREGEPNNGDQQGAAANAQQTTQPQNAPAQPQQQHYHQTEAEQQQAIPHTQTSNKDATAGAAPGQKDTNAPQTAKQQEQDPKQTKRTATPTTAPTKQTTTKARRNRRRDNKPQATTTPRPTKPNNQPKPTTDPNP

SEQ ID NO: 28892 - protein, 66 aa, Diabrotica virgifera
  misc_feature: Coding regions on vcDNA: vcDNA=SeqID_8589; Strand=-; Position=1-198
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
FXXXXXXXXXXXNQPGSHRFKXXXXXXXXXEXXXXXXXXXXXXXXSNIEVAIFIIDLNSPNKITLL

SEQ ID NO: 28893 - protein, 60 aa, Diabrotica virgifera
  misc_feature: Coding regions on vcDNA: vcDNA=SeqID_8590; Strand=+; Position=146-328
  misc_feature (25)..(32): Xaa can be any naturally occurring amino acid
  misc_feature (50)..(57): Xaa can be any naturally occurring amino acid
IYHSRSFTTSRIISCYQEEKTLNNXXXXXXXXDSCISSTLRNTVNLFIIXXXXXXXXYID

SEQ ID NO: 28894 - protein, 117 aa, Diabrotica virgifera
  misc_feature: Coding regions on vcDNA: vcDNA=SeqID_8591; Strand=+; Position=26-379
  misc_feature: Homolog annotation: Hit_ID=NP_647668.1; Match level="QueryCoverage =99%, HitCoverage=56%, E-value=1e-23, Identity=52%"; Hit description =CG1919-PA [Drosophila melanogaster] gb|AAF47580.1| CG1919-PA [Drosophila melanogaster]
  misc_feature: Gene Ontology Annotation: Molecular function=structural constituent of eye lens
  misc_feature: Pfam annotation: Pfam_ID=Chitin_bind_4; Match level="Score=68.3, E -value=2.2e-17, Copies=1"; Pfam description=Insect cuticle protein
MFTKIVALTTLVACASAGFLGGLSGHGYGGGHGLALGAVSVAHVAPVAIAHAQPSHESVDYYAYPKYEFNYGVADGHTGDHKSQKEVRDGDVVKGSYTVAEPDGTLRTVHYTADGYH

SEQ ID NO: 28895 - protein, 221 aa, Diabrotica virgifera
  misc_feature: Coding regions on vcDNA: vcDNA=SeqID_8592; Strand=+; Position=85-747
  misc_feature: Homolog annotation: Hit_ID=BAC76666.1; Match level="QueryCoverage =97%, HitCoverage=61%, E-value=1e-37, Identity=41%"; Hit description =cytochrome oxidase subunit 1 [Cychrus businskyorum]
  misc_feature (75)..(75): Xaa can be any naturally occurring amino acid
  misc_feature (87)..(87): Xaa can be any naturally occurring amino acid
  misc_feature (117)..(117): Xaa can be any naturally occurring amino acid
  misc_feature (146)..(146): Xaa can be any naturally occurring amino acid
  misc_feature (162)..(162): Xaa can be any naturally occurring amino acid
  misc_feature (179)..(185): Xaa can be any naturally occurring amino acid
  misc_feature (196)..(196): Xaa can be any naturally occurring amino acid
LLRSLSLLGYDPSNIVIVISLVYIILYVITVPIVTLDIVNRVDPLIIVAPDISCPPPNKIIYRSVPPSPLSSVLXKDMIWVFCDHLXIYPPLTSDIAIVCPSLYSLIPKLLLSGIYXIPCVNTFITTVIFIRSIYIIFDLIPLYVXAVAITVILLLSAIPVXDGAITILLPDLNINTSXXXXXXXGDPILYQHLFXYVGRPAVYIIILPGFVLVSHIVRQE

SEQ ID NO: 28896 - protein, 165 aa, Diabrotica virgifera
  misc_feature: Coding regions on vcDNA: vcDNA=SeqID_8593; Strand=+; Position=53-547
  misc_feature: Homolog annotation: Hit_ID=AAR91450.1; Match level="QueryCoverage =99%, HitCoverage=96%, E-value=6e-10, Identity=27%"; Hit description =NADH dehydrogenase subunit 6 [Drosophila simulans] gb|AAR91437.1| NADH dehydrogenase subunit 6 [Drosophila
  misc_feature (12)..(19): Xaa can be any naturally occurring amino acid
  misc_feature (47)..(47): Xaa can be any naturally occurring amino acid
  misc_feature (49)..(56): Xaa can be any naturally occurring amino acid
  misc_feature (72)..(94): Xaa can be any naturally occurring amino acid
  misc_feature (101)..(113): Xaa can be any naturally occurring amino acid
  misc_feature (117)..(134): Xaa can be any naturally occurring amino acid
  misc_feature (139)..(149): Xaa can be any naturally occurring amino acid
LISLISLISDIXXXXXXXXHPLTCGLILLIQTIFTSVITGLINYNYXFXXXXXXXXVGGILILFIYITRIAXXXXXXXXXXXXXXXXXXXXXXXILRFILXXXXXXXXXXXXXMNNXXXXXXXXXXXXXXXXXXNNLIXXXXXXXXXXXLIAVVKITKFLYGPLR

SEQ ID NO: 28897 - protein, 205 aa, Diabrotica virgifera
  misc_feature: Coding regions on vcDNA: vcDNA=SeqID_8594; Strand=+; Position=161-779
  misc_feature: Homolog annotation: Hit_ID=NP_652626.1; Match level="QueryCoverage =98%, HitCoverage=38%, E-value=1e-26, Identity=32%"; Hit description =CG18578-PA [Drosophila melanogaster] gb|AAF54591.1| CG18578-PA [Drosophila melanogaster]
  misc_feature (134)..(134): Xaa can be any naturally occurring amino acid
MKALICTVHNYNVLIISPMVSSSHFYLGNALGRGLVEAGHQVTVVSPYEDKNPLKGYKDVVLTGLAQQKRDISPLDFYHMDPFSISSHFADVGTGIVNNIFNHPNFKNLINSNEKFDVLIIQYFRSDALNIFTXHYNAPLIVFSIVVPGFWVNPIVGSPLEPSYFPDFFVKYSSNMNFWERTVNSLLLLFNYVHKHLYFIPNKKS

SEQ ID NO: 28898 - protein, 183 aa, Diabrotica virgifera
  misc_feature: Coding regions on vcDNA: vcDNA=SeqID_8595; Strand=+; Position=278-826
  misc_feature: Homolog annotation: Hit_ID=XP_395718.1; Match level="QueryCoverage =100%, HitCoverage=7%, E-value=6e-50, Identity=61%"; Hit description =similar to fetal Alzheimer antigen isoform 1; bromodomain and PHD domain transcription
  misc_feature: Pfam annotation: Pfam_ID=AT_hook; Match level="Score=15.3, E-value =0.045, Copies=1"; Pfam description=AT hook motif
  misc_feature (160)..(160): Xaa can be any naturally occurring amino acid
MSTRGMKKRGRPPKVQVAERTKKFQIHLLKKPKYLLNYKGPDSQSSTPTASRASSPHESESSRRSSNRIRGKDGHRAGRKSGYAGSVYQRRGYNTAPNDYHESEYHYGSDFGDDSSENKSDIEDEMGLSESESEGSVPDRGSDSDFSLSGYSTVSGTPRXCYSLNRAPTPDPPLWLQNREIPP

SEQ ID NO: 28899 - protein, 108 aa, Diabrotica virgifera; identical to SEQ ID NO: 27732
  misc_feature: Coding regions on vcDNA: vcDNA=SeqID_8596; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 28900 - protein, 45 aa, Diabrotica virgifera
  misc_feature: Coding regions on vcDNA: vcDNA=SeqID_8597; Strand=-; Position=1-135
  misc_feature (2)..(10): Xaa can be any naturally occurring amino acid
  misc_feature (13)..(42): Xaa can be any naturally occurring amino acid
YXXXXXXXXXSIXXXXXXXXXXXXXXXXXXXXXXXXXXXXXXHFQ

SEQ ID NO: 28901 - protein, 82 aa, Diabrotica virgifera
  misc_feature: Coding regions on vcDNA: vcDNA=SeqID_8598; Strand=-; Position=0-245
  misc_feature (3)..(50): Xaa can be any naturally occurring amino acid
  misc_feature (52)..(77): Xaa can be any naturally occurring amino acid
KKXXXXXXXXXXXXXXXXXXXXXXXXXXXXXXXXXXXXXXXXXXXXXXXXSXXXXXXXXXXXXXXXXXXXXXXXXXXPFHPA

SEQ ID NO: 28902 - protein, 138 aa, Diabrotica virgifera
  misc_feature: Coding regions on vcDNA: vcDNA=SeqID_8599; Strand=-; Position=1-414
  misc_feature (2)..(10): Xaa can be any naturally occurring amino acid
  misc_feature (28)..(55): Xaa can be any naturally occurring amino acid
  misc_feature (57)..(111): Xaa can be any naturally occurring amino acid
  misc_feature (115)..(138): Xaa can be any naturally occurring amino acid
PXXXXXXXXXQMGSLKKLYKNLYKPLLXXXXXXXXXXXXXXXXXXXXXXXXXXXXHXXXXXXXXXXXXXXXXXXXXXXXXXXXXXXXXXXXXXXXXXXXXXXXXXXXXXXXALLXXXXXXXXXXXXXXXXXXXXXXXX

SEQ ID NO: 28903 - protein, 118 aa, Diabrotica virgifera
  misc_feature: Coding regions on vcDNA: vcDNA=SeqID_8600; Strand=+; Position=458-814
  misc_feature: Homolog annotation: Hit_ID=XP_485924.1; Match level="QueryCoverage =76%, HitCoverage=44%, E-value=6e-14, Identity=38%"; Hit description =similar to Zinc finger protein 267 (Zinc finger protein HZF2) [Mus musculus]
  misc_feature: Gene Ontology Annotation: Molecular function=transcription co -repressor activity; Cellular component=nucleus; Biological process =regulation of transcription, DNA-dependent
  misc_feature: Pfam annotation: Pfam_ID=zf-C2H2; Match level="Score=30.4, E-value =5.3e-06, Copies=1"; Pfam description=Zinc finger, C2H2 type
  misc_feature (77)..(84): Xaa can be any naturally occurring amino acid
  misc_feature (103)..(110): Xaa can be any naturally occurring amino acid
MQDFLQDKMGIKKATTEHSPHKGTCMNPHAEGKTSTKNLKVVTGKRPYKCDICYKQFRDGSKLKTHLRVHTGIKPYXXXXXXXXFNRANQLKAHLRVHPGRKXXXXXXXXMKLMEQKV

SEQ ID NO: 28904 - protein, 57 aa, Diabrotica virgifera
  misc_feature: Coding regions on vcDNA: vcDNA=SeqID_8601; Strand=-; Position=0-170
KIRNAMCYKRRMRKVLRLAHRGYCTNLTTSITSVVKQYPLWASLRGYCFTTSITSVV

SEQ ID NO: 28905 - protein, 66 aa, Diabrotica virgifera
  misc_feature: Coding regions on vcDNA: vcDNA=SeqID_8602; Strand=+; Position=280-477
RRTRRRGRGPDKSNRMMTLFIVSDVKTRALSLEDYLSANPRAPLRTFQFAFSLSRWTMRLTRQDVP

SEQ ID NO: 28906 - protein, 81 aa, Diabrotica virgifera
  misc_feature: Coding regions on vcDNA: vcDNA=SeqID_8603; Strand=-; Position=146-391
SVTLRCVARSQRTNSSGRGPISALRSVALRRRNGTTHRKAHRCVAMCCVDPTIHRIDGRCGIPLLHIVLLRHPSNQFPLYT

SEQ ID NO: 28907 - protein, 64 aa, Diabrotica virgifera
  misc_feature: Coding regions on vcDNA: vcDNA=SeqID_8604; Strand=+; Position=466-660
HNSIGGELKRIDLLTRKDITNIKLPYGIDLKDGYMYHDDATSVYFWVECLQTYVQYYFTNNRAY

SEQ ID NO: 28908 - protein, 21 aa, Diabrotica virgifera
  misc_feature: Coding regions on vcDNA: vcDNA=SeqID_8605; Strand=-; Position=0-62
  misc_feature (1)..(13): Xaa can be any naturally occurring amino acid
  misc_feature (15)..(20): Xaa can be any naturally occurring amino acid
XXXXXXXXXXXXXLXXXXXXA

SEQ ID NO: 28909 - protein, 233 aa, Diabrotica virgifera
  misc_feature: Coding regions on vcDNA: vcDNA=SeqID_8606; Strand=+; Position=156-857
  misc_feature (55)..(230): Xaa can be any naturally occurring amino acid
ISNIPISNNYDSTCVISIRFVKSYRIGQNFMLSYVSTHRRTVLYTLNIKKSFLNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMIY

SEQ ID NO: 28910 - protein, 35 aa, Diabrotica virgifera
  misc_feature: Coding regions on vcDNA: vcDNA=SeqID_8607; Strand=-; Position=1-105
  misc_feature (1)..(35): Xaa can be any naturally occurring amino acid
XXXXXXXXXXXXXXXXXXXXXXXXXXXXXXXXXXX

SEQ ID NO: 28911 - protein, 77 aa, Diabrotica virgifera
  misc_feature: Coding regions on vcDNA: vcDNA=SeqID_8608; Strand=+; Position=55-288
KTYFKQFKKGIKKVVRYFKFSWYSENPWLCGWKKNRPYCWPCLLVSTKKWVDQVHGLNSFRVLKKRHEISPLPTCKM

SEQ ID NO: 28912 - protein, 51 aa, Diabrotica virgifera
  misc_feature: Coding regions on vcDNA: vcDNA=SeqID_8609; Strand=-; Position=149-304
DGRHYTVMCGGAGKKGRAFILESHYSLICLVISRKITIINPAVNKYKLLIS

SEQ ID NO: 28913 - protein, 59 aa, Diabrotica virgifera
  misc_feature: Coding regions on vcDNA: vcDNA=SeqID_8610; Strand=-; Position=73-252
SPVLAHLNPLHQYLPHVSAVFTICQSLLTGPYPAPARYQPSIQSTFCFVIRNICWLYQN

SEQ ID NO: 28914 - protein, 57 aa, Diabrotica virgifera
  misc_feature: Coding regions on vcDNA: vcDNA=SeqID_8611; Strand=+; Position=136-309
STSALGIVSYYWLKFIRPDIHLCPRRRSGRMIVVSCLIKIDSLDVETRNRSRKEKHY

SEQ ID NO: 28915 - protein, 79 aa, Diabrotica virgifera
  misc_feature: Coding regions on vcDNA: vcDNA=SeqID_8612; Strand=+; Position=311-550
  misc_feature (6)..(11): Xaa can be any naturally occurring amino acid
IGKGSXXXXXXIKLHYNSSISKNVCHFYSVAMRRAKECYFSLGIRSIISSTLNQRFSTLVGVSSKRTYDCCYLLKVTKP

SEQ ID NO: 28916 - protein, 50 aa, Diabrotica virgifera
  misc_feature: Coding regions on vcDNA: vcDNA=SeqID_8613; Strand=-; Position=5-157
  misc_feature (3)..(10): Xaa can be any naturally occurring amino acid
  misc_feature (21)..(21): Xaa can be any naturally occurring amino acid
  misc_feature (39)..(39): Xaa can be any naturally occurring amino acid
FKXXXXXXXXSNRLNKYSCYXNYKLKSNIEVGNLIYRLXLSNKITLLSLR

SEQ ID NO: 28917 - protein, 171 aa, Diabrotica virgifera; identical to SEQ ID NO: 27583
  misc_feature: Coding regions on vcDNA: vcDNA=SeqID_8614; Strand=-; Position=3-518
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(166): Xaa can be any naturally occurring amino acid

SEQ ID NO: 28918 - protein, 125 aa, Diabrotica virgifera
  misc_feature: Coding regions on vcDNA: vcDNA=SeqID_8615; Strand=-; Position=1-375
  misc_feature (12)..(19): Xaa can be any naturally occurring amino acid
  misc_feature (25)..(106): Xaa can be any naturally occurring amino acid
  misc_feature (108)..(115): Xaa can be any naturally occurring amino acid
SITQLIVKKVFXXXXXXXXVFSFCXXXXXXXXXXXXXXXXXXXXXXXXXXXXXXXXXXXXXXXXXXXXXXXXXXXXXXXXXXXXXXXXXXXXXXXXXXXXXXXXXXTXXXXXXXXIILSYYIIIY

SEQ ID NO: 28919 - protein, 76 aa, Diabrotica virgifera
  misc_feature: Coding regions on vcDNA: vcDNA=SeqID_8616; Strand=+; Position=139-369
VLFNDSFSQLYVSDPSLLLVLILPRYLFSPGCHFMTSLGIHSSSFLMLCTNKLSCFINIRYMYVHLIPNISLLPSL

SEQ ID NO: 28920 - protein, 76 aa, Diabrotica virgifera
  misc_feature: Coding regions on vcDNA: vcDNA=SeqID_8617; Strand=-; Position=0-227
  misc_feature (3)..(74): Xaa can be any naturally occurring amino acid
NKXXXXXXXXXXXXXXXXXXXXXXXXXXXXXXXXXXXXXXXXXXXXXXXXXXXXXXXXXXXXXXXXXXXXXXXXAA

SEQ ID NO: 28921 - protein, 145 aa, Diabrotica virgifera
  misc_feature: Coding regions on vcDNA: vcDNA=SeqID_8618; Strand=+; Position=21-459
  misc_feature: Homolog annotation: Hit_ID=CAH04327.1; Match level="QueryCoverage =95%, HitCoverage=98%, E-value=6e-27, Identity=48%"; Hit description =S12e ribosomal protein [Curculio glandium]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_L7Ae; Match level="Score=30.5, E -value=5.2e-06, Copies=1"; Pfam description=Ribosomal protein L7Ae/L30e/S12e/Gadd4
  misc_feature (20)..(20): Xaa can be any naturally occurring amino acid
  misc_feature (59)..(59): Xaa can be any naturally occurring amino acid
  misc_feature (94)..(94): Xaa can be any naturally occurring amino acid
MTDNKADDAPPDPPPHPGGXMDVTLALQQALQKALIPDVIHHGLHDAAKDVDKRQDKLXVLVEECDEPMDKTLYSTLCSEQRTHLIIAHNNEKXSERSGECKIENTVEEPEDAGCACVCTRDYVKESPDQYALIDDLKNDNKSDT

SEQ ID NO: 28922 - protein, 65 aa, Diabrotica virgifera
  misc_feature: Coding regions on vcDNA: vcDNA=SeqID_8619; Strand=-; Position=2-196
  misc_feature (34)..(34): Xaa can be any naturally occurring amino acid
  misc_feature (36)..(36): Xaa can be any naturally occurring amino acid
  misc_feature (38)..(38): Xaa can be any naturally occurring amino acid
ISRLSHKIVRQVKFSGFDVWHYRNPHHPIVFSTXSXYXSSASSASLSSSSPSSKNTTTMSTRTTM

SEQ ID NO: 28923 - protein, 75 aa, Diabrotica virgifera
  misc_feature: Coding regions on vcDNA: vcDNA=SeqID_8620; Strand=+; Position=1-228
PCGHRPRNPRDPLFAPEIFNYTNFIISSDKDYCDSRVRKSNLCNSQQLFTTKHKIPAKISLSSDSLYLNPTIQPF

SEQ ID NO: 28924 - protein, 284 aa, Diabrotica virgifera
  misc_feature: Coding regions on vcDNA: vcDNA=SeqID_8621; Strand=+; Position=49-900
  misc_feature: Homolog annotation: Hit_ID=EAA43038.2; Match level="QueryCoverage =88%, HitCoverage=58%, E-value=1e-120, Identity=82%"; Hit description= ENSANGP00000024470 [Anopheles gambiae str. PEST] ref|XP_550677.1| ENSANGP00000024470 [Anopheles gambiae s
  misc_feature: Gene Ontology Annotation: Molecular function=non-membrane spanning protein tyrosine kinase activity; Cellular component=nucleus; Biological process=circadian rhythm
  misc_feature: Pfam annotation: Pfam_ID=Pkinase; Match level="Score=-91.4, E-value =0.0032, Copies=1"; Pfam description=Protein kinase domain
  misc_feature (177)..(182): Xaa can be any naturally occurring amino acid
MAWHKHEHVMLMDKNKPKMPVAPGGGGDMSLSQRRHVPLYGRLVAEDTLGIPPMANSSSTDIQAMQARIPPTFRDSSSAPLRKLSVDLIKTYKHINEVYYAKKKRRAAQIQGEDSSHKKERKIYNDGYDDDNHDYIVKNGEKFLERYEIDSLIGKGSFGQVVKAFDHVEQCQVAIKXXXXXXPFLNQAQIEVKLLEMMNRADVENKYYIVKLKRHFMWRNHLCLVFELLSYNLYDLLRNTNFRGVSLNLTRKFAQQLCTALLFLSTPELNIIHCDLKPENILLC

SEQ ID NO: 28925 - protein, 44 aa, Diabrotica virgifera
  misc_feature: Coding regions on vcDNA: vcDNA=SeqID_8622; Strand=-; Position=77-211
  misc_feature (2)..(10): Xaa can be any naturally occurring amino acid
  misc_feature (26)..(26): Xaa can be any naturally occurring amino acid
  misc_feature (33)..(40): Xaa can be any naturally occurring amino acid
  misc_feature (43)..(43): Xaa can be any naturally occurring amino acid
LXXXXXXXXXDRNQLGSHRFKLRSCXNLKVDRXXXXXXXXNYXL

SEQ ID NO: 28926 - protein, 73 aa, Diabrotica virgifera
  misc_feature: Coding regions on vcDNA: vcDNA=SeqID_8623; Strand=-; Position=1-219
  misc_feature (4)..(13): Xaa can be any naturally occurring amino acid
  misc_feature (24)..(31): Xaa can be any naturally occurring amino acid
  misc_feature (35)..(43): Xaa can be any naturally occurring amino acid
  misc_feature (48)..(48): Xaa can be any naturally occurring amino acid
SFWXXXXXXXXXXKPNWLPTVLNXXXXXXXXVDRXXXXXXXXXYKLNXTSRSQSYYRFDSPIKLRCIPKGNLF

SEQ ID NO: 28927 - protein, 37 aa, Diabrotica virgifera
  misc_feature: Coding regions on vcDNA: vcDNA=SeqID_8624; Strand=-; Position=60-173
  misc_feature (1)..(10): Xaa can be any naturally occurring amino acid
XXXXXXXXXXLLRFLTTSELEKYKLCNSKMTMGNNYL

SEQ ID NO: 28928 - protein, 35 aa, Diabrotica virgifera
  misc_feature: Coding regions on vcDNA: vcDNA=SeqID_8625; Strand=-; Position=1-105
  misc_feature (7)..(35): Xaa can be any naturally occurring amino acid
SVGSVRXXXXXXXXXXXXXXXXXXXXXXXXXXXXX

SEQ ID NO: 28929 - protein, 106 aa, Diabrotica virgifera
  misc_feature: Coding regions on vcDNA: vcDNA=SeqID_8626; Strand=+; Position=51-371
  misc_feature (1)..(8): Xaa can be any naturally occurring amino acid
  misc_feature (15)..(23): Xaa can be any naturally occurring amino acid
  misc_feature (46)..(54): Xaa can be any naturally occurring amino acid
XXXXXXXXKWETKRXXXXXXXXXAYLVEHLLLLRHLNYYCVGIDNXXXXXXXXXAPESDKGFIHKCMSTRLAVASSSTDKLQLLLLKCIYNPLFIHPNNRVAIGLS

SEQ ID NO: 28930 - protein, 89 aa, Diabrotica virgifera
  misc_feature: Coding regions on vcDNA: vcDNA=SeqID_8627; Strand=+; Position=41-310
SVCISVVPTTLETPGAPFADLGNQVLRESVRVACLCIATSRGAPVVHLHRLNAESHRSSGRLRPLQWPWPRRHPVNSDGIFVFGDAKGP

SEQ ID NO: 28931 - protein, 66 aa, Diabrotica virgifera; identical to SEQ ID NO: 26808
  misc_feature: Coding regions on vcDNA: vcDNA=SeqID_8628; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28932 - protein, 45 aa, Diabrotica virgifera
  misc_feature: Coding regions on vcDNA: vcDNA=SeqID_8629; Strand=-; Position=1-135
  misc_feature (1)..(45): Xaa can be any naturally occurring amino acid
XXXXXXXXXXXXXXXXXXXXXXXXXXXXXXXXXXXXXXXXXXXXX

SEQ ID NO: 28933 - protein, 56 aa, Diabrotica virgifera
  misc_feature: Coding regions on vcDNA: vcDNA=SeqID_8630; Strand=-; Position=582-752
NALCFDAFDIYHQTSPTLRFLANGVTTSPHVFRTAAILRLLHCYLGLTQDNVETIP

SEQ ID NO: 28934 - protein, 268 aa, Diabrotica virgifera
  misc_feature: Coding regions on vcDNA: vcDNA=SeqID_8631; Strand=+; Position=2-808
  misc_feature: Homolog annotation: Hit_ID=XP_308705.1; Match level="QueryCoverage =95%, HitCoverage=94%, E-value=4e-25, Identity=29%"; Hit description =ENSANGP00000021415 [Anopheles gambiae]
  misc_feature: Gene Ontology Annotation: Molecular function=G-protein coupled receptor activity; Cellular component=integral to membrane; Biological process=G-protein coupled receptor protein signaling pathway
  misc_feature: Pfam annotation: Pfam_ID=LRR_1; Match level="Score=97.9, E-value=2.5e- 26, Copies=7"; Pfam description=Leucine Rich Repeat
TCARTTAVTTCSQVRLSKTIPLLIDDYKNILSISLDEHTDTIYSNVFKRLAELKRLYLSNNKIKSLESGSFDGLSKLEELSLYNNLLTTVVSGTFRDLHNLKILNLGSNKITSIPNNAFLGLDNLEEINLSFNQLAEIPVQINTIKSLRSLHMNSNKLKSLKANSFRNLNKLETLNLHDNIIDSLEAKSFAGLRNLKQLSLKSNYLKQFNTQDVLEDLGSLQILSLAINDLKCADLRNIDRELKRKRVDFEAGINKQNPNTYRGICTN

SEQ ID NO: 28935 - protein, 53 aa, Diabrotica virgifera
  misc_feature: Coding regions on vcDNA: vcDNA=SeqID_8632; Strand=-; Position=1-159
  misc_feature (7)..(17): Xaa can be any naturally occurring amino acid
  misc_feature (20)..(31): Xaa can be any naturally occurring amino acid
  misc_feature (33)..(53): Xaa can be any naturally occurring amino acid
KKFMSDXXXXXXXXXXXYHXXXXXXXXXXXXIXXXXXXXXXXXXXXXXXXXXX

SEQ ID NO: 28936 - protein, 40 aa, Diabrotica virgifera
  misc_feature: Coding regions on vcDNA: vcDNA=SeqID_8633; Strand=-; Position=0-119
  misc_feature (1)..(37): Xaa can be any naturally occurring amino acid
XXXXXXXXXXXXXXXXXXXXXXXXXXXXXXXXXXXXXFLL

SEQ ID NO: 28937 - protein, 32 aa, Diabrotica virgifera
  misc_feature: Coding regions on vcDNA: vcDNA=SeqID_8634; Strand=-; Position=1-96
  misc_feature (4)..(32): Xaa can be any naturally occurring amino acid
VIQXXXXXXXXXXXXXXXXXXXXXXXXXXXXX

SEQ ID NO: 28938 - protein, 42 aa, Diabrotica virgifera
  misc_feature: Coding regions on vcDNA: vcDNA=SeqID_8635; Strand=-; Position=2-127
  misc_feature (2)..(25): Xaa can be any naturally occurring amino acid
  misc_feature (29)..(37): Xaa can be any naturally occurring amino acid
NXXXXXXXXXXXXXXXXXXXXXXXXLKNXXXXXXXXXGGFSS

SEQ ID NO: 28939 - protein, 75 aa, Diabrotica virgifera
  misc_feature: Coding regions on vcDNA: vcDNA=SeqID_8636; Strand=+; Position=215-442
DKYVNIRSSANFKLKLTSRWRRYPRIGAVDPISVIKFLTVTFKNICVQLRLCKFRSYGGTKSQNTARVLLKPLLY

SEQ ID NO: 28940 - protein, 281 aa, Diabrotica virgifera
  misc_feature: Coding regions on vcDNA: vcDNA=SeqID_8637; Strand=+; Position=104-945
  misc_feature: Homolog annotation: Hit_ID=XP_394564.1; Match level="QueryCoverage =96%, HitCoverage=44%, E-value=4e-58, Identity=43%"; Hit description =similar to CG1550-PA [Apis mellifera]
  misc_feature (222)..(222): Xaa can be any naturally occurring amino acid
  misc_feature (224)..(224): Xaa can be any naturally occurring amino acid
  misc_feature (235)..(235): Xaa can be any naturally occurring amino acid
  misc_feature (250)..(250): Xaa can be any naturally occurring amino acid
  misc_feature (266)..(266): Xaa can be any naturally occurring amino acid
MGHDSEITAFLNFHKDQLMRSGVPEHLWKSLYKKLVKQTFDASSTFDLLKIERDDDEDDVIRSRLLLQASKDIKLSDPDHIYLIDHAWTYKVQDAKKQLVAHDALRERLCNVFDIDITQDKYEIADSLFEHMWKINNYYCISNNENVEDRLPIWYIMDEVGIAVIHSDDPNCRIVPFVYVNDQITYSILFPIKDIQKEDIICRDFGEGITDKGRRDAFLVPXVXKLFDDDVTQSXPSEGYFLSGHIKESXPDLSKLENNTQHGNVXEVFSQYSLVNMYVTD

SEQ ID NO: 28941 - protein, 108 aa, Diabrotica virgifera; identical to SEQ ID NO: 27732
  misc_feature: Coding regions on vcDNA: vcDNA=SeqID_8638; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 28942 - protein, 66 aa, Diabrotica virgifera; identical to SEQ ID NO: 26808
  misc_feature: Coding regions on vcDNA: vcDNA=SeqID_8639; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 28943 - protein, 76 aa, Diabrotica virgifera
  misc_feature: Coding regions on vcDNA: vcDNA=SeqID_8640; Strand=-; Position=41-271
SRERWFGSIRVARVHRNSQNHTEYNRYSCTSNRKKCSIFTNSFIAWVAPTRFSGVPNKARTIVSKDLPKLLTQILG

SEQ ID NO: 28944 - protein, 59 aa, Diabrotica virgifera
  misc_feature: Coding regions on vcDNA: vcDNA=SeqID_8641; Strand=+; Position=6-182
YVELVNHGVMNMLKFEIPCHITYLMRNNVIDIVQATRATLRTLQFTSEAIRMVTGSVYL

SEQ ID NO: 28945 - protein, 27 aa, Diabrotica virgifera
  misc_feature: Coding regions on vcDNA: vcDNA=SeqID_8642; Strand=-; Position=1-84
  misc_feature (2)..(26): Xaa can be any naturally occurring amino acid
PXXXXXXXXXXXXXXXXXXXXXXXXXL

SEQ ID NO: 28946 - protein, 59 aa, Diabrotica virgifera
  misc_feature: Coding regions on vcDNA: vcDNA=SeqID_8643; Strand=-; Position=15-194
RNTTVSISQPLLVILCIILKIPKVLNYQFFGLLVRDVYLNNSKISIRISRHANIHNTIR

SEQ ID NO: 28947 - protein, 115 aa, Diabrotica virgifera
  misc_feature: Coding regions on vcDNA: vcDNA=SeqID_8644; Strand=-; Position=867-1214
  misc_feature (23)..(45): Xaa can be any naturally occurring amino acid
  misc_feature (47)..(59): Xaa can be any naturally occurring amino acid
  misc_feature (65)..(74): Xaa can be any naturally occurring amino acid
  misc_feature (76)..(91): Xaa can be any naturally occurring amino acid
FWWGEKYLGEGEEIFPLTKIFSXXXXXXXXXXXXXXXXXXXXXXXPXXXXXXXXXXXXXTSFLIXXXXXXXXXXPXXXXXXXXXXXXXXXXPGSSKNKKLVGNQSLQELPPVFIS

SEQ ID NO: 28948 - protein, 139 aa, Diabrotica virgifera
  misc_feature: Coding regions on vcDNA: vcDNA=SeqID_8645; Strand=+; Position=151-570
  misc_feature: Homolog annotation: Hit_ID=NP_060943.1; Match level="QueryCoverage =94%, HitCoverage=93%, E-value=4e-29, Identity=49%"; Hit description =thioesterase superfamily member 2 [Homo sapiens] emb|CAD92509.1| thioesterase superfamily member 2
  misc_feature: Pfam annotation: Pfam_ID=4HBT; Match level="Score=56.3, E-value=8.7e -14, Copies=1"; Pfam description=Thioesterase superfamily
LCKFEVKHLMSMLKDTKAFEQCLKTLNIVSMEHGKCIAEMKVLEEHTNPLGTLHGGLSATLVDSVSSYGLFTHEKGAVKSVSVNINVSYMGGAKLGEEIVIESNTLRVGKTLAFCEVLIKNKANGNVLVKGEHTKYLMR

SEQ ID NO: 28949 - protein, 23 aa, Diabrotica virgifera
  misc_feature: Coding regions on vcDNA: vcDNA=SeqID_8646; Strand=-; Position=0-68
  misc_feature (3)..(20): Xaa can be any naturally occurring amino acid
FNXXXXXXXXXXXXXXXXXXALR

SEQ ID NO: 28950 - protein, 206 aa, Diabrotica virgifera
  misc_feature: Coding regions on vcDNA: vcDNA=SeqID_8647; Strand=+; Position=12-629
  misc_feature: Homolog annotation: Hit_ID=AAN08764.1; Match level="QueryCoverage =96%, HitCoverage=79%, E-value=2e-41, Identity=52%"; Hit description =elongation factor 1-alpha [Tanysphyrus lemnae]
  misc_feature (118)..(118): Xaa can be any naturally occurring amino acid
  misc_feature (152)..(152): Xaa can be any naturally occurring amino acid
  misc_feature (157)..(157): Xaa can be any naturally occurring amino acid
WTYYLHLVLSTLMAARERVITIEIALWEFSTPIYYVTIFDAPSAHRYLYKHDLCDISRCTVLCSFVAPVTREFETRISQKWHTREHALLAFSLVVKHLIVVVTTMCSPEPPYTESRFXKISKEESSHISKIVYTPPVAALSPLSRCDADTMXKDLTXMPCVSGCDISRIEREAVRECVSEALYAILLPSLPPVKPLSLLLPDVYTI

SEQ ID NO: 28951 - protein, 89 aa, Diabrotica virgifera
  misc_feature: Coding regions on vcDNA: vcDNA=SeqID_8648; Strand=+; Position=589-855
  misc_feature (29)..(38): Xaa can be any naturally occurring amino acid
  misc_feature (51)..(82): Xaa can be any naturally occurring amino acid
IELRKEHPRLFNFAGIHQTQSSRNTPRVXXXXXXXXXXMHPLPTSPLVFPXXXXXXXXXXXXXXXXXXXXXXXXXXXXXXXXPPLPPPP

SEQ ID NO: 28952 - protein, 87 aa, Diabrotica virgifera
  misc_feature: Coding regions on vcDNA: vcDNA=SeqID_8649; Strand=+; Position=36-299
IKGRNVKKTCGYSWVLIAVFCRCWRVPQGDASFERETQFDWYTRCTMRICRFSNNIVTLVLLRNRAIACSGNRLNRSTGLGNVGHQK

SEQ ID NO: 28953 - protein, 269 aa, Diabrotica virgifera
  misc_feature: Coding regions on vcDNA: vcDNA=SeqID_8650; Strand=+; Position=72-881
  misc_feature: Homolog annotation: Hit_ID=XP_424238.1; Match level="QueryCoverage =92%, HitCoverage=81%, E-value=6e-63, Identity=49%"; Hit description =PREDICTED: similar to phytanoyl-CoA hydroxylase precursor; phytanoyl- CoA
  misc_feature: Gene Ontology Annotation: Molecular function=protein binding; Cellular component=peroxisome; Biological process=fatty acid alpha -oxidation
  misc_feature: Pfam annotation: Pfam_ID=PhyH; Match level="Score=96.1, E-value=9.2e -26, Copies=1"; Pfam description=Phytanoyl-CoA dioxygenase (PhyH)
  misc_feature (48)..(59): Xaa can be any naturally occurring amino acid
MSKSATLPGLEKYSQAADTSAPERALRYTHPSSKLTLAQRQFYERNGXXXXXXXXXXXXIEVLNQRFIDICEDRADDMQCFVIKDPVLRKKGLKGEAVMNKLQDFVFDPVLSRYCMEKSLVDAVENIIGPNITVAHSMLINKPPDTDPDISRHPMHQDLHYFPFRPADKIVASWTAMQRVDENNGCLFVVPGSHIDNPLLPHIYPEGKNNAMYHGVQNKDHLPKQFVVLDKGDTVFFHPLLVHGSGVNRTKGYRRAISCHFCGYQLRIY

SEQ ID NO: 28954 - protein, 33 aa, Diabrotica virgifera
  misc_feature: Coding regions on vcDNA: vcDNA=SeqID_8651; Strand=-; Position=2-100
  misc_feature (3)..(31): Xaa can be any naturally occurring amino acid
INXXXXXXXXXXXXXXXXXXXXXXXXXXXXXKL

SEQ ID NO: 28955 - protein, 273 aa, Diabrotica virgifera
  misc_feature: Coding regions on vcDNA: vcDNA=SeqID_8652; Strand=+; Position=39-857
  misc_feature: Homolog annotation: Hit_ID=NP_610309.1; Match level="QueryCoverage =89%, HitCoverage=79%, E-value=2e-45, Identity=42%"; Hit description =CG2065-PA [Drosophila melanogaster] gb|AAF59213.1| CG2065-PA [Drosophila melanogaster]
  misc_feature: Gene Ontology Annotation: Molecular function=electron transporter activity; Cellular component=nucleus; Biological process=induction of apoptosis
  misc_feature: Pfam annotation: Pfam_ID=adh_short; Match level="Score=94.1, E-value =3.7e-25, Copies=1"; Pfam description=short chain dehydrogenase
  misc_feature (202)..(202): Xaa can be any naturally occurring amino acid
EDYLDHNSKYFAGGVCHCTARLDGQVVVITGANSGIGKALGLELAQRGATLVLPCRNINKGLEAKKYILKYSNSKNIKIFVKELDLCKISSIVKFAETLKTEFTEIYALVNNAGVFYHPQDLTEDGFEITLQTNYLGPFILTHHLLDLLKRSVHARIVNISSEAHRLVNVYDLNAVTKCQTEFRDNFIAYGVSKLAINLFTXELSQKLLSTNVIINAANPGNVETSIFRNFPPLSNPWLYALQWPIRILVIKNPKQGAHTPLHLLLTSNRTTG

SEQ ID NO: 28956 - protein, 81 aa, Diabrotica virgifera
  misc_feature: Coding regions on vcDNA: vcDNA=SeqID_8653; Strand=+; Position=440-683
  misc_feature (35)..(35): Xaa can be any naturally occurring amino acid
MKPKKQILIYHQILSRHPFLTEKTLYPPPKDYPPXSNTAGTPKYTPLLPPPPTITKDNTPASFPPSPSTQKHFSLAVTHHL

SEQ ID NO: 28957 - protein, 217 aa, Diabrotica virgifera
  misc_feature: Coding regions on vcDNA: vcDNA=SeqID_8654; Strand=-; Position=240-893
  misc_feature (1)..(50): Xaa can be any naturally occurring amino acid
  misc_feature (58)..(66): Xaa can be any naturally occurring amino acid
  misc_feature (68)..(107): Xaa can be any naturally occurring amino acid
  misc_feature (111)..(163): Xaa can be any naturally occurring amino acid
  misc_feature (165)..(217): Xaa can be any naturally occurring amino acid
XXXXXXXXXXXXXXXXXXXXXXXXXXXXXXXXXXXXXXXXXXXXXXXXXXMMRAFIYXXXXXXXXXLXXXXXXXXXXXXXXXXXXXXXXXXXXXXXXXXXXXXXXXXIIKXXXXXXXXXXXXXXXXXXXXXXXXXXXXXXXXXXXXXXXXXXXXXXXXXXXXXIXXXXXXXXXXXXXXXXXXXXXXXXXXXXXXXXXXXXXXXXXXXXXXXXXXXXX

SEQ ID NO: 28958 - protein, 119 aa, Diabrotica virgifera
  misc_feature: Coding regions on vcDNA: vcDNA=SeqID_8655; Strand=+; Position=3-506
  misc_feature: Homolog annotation: Hit_ID=AAF87759.1; Match level="QueryCoverage =100%, HitCoverage=37%, E-value=7e-47, Identity=63%"; Hit description= cytochrome oxidase subunit I [Diabrotica virgifera virgifera]
  misc_feature: Pfam annotation: Pfam_ID=COX1; Match level="Score=-280.3, E-value =0.099, Copies=1"; Pfam description=Cytochrome C and Quinol oxidase polyp
  misc_feature (14)..(14): Xaa can be any naturally occurring amino acid
  misc_feature (68)..(68): Xaa can be any naturally occurring amino acid
  misc_feature (103)..(103): Xaa can be any naturally occurring amino acid
PIGITFDRIPLFVXAVVITAILLLLSLPVLAGAITILLTDRNLNTSFFDPAGIIYAIIAIGLLGFIVXAHHIFTVGMDVDTRAYFTSATIIIAVPTGIKVFRXLATYHGTTITYSPVTL

SEQ ID NO: 28959 - protein, 35 aa, Diabrotica virgifera
  misc_feature: Coding regions on vcDNA: vcDNA=SeqID_8656; Strand=-; Position=1-105
  misc_feature (1)..(26): Xaa can be any naturally occurring amino acid
  misc_feature (30)..(30): Xaa can be any naturally occurring amino acid
  misc_feature (33)..(33): Xaa can be any naturally occurring amino acid
XXXXXXXXXXXXXXXXXXXXXXXXXXLVFXKNXSF

SEQ ID NO: 28960 - protein, 184 aa, Diabrotica virgifera
  misc_feature: Coding regions on vcDNA: vcDNA=SeqID_8657; Strand=+; Position=1-552
  misc_feature (1)..(183): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXL

SEQ ID NO: 28961 - protein, 34 aa, Diabrotica virgifera
  misc_feature: Coding regions on vcDNA: vcDNA=SeqID_8658; Strand=-; Position=1-102
  misc_feature (29)..(34): Xaa can be any naturally occurring amino acid
SYLVARVATMMFFCYKNILVSLQSLSSIXXXXXX

SEQ ID NO: 28962 - protein, 83 aa, Diabrotica virgifera
  misc_feature: Coding regions on vcDNA: vcDNA=SeqID_8659; Strand=-; Position=3-251
NTGHTMTIPLLWLSSMTRSVLIKVSIFIRYPRNTINASILYHKKTVWYITKYISSTREFSLTSCREHCHCWHSLLTKKLFGRE

SEQ ID NO: 28963 - protein, 58 aa, Diabrotica virgifera
  misc_feature: Coding regions on vcDNA: vcDNA=SeqID_8660; Strand=+; Position=208-384
  misc_feature (13)..(30): Xaa can be any naturally occurring amino acid
QLLNNLDNLFGMXXXXXXXXXXXXXXXXXXNLFPFYLLLSLTITLNIVSLVHNLPSLY

SEQ ID NO: 28964 - protein, 259 aa, Diabrotica virgifera
  misc_feature: Coding regions on vcDNA: vcDNA=SeqID_8661; Strand=+; Position=2-778
  misc_feature (1)..(15): Xaa can be any naturally occurring amino acid
  misc_feature (18)..(55): Xaa can be any naturally occurring amino acid
  misc_feature (58)..(244): Xaa can be any naturally occurring amino acid
  misc_feature (247)..(249): Xaa can be any naturally occurring amino acid
XXXXXXXXXXXXXXXYLXXXXXXXXXXXXXXXXXXXXXXXXXXXXXXXXXXXXXXRNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKLXXXLKTRNPYRVL

SEQ ID NO: 28965 - protein, 288 aa, Diabrotica virgifera
  misc_feature: Coding regions on vcDNA: vcDNA=SeqID_8662; Strand=+; Position=2-866
  misc_feature: Homolog annotation: Hit_ID=XP_320147.1; Match level="QueryCoverage =98%, HitCoverage=46%, E-value=6e-71, Identity=47%"; Hit description =ENSANGP00000011586 [Anopheles gambiae]
  misc_feature (245)..(245): Xaa can be any naturally occurring amino acid
  misc_feature (274)..(274): Xaa can be any naturally occurring amino acid
  misc_feature (282)..(282): Xaa can be any naturally occurring amino acid
GRVGLLKRLGNALAHNNPDLQKWIQNQKSLYNGLPCSLSDIRYSNENIGYRNKCEFTVGIDEETNLSTVGFRIGSYVNGTTGVGPVDGLVHIPESMKVAVKVFQNFVRSSDLSVFNPELHTGHFRQLMARSAPNQLMLVVGIHPQDLDEEKLNKFKQDLVEFFSKGDGKDANVTSLYYQKIVKKNHNNDITPSEHLWGETHIYETILGLKFKISPEAFFQVNSKGAEVLYQSAMELSEPLEDSTXLDVCCGTGTIGLCFSKKCKQVLGIEIIPXAIDDAKEXAAINKI

SEQ ID NO: 28966 - protein, 106 aa, Diabrotica virgifera
  misc_feature: Coding regions on vcDNA: vcDNA=SeqID_8663; Strand=+; Position=1-318
  misc_feature (2)..(92): Xaa can be any naturally occurring amino acid
EXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLGKNSGNFYLGKVP

SEQ ID NO: 28967 - protein, 27 aa, Diabrotica virgifera
  misc_feature: Coding regions on vcDNA: vcDNA=SeqID_8664; Strand=-; Position=1-81
  misc_feature (6)..(27): Xaa can be any naturally occurring amino acid
LIGSFXXXXXXXXXXXXXXXXXXXXXX

SEQ ID NO: 28968 - protein, 36 aa, Diabrotica virgifera
  misc_feature: Coding regions on vcDNA: vcDNA=SeqID_8665; Strand=+; Position=3-110
QNGFQVSVNTYCILIRYVILLYIIKYIWIWNKKIHL

SEQ ID NO: 28969 - protein, 101 aa, Diabrotica virgifera
  misc_feature: Coding regions on vcDNA: vcDNA=SeqID_8666; Strand=+; Position=215-521
  misc_feature: Homolog annotation: Hit_ID=BAB33421.1; Match level="QueryCoverage =94%, HitCoverage=32%, E-value=9e-23, Identity=56%"; Hit description =putative senescence-associated protein [Pisum sativum]
  misc_feature (26)..(26): Xaa can be any naturally occurring amino acid
  misc_feature (56)..(56): Xaa can be any naturally occurring amino acid
MCIFAPLPARVSVSTKCPNLRFLSYXEGLLSLATECIRKSATTLSHDGLNPAHIPXYDVNNPRLGEFCFAMIGRADIDGPRSDIPMNAWPPQVRYSLGQLV

SEQ ID NO: 28970 - protein, 41 aa, Diabrotica virgifera
  misc_feature: Coding regions on vcDNA: vcDNA=SeqID_8667; Strand=+; Position=3-128
  misc_feature (3)..(8): Xaa can be any naturally occurring amino acid
IPXXXXXXERFYKRRISFFHERQDAYLLRDKHYRRDKIILL

SEQ ID NO: 28971 - protein, 55 aa, Diabrotica virgifera
  misc_feature: Coding regions on vcDNA: vcDNA=SeqID_8668; Strand=+; Position=3-170
  misc_feature (5)..(11): Xaa can be any naturally occurring amino acid
  misc_feature (30)..(37): Xaa can be any naturally occurring amino acid
IKVSXXXXXXXLLGFIYIALVDIIYELVMXXXXXXXXRPPLFSCTTVASSEYLIT

SEQ ID NO: 28972 - protein, 125 aa, Diabrotica virgifera
  misc_feature: Coding regions on vcDNA: vcDNA=SeqID_8669; Strand=-; Position=135-512
  misc_feature (28)..(34): Xaa can be any naturally occurring amino acid
ISLVMVLLNYNSDYYTPGQKNSFICILXXXXXXXGYSSFNAEEVNITVGEPKQGFLQSLERVRLLHGEKPCTLKMYLSHILALNARDFVKGGGEYYCWNSRFGLTHVNSRHESIRIFMGHFRDRD

SEQ ID NO: 28973 - protein, 108 aa, Diabrotica virgifera
  misc_feature: Coding regions on vcDNA: vcDNA=SeqID_8670; Strand=-; Position=0-323
  misc_feature (10)..(42): Xaa can be any naturally occurring amino acid
  misc_feature (44)..(64): Xaa can be any naturally occurring amino acid
  misc_feature (68)..(107): Xaa can be any naturally occurring amino acid
KKIPRGFPKXXXXXXXXXXXXXXXXXXXXXXXXXXXXXXXXXAXXXXXXXXXXXXXXXXXXXXXNLFXXXXXXXXXXXXXXXXXXXXXXXXXXXXXXXXXXXXXXXXL

SEQ ID NO: 28974 - protein, 88 aa, Diabrotica virgifera
  misc_feature: Coding regions on vcDNA: vcDNA=SeqID_8671; Strand=+; Position=39-305
  misc_feature (1)..(12): Xaa can be any naturally occurring amino acid
XXXXXXXXXXXXVFIRIYFVLDMELISHQYVYNNAVKTTICTQKCFKNQNVLIGLFIDCHLFRASVMGHIILIYLSHTSLVCVIYIYQ

SEQ ID NO: 28975 - protein, 274 aa, Diabrotica virgifera
  misc_feature: Coding regions on vcDNA: vcDNA=SeqID_8672; Strand=+; Position=76-897
  misc_feature: Homolog annotation: Hit_ID=AAH67608.1; Match level="QueryCoverage =75%, HitCoverage=42%, E-value=1e-49, Identity=47%"; Hit description =LOC407696 protein [Danio rerio]
  misc_feature: Gene Ontology Annotation: Molecular function=ATP dependent RNA helicase activity; Cellular component=nucleolus; Biological process =35S primary transcript processing
  misc_feature: Pfam annotation: Pfam_ID=DEAD; Match level="Score=97.7, E-value=3e -26, Copies=1"; Pfam description=DEAD/DEAH box helicase
  misc_feature (95)..(111): Xaa can be any naturally occurring amino acid
  misc_feature (262)..(262): Xaa can be any naturally occurring amino acid
MKIRVHCSMYVIIMDAYDIFKKLTRGAKFSRNFNKEVSSVVKHETPPAVKIEKVLTVSQDNPSITLISGLSTENRAKKRKFKDEEHILKGLEQEXXXXXXXXXXXXXXXXXVPEPCKSFQDFNVDSDIIDNLKKCGYEEPTPIQKQAVPLMLKERQILACAPTGSGKTAAFLVPIIHSLRGPQRQGFRALILCPTRELAQQTQRECDRLAEGREFRVHVISKIKKALSQYNPSGSQKYDILVTTPNRFVLFVKQDPPAISLXNVEWLVIDEADN

SEQ ID NO: 28976 - protein, 39 aa, Diabrotica virgifera
  misc_feature: Coding regions on vcDNA: vcDNA=SeqID_8673; Strand=-; Position=1-120
  misc_feature (22)..(33): Xaa can be any naturally occurring amino acid
IKQLCLSNDCQVIPQQFYTSFXXXXXXXXXXXXAIVLLD

SEQ ID NO: 28977 - protein, 52 aa, Diabrotica virgifera
  misc_feature: Coding regions on vcDNA: vcDNA=SeqID_8674; Strand=+; Position=181-339
  misc_feature (25)..(33): Xaa can be any naturally occurring amino acid
FQFNCEVGIKIFILSYMTICHCLFXXXXXXXXXVLHISISNLNYLCSLMMIT

SEQ ID NO: 28978 - protein, 96 aa, Diabrotica virgifera
  misc_feature: Coding regions on vcDNA: vcDNA=SeqID_8675; Strand=+; Position=242-529
KGQGVAGRKKCCLKTSWYATYKENISEEAMILAYRDISDRDNAKIHYMIKNQRPRCRLGFLNWVSLLMSITIIDTDDIALQYILPRAAQRPKHLTL

SEQ ID NO: 28979 - protein, 64 aa, Diabrotica virgifera
  misc_feature: Coding regions on vcDNA: vcDNA=SeqID_8676; Strand=-; Position=38-232
  misc_feature (17)..(23): Xaa can be any naturally occurring amino acid
ILQFSRSFLFVNNQYIXXXXXXXHTRGTKKKMYVYNNKIFSLNIIHTSYNVISLSFSQKLYSLC

SEQ ID NO: 28980 - protein, 238 aa, Diabrotica virgifera
  misc_feature: Coding regions on vcDNA: vcDNA=SeqID_8677; Strand=-; Position=2-715
  misc_feature (3)..(24): Xaa can be any naturally occurring amino acid
  misc_feature (28)..(28): Xaa can be any naturally occurring amino acid
  misc_feature (30)..(238): Xaa can be any naturally occurring amino acid
KNXXXXXXXXXXXXXXXXXXXXXXPQLXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 28981 - protein, 90 aa, Diabrotica virgifera
  misc_feature: Coding regions on vcDNA: vcDNA=SeqID_8678; Strand=+; Position=271-543
  misc_feature (1)..(23): Xaa can be any naturally occurring amino acid
XXXXXXXXXXXXXXXXXXXXXXXVILFTDEYIPATLRNNVRTVIVTAKGTKILNMEMRINIYKINVTKFKGKNIDKVRTICFFLLCIDCL

SEQ ID NO: 28982 - protein, 105 aa, Diabrotica virgifera
  misc_feature: Coding regions on vcDNA: vcDNA=SeqID_8679; Strand=+; Position=212-529
  misc_feature (6)..(13): Xaa can be any naturally occurring amino acid
  misc_feature (18)..(33): Xaa can be any naturally occurring amino acid
  misc_feature (35)..(57): Xaa can be any naturally occurring amino acid
  misc_feature (73)..(79): Xaa can be any naturally occurring amino acid
HFYCNXXXXXXXXGTKRXXXXXXXXXXXXXXXXFXXXXXXXXXXXXXXXXXXXXXXXKPNFIKIHFLNKNQDXXXXXXXICHYLFLHIIILLFYKLFITLLISII

SEQ ID NO: 28983 - protein, 42 aa, Diabrotica virgifera
  misc_feature: Coding regions on vcDNA: vcDNA=SeqID_8680; Strand=+; Position=71-196
SMTCPLILLNVLRFFCVYRKFSYFYFLCYCYDYINLNYLCLL

SEQ ID NO: 28984 - protein, 48 aa, Diabrotica virgifera
  misc_feature: Coding regions on vcDNA: vcDNA=SeqID_8681; Strand=+; Position=185-331
  misc_feature (12)..(23): Xaa can be any naturally occurring amino acid
  misc_feature (33)..(40): Xaa can be any naturally occurring amino acid
HKIITIKSNNQXXXXXXXXXXXXNNTYVYLLPXXXXXXXXQIKTITFV

SEQ ID NO: 28985 - protein, 261 aa, Diabrotica virgifera
  misc_feature: Coding regions on vcDNA: vcDNA=SeqID_8682; Strand=+; Position=50-835
  misc_feature: Homolog annotation: Hit_ID=XP_316182.1; Match level="QueryCoverage =78%, HitCoverage=52%, E-value=6e-16, Identity=29%"; Hit description =ENSANGP00000017116 [Anopheles gambiae]
  misc_feature: Pfam annotation: Pfam_ID=C2; Match level="Score=1.3, E-value=0.042, Copies=1"; Pfam description=C2 domain
MEDRLNNIKNYFKKKSNDSEFVQRFGGVPQIGFRISFCESTKELKVKVIGARQLPTDYGNVKPQGYLVKVTFYPSKQKFETKTAKDSWPTINEEFSCILLPVKRIDDFFKGQFISFTVYATLGKEEEEQRQKEKPKSILKRYFSFSDGEEIISLRNNSFRRSGSQRRSSYNNSLSNRRTVGAVTYNLDRKLFTQKLRTGEISTPDIWRNITEITSGIQTQPRDGPKGSIELTLQYGVSEDGTNEVVESTVTFRCSLQQCSS

SEQ ID NO: 28986 - protein, 282 aa, Diabrotica virgifera
  misc_feature: Coding regions on vcDNA: vcDNA=SeqID_8683; Strand=-; Position=0-845
  misc_feature (22)..(22): Xaa can be any naturally occurring amino acid
  misc_feature (29)..(43): Xaa can be any naturally occurring amino acid
  misc_feature (45)..(278): Xaa can be any naturally occurring amino acid
SCYTNYKLYPPSRSHLYYRLTXPIKYAVXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRKG

SEQ ID NO: 28987 - protein, 163 aa, Diabrotica virgifera
  misc_feature: Coding regions on vcDNA: vcDNA=SeqID_8684; Strand=+; Position=314-802
  misc_feature: Homolog annotation: Hit_ID=AAT02772.1; Match level="QueryCoverage =74%, HitCoverage=77%, E-value=8e-47, Identity=78%"; Hit description =cytochrome oxidase subunit I [Diabrotica virgifera zeae]
  misc_feature: Pfam annotation: Pfam_ID=COX1; Match level="Score=-259.7, E-value =0.02, Copies=1"; Pfam description=Cytochrome C and Quinol oxidase polype
  misc_feature (2)..(2): Xaa can be any naturally occurring amino acid
  misc_feature (10)..(10): Xaa can be any naturally occurring amino acid
  misc_feature (35)..(43): Xaa can be any naturally occurring amino acid
  misc_feature (70)..(70): Xaa can be any naturally occurring amino acid
LXERGVGTGXTVYPPLSSNIAHGGPSVDLAIFRLXXXXXXXXXGAINFITTVINIRPIGITFDRIPLFVXAVVITAILLLLSLPVLAGAITILLTDRNLNTSFFDPAGGGDPILHPEGFGLFLILLQWYFRNNLCYNSNWLIFYCLRSPYIYRWKWMVIPELI

SEQ ID NO: 28988 - protein, 64 aa, Diabrotica virgifera
  misc_feature: Coding regions on vcDNA: vcDNA=SeqID_8685; Strand=-; Position=62-256
  misc_feature (29)..(36): Xaa can be any naturally occurring amino acid
LSFPYKILILNRHPSIAHHTLTFARVVDXXXXXXXXYYMLCNPPSIKSSAIYTISSTTILFNSQ

SEQ ID NO: 28989 - protein, 55 aa, Diabrotica virgifera
  misc_feature: Coding regions on vcDNA: vcDNA=SeqID_8686; Strand=+; Position=67-234
  misc_feature (26)..(37): Xaa can be any naturally occurring amino acid
LIVKTDLDCFIYVNKYVIFYQHVTFXXXXXXXXXXXXELILIIRANYLMIKNYLI

SEQ ID NO: 28990 - protein, 60 aa, Diabrotica virgifera
  misc_feature: Coding regions on vcDNA: vcDNA=SeqID_8687; Strand=+; Position=1-183
  misc_feature (13)..(25): Xaa can be any naturally occurring amino acid
YLEKLTSLTTMAXXXXXXXXXXXXXGETPAAAPAPAETCSSSESQAGLPNNHIIMIIERF

SEQ ID NO: 28991 - protein, 313 aa, Diabrotica virgifera
  misc_feature: Coding regions on vcDNA: vcDNA=SeqID_8688; Strand=-; Position=3-939
  misc_feature: Homolog annotation: Hit_ID=AAF87760.1; Match level="QueryCoverage =100%, HitCoverage=71%, E-value=1e-130, Identity=77%"; Hit description=cytochrome oxidase subunit I [Diabrotica virgifera zeae]
  misc_feature: Pfam annotation: Pfam_ID=COX1; Match level="Score=124.5, E-value=2.5e- 34, Copies=1"; Pfam description=Cytochrome C and Quinol oxidase polyp
  misc_feature (21)..(21): Xaa can be any naturally occurring amino acid
  misc_feature (37)..(37): Xaa can be any naturally occurring amino acid
  misc_feature (44)..(50): Xaa can be any naturally occurring amino acid
  misc_feature (72)..(72): Xaa can be any naturally occurring amino acid
  misc_feature (89)..(89): Xaa can be any naturally occurring amino acid
  misc_feature (124)..(124): Xaa can be any naturally occurring amino acid
  misc_feature (141)..(141): Xaa can be any naturally occurring amino acid
  misc_feature (144)..(150): Xaa can be any naturally occurring amino acid
  misc_feature (197)..(197): Xaa can be any naturally occurring amino acid
  misc_feature (204)..(220): Xaa can be any naturally occurring amino acid
  misc_feature (251)..(251): Xaa can be any naturally occurring amino acid
  misc_feature (267)..(274): Xaa can be any naturally occurring amino acid
  misc_feature (295)..(295): Xaa can be any naturally occurring amino acid
PVLAGAITILLTDRNLNTSFXDPAGGGDPILYQHLFXIFGHPAXXXXXXXGFGLISHIVRQERRKKEAFGTXGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAHFHYVLSIGAVFAIIAGFIQXFPLFTGXXXXXXXXXXXXXXXXXGVNLTFFPQHFLGLIGIPRRYSDYPDVFILXNIVSSIGSLISLIGVXXXXXXXXEAFSFQRKRLRPLRITSSIEXLQFNPPAEHRYSELPILS

SEQ ID NO: 28992 - protein, 136 aa, Diabrotica virgifera
  misc_feature: Coding regions on vcDNA: vcDNA=SeqID_8689; Strand=+; Position=118-528
  misc_feature: Homolog annotation: Hit_ID=EAL31159.1; Match level="QueryCoverage =87%, HitCoverage=70%, E-value=5e-09, Identity=31%"; Hit description =GA12789-PA [Drosophila pseudoobscura]
MEYIEKTAKDYKKCCDVDMDSKLNLLNKSIDEMLTRLEEFQTMMSFVEQDRKDYNDILTSVPNYKDEFDTLCNRIDTVDKLTSHIKSNLDVLESEIEKAESSLGCSEKTTKVTQIFTPLFKKNVDKKQSTQEDYFD

SEQ ID NO: 28993 - protein, 77 aa, Diabrotica virgifera
  misc_feature: Coding regions on vcDNA: vcDNA=SeqID_8690; Strand=-; Position=1-231
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PFXXXXXXXXXXXTNLAHTGLNXXXXXXXXSNXXXXXXXXXXXXXXPTSRSXXXXXXXXXXXXXXVMPKVIYSRTRG

SEQ ID NO: 28994 - protein, 57 aa, Diabrotica virgifera
  misc_feature: Coding regions on vcDNA: vcDNA=SeqID_8691; Strand=+; Position=274-447
LYYIHSTGKVCFSFIRSDPFGLLNCKDSLHSTKSSLQQLVSCFRVMSPVFRAEQASL

SEQ ID NO: 28995 - protein, 148 aa, Diabrotica virgifera
  misc_feature: Coding regions on vcDNA: vcDNA=SeqID_8692; Strand=-; Position=1-444
  misc_feature (1)..(42): Xaa can be any naturally occurring amino acid
  misc_feature (44)..(78): Xaa can be any naturally occurring amino acid
  misc_feature (84)..(148): Xaa can be any naturally occurring amino acid
XXXXXXXXXXXXXXXXXXXXXXXXXXXXXXXXXXXXXXXXXXIXXXXXXXXXXXXXXXXXXXXXXXXXXXXXXXXXXXLISSFXXXXXXXXXXXXXXXXXXXXXXXXXXXXXXXXXXXXXXXXXXXXXXXXXXXXXXXXXXXXXXXXX

SEQ ID NO: 28996 - protein, 143 aa, Diabrotica virgifera
  misc_feature: Coding regions on vcDNA: vcDNA=SeqID_8693; Strand=+; Position=3-434
  misc_feature (6)..(6): Xaa can be any naturally occurring amino acid
  misc_feature (15)..(115): Xaa can be any naturally occurring amino acid
  misc_feature (121)..(130): Xaa can be any naturally occurring amino acid
PRGRAXQQKQEKSPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLPLILXXXXXXXXXXLLIKIPFLNKNSP

SEQ ID NO: 28997 - protein, 56 aa, Diabrotica virgifera
  misc_feature: Coding regions on vcDNA: vcDNA=SeqID_8694; Strand=-; Position=134-304
YPRAQYLIKLWIWTTIGYQLPVLLRSWDGSALLSIKVDLFKFIRQDIINSIGAISE

SEQ ID NO: 28998 - protein, 282 aa, Diabrotica virgifera
  misc_feature: Coding regions on vcDNA: vcDNA=SeqID_8695; Strand=+; Position=2-847
  misc_feature: Homolog annotation: Hit_ID=S42886; Match level="QueryCoverage=97%, HitCoverage=71%, E-value=6e-40, Identity=45%"; Hit description =collagen - silkworm emb|CAA83002.1| Collagen [Bombyx mori]
  misc_feature: Gene Ontology Annotation: Molecular function=ATP binding; Cellular component=extracellular matrix; Biological process=heart development
  misc_feature: Pfam annotation: Pfam_ID=Collagen; Match level="Score=-14.8, E-value =0.0014, Copies=1"; Pfam description=Collagen triple helix repeat (20 copi
  misc_feature (186)..(196): Xaa can be any naturally occurring amino acid
FASAGQSEGGGQTGGWPEQNGGWPGQTSGIRQPSGMRQPVETGQPGTIGQPGGYGQPSGTNQPGGIGQPGGYGQPGGTGQPIETGQPGVIGQPGGYGQPNGARQPGGIGQPGGYGQPAGAGQPIETGQPGVLGQPGGYGQPNGARQPGGIGQPGGYGQPAGTGQPVGTGQPGIIGQPGGYGPPSGXXXXXXXXXXXGYRQPGSPGQSGGIAPPGKIEQTGGIQQPGGIGQSGGYPGRPGEIPQTNGWPGQTGGIPQFTTGRWSETTGQTGTNQRGPGQVGWS

SEQ ID NO: 28999 - protein, 123 aa, Diabrotica virgifera
  misc_feature: Coding regions on vcDNA: vcDNA=SeqID_8696; Strand=+; Position=1-372
  misc_feature (6)..(30): Xaa can be any naturally occurring amino acid
HLFSNXXXXXXXXXXXXXXXXXXXXXXXXXDFSLVAAILLPHHLEHLDPKGVATLNLETSVVILFITSLLVVTIHIIVQTMTRVGLATATLFLPLPVYSTITKTLLRVTSGLPLLPDMRDHRQ

SEQ ID NO: 29000 - protein, 87 aa, Diabrotica virgifera
  misc_feature: Coding regions on vcDNA: vcDNA=SeqID_8697; Strand=+; Position=69-332
KKNLPSILDGFGCPKTDPIKRWKRHWVTQRNLSTSQYRLIRPIITELPCDKNLPLPHKYTCTISTTRWGPASNPVHLLKTNLLDANI

SEQ ID NO: 29001 - protein, 50 aa, Diabrotica virgifera
  misc_feature: Coding regions on vcDNA: vcDNA=SeqID_8698; Strand=-; Position=238-390
NNNYYISQYNLSFLLLLLYSYLPSLFYFLLIYPHHILYGFNKQIPRFHIY

SEQ ID NO: 29002 - protein, 82 aa, Diabrotica virgifera
  misc_feature: Coding regions on vcDNA: vcDNA=SeqID_8699; Strand=-; Position=2-247
  misc_feature (17)..(81): Xaa can be any naturally occurring amino acid
YYRFDSSNKITLLSLRXXXXXXXXXXXXXXXXXXXXXXXXXXXXXXXXXXXXXXXXXXXXXXXXXXXXXXXXXXXXXXXXXL

SEQ ID NO: 29003 - protein, 221 aa, Diabrotica virgifera
  misc_feature: Coding regions on vcDNA: vcDNA=SeqID_8700; Strand=-; Position=0-662
  misc_feature (26)..(42): Xaa can be any naturally occurring amino acid
  misc_feature (45)..(220): Xaa can be any naturally occurring amino acid
NRARIQIIRRAGGPVYFIQKVMLLIXXXXXXXXXXXXXXXXXAKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 29004 - protein, 112 aa, Diabrotica virgifera
  misc_feature: Coding regions on vcDNA: vcDNA=SeqID_8701; Strand=+; Position=3-341
  misc_feature: Homolog annotation: Hit_ID=EAA00101.2; Match level="QueryCoverage =86%, HitCoverage=15%, E-value=1e-34, Identity=72%"; Hit description =ENSANGP00000021162 [Anopheles gambiae str. PEST] ref|XP_552375.1| ENSANGP00000021162 [Anopheles gambiae st
  misc_feature: Gene Ontology Annotation: Molecular function=beta-glucuronidase activity; Cellular component=lysosome; Biological process =glycosaminoglycan catabolism
GLHFLPAYIWSEEYQMNVMSEHFKAFDYLRSQGFFVGEFIWNFADFKTAQTYTRVGGNKKGIFTRNRQPKASAFHLRRRYWGLAKEYNPNVTLPNDLNAPYTIREAPPHTEL

SEQ ID NO: 29005 - protein, 70 aa, Diabrotica virgifera
  misc_feature: Coding regions on vcDNA: vcDNA=SeqID_8702; Strand=+; Position=246-458
LDIGLHKHGHLTTPEHLHIPKHLKALIGLLPERKQQRDYRENDCMIIDLNPHGANDYLGSKPLLDACCQE

SEQ ID NO: 29006 - protein, 57 aa, Diabrotica virgifera
  misc_feature: Coding regions on vcDNA: vcDNA=SeqID_8703; Strand=-; Position=0-170
  misc_feature (3)..(9): Xaa can be any naturally occurring amino acid
  misc_feature (51)..(52): Xaa can be any naturally occurring amino acid
PPXXXXXXXFSWCLCVGGVSRGLVPSFPFFVFCLLALALGLKRGRLLALSXXSVSKG

SEQ ID NO: 29007 - protein, 69 aa, Diabrotica virgifera
  misc_feature: Coding regions on vcDNA: vcDNA=SeqID_8704; Strand=+; Position=18-227
  misc_feature (7)..(19): Xaa can be any naturally occurring amino acid
  misc_feature (22)..(33): Xaa can be any naturally occurring amino acid
  misc_feature (37)..(46): Xaa can be any naturally occurring amino acid
LIIISLXXXXXXXXXXXXXYCXXXXXXXXXXXXWYSXXXXXXXXXXNLNLFIKNRFLMSYVYIIKMKNL

SEQ ID NO: 29008 - protein, 67 aa, Diabrotica virgifera
  misc_feature: Coding regions on vcDNA: vcDNA=SeqID_8705; Strand=+; Position=98-301
FSLRLCVAENVCLILCRIAFHQSTDLFLLRWMTSVHLNVIFSKVTPTQRRYITDYLAQPVTCTDHLL

SEQ ID NO: 29009 - protein, 177 aa, Diabrotica virgifera
  misc_feature: Coding regions on vcDNA: vcDNA=SeqID_8706; Strand=+; Position=3-536
SGLTHNEHVDQLAKNSLIHGTVTKYQPCILDAFACLRTEQMKSWKRHWERYCNISTTQYSLIQPIISEKPWYKNFTLPRKYTSTISRIRFGHACYPAHLFKINILDSNICQDSEVKSDLNHIFFECKKHKHLTKHLIKRIIDQNIPLPVNILFILSLNKKKIFDCLVSFLSDSKILL

SEQ ID NO: 29010 - protein, 92 aa, Diabrotica virgifera
  misc_feature: Coding regions on vcDNA: vcDNA=SeqID_8707; Strand=+; Position=1-276
  misc_feature (1)..(55): Xaa can be any naturally occurring amino acid
  misc_feature (60)..(88): Xaa can be any naturally occurring amino acid
XXXXXXXXXXXXXXXXXXXXXXXXXXXXXXXXXXXXXXXXXXXXXXXXXXXXXXXLNWGXXXXXXXXXXXXXXXXXXXXXXXXXXXXXPLGE

SEQ ID NO: 29011 - protein, 85 aa, Diabrotica virgifera
  misc_feature: Coding regions on vcDNA: vcDNA=SeqID_8708; Strand=-; Position=87-344
VRILYRRQLPVALAITLGCTASTQGTSPTGIVRFIHEHGCLVHKKMQCGNITSNKSISSNRFNPDNIVANYTSHKASRGSHDCRR

SEQ ID NO: 29012 - protein, 156 aa, Diabrotica virgifera
  misc_feature: Coding regions on vcDNA: vcDNA=SeqID_8709; Strand=+; Position=335-805
  misc_feature: Pfam annotation: Pfam_ID=DUF227; Match level="Score=9.7, E-value =0.00011, Copies=1"; Pfam description=Domain of unknown function (DUF227)
INVLNNSVYFKYIHSVYMSAMDFKVEIKDEPVEYIQKDTESQLSTSIDLENFKNEKEDKSEMGLNAEIKEEFSDSCQVYTKDQLFTSPDLKDLVNEADEDNSGFQNIDRHIGFDLETTKLVLRDLASLHAVSLALRLRKPEVFEKVIKPYCVPLKL

SEQ ID NO: 29013 - protein, 165 aa, Diabrotica virgifera
  misc_feature: Coding regions on vcDNA: vcDNA=SeqID_8710; Strand=+; Position=31-527
  misc_feature: Homolog annotation: Hit_ID=XP_395827.1; Match level="QueryCoverage =87%, HitCoverage=25%, E-value=7e-51, Identity=70%"; Hit description =similar to ENSANGP00000008222 [Apis mellifera]
  misc_feature: Gene Ontology Annotation: Molecular function=solute:solute antiporter activity; Cellular component=mitochondrial inner membrane; Biological process=solute:solute exchange
  misc_feature: Pfam annotation: Pfam_ID=Mito_carr; Match level="Score=112.6, E-value= 1e-30, Copies=1"; Pfam description=Mitochondrial carrier protein
  misc_feature (147)..(147): Xaa can be any naturally occurring amino acid
  misc_feature (153)..(153): Xaa can be any naturally occurring amino acid
MMELERQNKFEIICKNLLCGGVAGMLSKTTVAPLDRVKILLQAHNRHHESHGVVGGLRHVINKEGPLALYKGNGAQMVRIFPYAAIQFTSFEVYKKYLDGVFGETSHIDKFLAGAAAGLTSVFCTYPLDTIRARLAFQVSGEHIYTXDSSRGXTIFKEESGARAL

SEQ ID NO: 29014 - protein, 35 aa, Diabrotica virgifera
  misc_feature: Coding regions on vcDNA: vcDNA=SeqID_8711; Strand=-; Position=1-105
  misc_feature (4)..(33): Xaa can be any naturally occurring amino acid
PHSXXXXXXXXXXXXXXXXXXXXXXXXXXXXXXIF

SEQ ID NO: 29015 - protein, 157 aa, Diabrotica virgifera
  misc_feature: Coding regions on vcDNA: vcDNA=SeqID_8712; Strand=+; Position=3-476
  misc_feature: Homolog annotation: Hit_ID=EAL38669.1; Match level="QueryCoverage =91%, HitCoverage=10%, E-value=1e-22, Identity=41%"; Hit description =ENSANGP00000025661 [Anopheles gambiae str. PEST] ref|XP_551799.1| ENSANGP00000025661 [Anopheles gambiae st
  misc_feature: Gene Ontology Annotation: Molecular function=antibacterial peptide activity; Cellular component=integral to plasma membrane; Biological process=activation of NF-kappaB-inducing kinase
  misc_feature: Pfam annotation: Pfam_ID=TIR; Match level="Score=82.5, E-value=1.1e -21, Copies=1"; Pfam description=TIR domain
AFISYSSEDRNFVVRLVSMLEDYAPYLKLCVYERDFNVGHFISECVLACISDSRKIVLVVSDNYAKSQWCRWESHIAEHHRLFFEDGNGDFVDDTIVVIKLGTVNKSNMTPMLKFLLKTRIYLQWEHDDNKQKLFWNKLRTTLAASKFEQITQVTHM

SEQ ID NO: 29016 - protein, 203 aa, Diabrotica virgifera
  misc_feature: Coding regions on vcDNA: vcDNA=SeqID_8713; Strand=-; Position=3-609
  misc_feature: Homolog annotation: Hit_ID=DAA04497.1; Match level="QueryCoverage =81%, HitCoverage=13%, E-value=5e-18, Identity=31%"; Hit description =TPA: pol polyprotein [Schistosoma mansoni]
  misc_feature (91)..(98): Xaa can be any naturally occurring amino acid
  misc_feature (117)..(117): Xaa can be any naturally occurring amino acid
  misc_feature (147)..(147): Xaa can be any naturally occurring amino acid
TGKQSLYTGLTNQPVPFHKVRHILSYIILMSFLIDNNILSQNQFGFLTNKCTTDAMFSVLHEVYQALNNNLYTATVFCDYAKAFDCVNHDXXXXXXXXYGIRGISSNWFQSYLNNRXQLVRANNTDSSLKNIVSLVPLGLVLGPILXFINDITNLKIDGKIFLFADDTSITWSNSTIASFHATITSDLHAIKTWSDSNLPDPE

SEQ ID NO: 29017 - protein, 267 aa, Diabrotica virgifera
  misc_feature: Coding regions on vcDNA: vcDNA=SeqID_8714; Strand=-; Position=3-802
  misc_feature: Homolog annotation: Hit_ID=AAK61417.1; Match level="QueryCoverage =96%, HitCoverage=73%, E-value=2e-34, Identity=34%"; Hit description =transposase [Ceratitis rosa]
  misc_feature: Pfam annotation: Pfam_ID=Transposase_5; Match level="Score=8.7, E -value=0.0045, Copies=1"; Pfam description=Transposase
  misc_feature (123)..(132): Xaa can be any naturally occurring amino acid
  misc_feature (251)..(251): Xaa can be any naturally occurring amino acid
RKSYITSTVTKTLKRSKIAQKLERPRTATNEVIKQNIAIDLEESPQTSTTNLALNHGISQRSVRRILKMEKYHPYKIQLVQELSDDDFDRRLEFCERMLDICNNDEHFASNAVFSDEATFCLXXXXXXXXXXYWSNENPRWIIEAHTQHPQKLNVWMGIVQNRLISRFFIDGNLNGDKYLNLLNNQIIPALQQNGQLPQNFWFQQDGAPPHYDRRVRDFLDMNFPNQWIGRRGFLEWPARSPDLNPLDFFXWSYLKSRVYVNRPTCL

SEQ ID NO: 29018 - protein, 47 aa, Diabrotica virgifera; identical to SEQ ID NO: 26759
  misc_feature: Coding regions on vcDNA: vcDNA=SeqID_8715; Strand=+; Position=1-144
  misc_feature (1)..(15): Xaa can be any naturally occurring amino acid
  misc_feature (17)..(24): Xaa can be any naturally occurring amino acid

SEQ ID NO: 29019 - protein, 46 aa, Diabrotica virgifera
  misc_feature: Coding regions on vcDNA: vcDNA=SeqID_8716; Strand=+; Position=43-183
YVIVFSYVFSIIQCIIDRKWFIQSFFYLITKMSAYELLSVPSFFIP

SEQ ID NO: 29020 - protein, 50 aa, Diabrotica virgifera
  misc_feature: Coding regions on vcDNA: vcDNA=SeqID_8717; Strand=-; Position=298-450
  misc_feature (13)..(19): Xaa can be any naturally occurring amino acid
  misc_feature (24)..(29): Xaa can be any naturally occurring amino acid
VISYSQRCILKSXXXXXXXHANKXXXXXXLLKILNVHNIIICNFIYAAHE

SEQ ID NO: 29021 - protein, 29 aa, Diabrotica virgifera
  misc_feature: Coding regions on vcDNA: vcDNA=SeqID_8718; Strand=-; Position=43-132
IHLTVNFQHSITTGTTKRHFYLLKNHITT

SEQ ID NO: 29022 - protein, 80 aa, Diabrotica virgifera
  misc_feature: Coding regions on vcDNA: vcDNA=SeqID_8719; Strand=+; Position=36-278
LKNGCSIIFGNVSNGTRQDHPLYPWRWMGGNFKVLNGNHLFLLQIWIPYVSNFYLGHFFELGMDGAIIGKTIYRDTISML

SEQ ID NO: 29023 - protein, 94 aa, Diabrotica virgifera
  misc_feature: Coding regions on vcDNA: vcDNA=SeqID_8720; Strand=+; Position=58-339
  misc_feature (1)..(44): Xaa can be any naturally occurring amino acid
  misc_feature (77)..(83): Xaa can be any naturally occurring amino acid
  misc_feature (85)..(92): Xaa can be any naturally occurring amino acid
XXXXXXXXXXXXXXXXXXXXXXXXXXXXXXXXXXXXXXXXXXXXINYLGKTVIFIGKFIHKRWAPPGGFKSIYWGAXXXXXXXAXXXXXXXXVV

SEQ ID NO: 29024 - protein, 103 aa, Diabrotica virgifera
  misc_feature: Coding regions on vcDNA: vcDNA=SeqID_8721; Strand=-; Position=1-309
  misc_feature (1)..(103): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29025 - protein, 85 aa, Diabrotica virgifera
  misc_feature: Coding regions on vcDNA: vcDNA=SeqID_8722; Strand=+; Position=517-774
  misc_feature (7)..(13): Xaa can be any naturally occurring amino acid
VSFQYVXXXXXXXQIYVTTDFVEKLFNPIAKNVICQLSLYMRKCEDTLTSTPFLHRLSLKILHARRPFCYLTPQYSNGKVFLTLP

SEQ ID NO: 29026 - protein, 99 aa, Diabrotica virgifera
  misc_feature: Coding regions on vcDNA: vcDNA=SeqID_8723; Strand=+; Position=1-300
  misc_feature (31)..(36): Xaa can be any naturally occurring amino acid
  misc_feature (48)..(73): Xaa can be any naturally occurring amino acid
  misc_feature (89)..(95): Xaa can be any naturally occurring amino acid
RTRGLWRTKKMWSKKRLPKTWWVPSINWKEXXXXXXQKKLYTMSVSGXXXXXXXXXXXXXXXXXXXXXXXXXXRYIIFLSLRKRSDTIXXXXXXXRHNQ

SEQ ID NO: 29027 - protein, 144 aa, Diabrotica virgifera
  misc_feature: Coding regions on vcDNA: vcDNA=SeqID_8724; Strand=+; Position=20-451
  misc_feature: Homolog annotation: Hit_ID=EAL25425.1; Match level="QueryCoverage =88%, HitCoverage=64%, E-value=5e-24, Identity=44%"; Hit description =GA15602-PA [Drosophila pseudoobscura]
  misc_feature: Pfam annotation: Pfam_ID=Chitin_bind_4; Match level="Score=93.4, E -value=5.7e-25, Copies=1"; Pfam description=Insect cuticle protein
MKTIIAFLAILAVSLAASLDHLEPKHIPIIRQENEVSVDGNYRSSFETGNGIVIQEQGVQKNAGSQDAASEVHGSAEWQSPEGIPVVLKYVANEFGYQPEGNLLPTPPTDTNTPPPIPEAILRSLEWNAAHPEENEEYQRPKHQ

SEQ ID NO: 29028 - protein, 161 aa, Diabrotica virgifera
  misc_feature: Coding regions on vcDNA: vcDNA=SeqID_8725; Strand=+; Position=24-507
  misc_feature: Homolog annotation: Hit_ID=CAH04315.1; Match level="QueryCoverage =77%, HitCoverage=46%, E-value=1e-49, Identity=81%"; Hit description =S3Ae ribosomal protein [Biphyllus lunatus]
  misc_feature: Gene Ontology Annotation: Molecular function=structural constituent of ribosome; Cellular component=cytosolic small ribosomal subunit (sensu Eukarya); Biological process=protein biosynthesis
  misc_feature: Pfam annotation: Pfam_ID=Ribosomal_S3Ae; Match level="Score=97.3, E -value=4e-26, Copies=1"; Pfam description=Ribosomal S3Ae family
  misc_feature (66)..(73): Xaa can be any naturally occurring amino acid
  misc_feature (102)..(102): Xaa can be any naturally occurring amino acid
  misc_feature (114)..(114): Xaa can be any naturally occurring amino acid
DSCTGGSYPSGLSTLEPASPVESPAPPLPPSMFATRQGGKTLVNRTQGTKIASEGLKFRVFEVSLXXXXXXXXAERSFRKFRWIAEDVQGRNVLSNFLGMDXTTDKLRSMVKKXQTLIEASADVKTSDGYLLREFCIGFTNRDEIAQRKTCYATTYTNWRY

SEQ ID NO: 29029 - protein, 76 aa, Diabrotica virgifera
  misc_feature: Coding regions on vcDNA: vcDNA=SeqID_8726; Strand=+; Position=1-231
  misc_feature (2)..(27): Xaa can be any naturally occurring amino acid
  misc_feature (30)..(30): Xaa can be any naturally occurring amino acid
KXXXXXXXXXXXXXXXXXXXXXXXXXXLRXYSRIFIGEFKSIIKDCDLHVGIKVLMGVELLYLNLFNFLKFTWTGV

SEQ ID NO: 29030 - protein, 38 aa, Diabrotica virgifera
  misc_feature: Coding regions on vcDNA: vcDNA=SeqID_8727; Strand=-; Position=1-114
  misc_feature (3)..(37): Xaa can be any naturally occurring amino acid
KKXXXXXXXXXXXXXXXXXXXXXXXXXXXXXXXXXXXN

SEQ ID NO: 29031 - protein, 88 aa, Diabrotica virgifera
  misc_feature: Coding regions on vcDNA: vcDNA=SeqID_8728; Strand=-; Position=358-624
  misc_feature (61)..(81): Xaa can be any naturally occurring amino acid
LFSIYFFANFTKLTKLLTKRTSQLCLSLANGVSTYYDISNTHLCLGTQKSVLQLFLYLTEXXXXXXXXXXXXXXXXXXXXXLFIYKTK

SEQ ID NO: 29032 - protein, 78 aa, Diabrotica virgifera
  misc_feature: Coding regions on vcDNA: vcDNA=SeqID_8729; Strand=-; Position=1-234
  misc_feature (3)..(78): Xaa can be any naturally occurring amino acid
KLXXXXXXXXXXXXXXXXXXXXXXXXXXXXXXXXXXXXXXXXXXXXXXXXXXXXXXXXXXXXXXXXXXXXXXXXXXXX

SEQ ID NO: 29033 - protein, 298 aa, Diabrotica virgifera
  misc_feature: Coding regions on vcDNA: vcDNA=SeqID_8730; Strand=+; Position=40-938
  misc_feature: Homolog annotation: Hit_ID=XP_311397.1; Match level="QueryCoverage =85%, HitCoverage=82%, E-value=1e-52, Identity=41%"; Hit description =ENSANGP00000016730 [Anopheles gambiae]
  misc_feature: Pfam annotation: Pfam_ID=UMPH-1; Match level="Score=190.7, E-value=3e- 54, Copies=1"; Pfam description=Pyrimidine 5'-nucleotidase (UMPH-1)
  misc_feature (102)..(102): Xaa can be any naturally occurring amino acid
  misc_feature (247)..(247): Xaa can be any naturally occurring amino acid
MRNFVCELEQFNKPYVHIKDKDAVNKKISNLINGGMNKLQLVSDFDKTITKQHENGKRHRSSFNMFYDCPSLTTEYIDAANALDKIYAPREIDPTIPRDEKXKLMNEWWTLSEKILKGLVVPPEEIENICAIVGPSMRDGTKEFFEFLESKKVPILVFSAGLGDTVVAVLKHCEVYLSNVEVVSNFLKYDSEGRIEGFKDLLIHVYNKNEVAIKDTEFYHKIADRENVILMGDSLGDANMVGGLDNXMKVLKIGFLYKDDESVQITWILRYSFVDDQRWIYKSYIALIVPKMKAWGYV

SEQ ID NO: 29034 - protein, 223 aa, Diabrotica virgifera
  misc_feature: Coding regions on vcDNA: vcDNA=SeqID_8731; Strand=-; Position=3-672
  misc_feature: Homolog annotation: Hit_ID=BAB83836.1; Match level="QueryCoverage =79%, HitCoverage=12%, E-value=2e-28, Identity=39%"; Hit description =LTR retrotransposable element~partially supported by GENSCAN [Oryzias latipes]
  misc_feature: Pfam annotation: Pfam_ID=RVT_1; Match level="Score=9.9, E-value=3.1e -05, Copies=1"; Pfam description=Reverse transcriptase (RNA-dependent D
  misc_feature (96)..(96): Xaa can be any naturally occurring amino acid
VHFCEFGVSNNLGSRYLVSLVSHESIIEKNKEVFTGLGCLPNICHLEVIEPPRRIPFSLHDKLKEELNRMLSTRVIEKVNEASEWVNSIVLSRKKXKSLRVCLDPRNLNKALKRCHYPIPTFNEIRSKLAKAKYFSTLDAQSGFWMIQLDLESSKLCTFNTPFGRFRFTRLPYGISCAPEIFHKVMNEIVGDIQGVCLYIDDILIYSETLEGHNKILELVLER

SEQ ID NO: 29035 - protein, 128 aa, Diabrotica virgifera
  misc_feature: Coding regions on vcDNA: vcDNA=SeqID_8732; Strand=+; Position=47-433
  misc_feature (17)..(29): Xaa can be any naturally occurring amino acid
  misc_feature (37)..(47): Xaa can be any naturally occurring amino acid
  misc_feature (52)..(67): Xaa can be any naturally occurring amino acid
  misc_feature (77)..(111): Xaa can be any naturally occurring amino acid
  misc_feature (118)..(128): Xaa can be any naturally occurring amino acid
TRLYLFYQYDHHSDRTXXXXXXXXXXXXXVTLVYHGXXXXXXXXXXXQIKRXXXXXXXXXXXXXXXXLCDEMLFVVXXXXXXXXXXXXXXXXXXXXXXXXXXXXXXXXXXXLKVRIYXXXXXXXXXXX

SEQ ID NO: 29036 - protein, 129 aa, Diabrotica virgifera
  misc_feature: Coding regions on vcDNA: vcDNA=SeqID_8733; Strand=+; Position=94-480
  misc_feature (3)..(37): Xaa can be any naturally occurring amino acid
  misc_feature (39)..(69): Xaa can be any naturally occurring amino acid
  misc_feature (82)..(89): Xaa can be any naturally occurring amino acid
  misc_feature (107)..(113): Xaa can be any naturally occurring amino acid
  misc_feature (116)..(122): Xaa can be any naturally occurring amino acid
LTXXXXXXXXXXXXXXXXXXXXXXXXXXXXXXXXXXXGXXXXXXXXXXXXXXXXXXXXXXXXXXXXXXXLRDNRGIFYLKSXXXXXXXXPPPVLGLKGFKIGGKTPXXXXXXXFPXXXXXXXLISEFLK

SEQ ID NO: 29037 - protein, 94 aa, Diabrotica virgifera
  misc_feature: Coding regions on vcDNA: vcDNA=SeqID_8734; Strand=+; Position=2-286
  misc_feature (2)..(52): Xaa can be any naturally occurring amino acid
  misc_feature (64)..(64): Xaa can be any naturally occurring amino acid
AXXXXXXXXXXXXXXXXXXXXXXXXXXXXXXXXXXXXXXXXXXXXXXXXXXXLIPFFDIDKYLXIQRILLRVNRYKMRLDVISYNVYSNYKLSL

SEQ ID NO: 29038 - protein, 30 aa, Diabrotica virgifera
  misc_feature: Coding regions on vcDNA: vcDNA=SeqID_8735; Strand=-; Position=0-89
  misc_feature (1)..(29): Xaa can be any naturally occurring amino acid
XXXXXXXXXXXXXXXXXXXXXXXXXXXXXS

SEQ ID NO: 29039 - protein, 59 aa, Diabrotica virgifera
  misc_feature: Coding regions on vcDNA: vcDNA=SeqID_8736; Strand=-; Position=710-889
ALQTMIGICTKEIATRMVKGNSAIRQLKNHITLKNHITRNTKMRIYKSIIESNGNKLLA

SEQ ID NO: 29040 - protein, 69 aa, Diabrotica virgifera
  misc_feature: Coding regions on vcDNA: vcDNA=SeqID_8737; Strand=+; Position=377-586
  misc_feature (2)..(10): Xaa can be any naturally occurring amino acid
  misc_feature (35)..(42): Xaa can be any naturally occurring amino acid
  misc_feature (50)..(57): Xaa can be any naturally occurring amino acid
NXXXXXXXXXNEDQRFSVFHSMKLVIFIYHYIHFXXXXXXXXQLYHSNFXXXXXXXXGICTCSKKIYVK

SEQ ID NO: 29041 - protein, 45 aa, Diabrotica virgifera
  misc_feature: Coding regions on vcDNA: vcDNA=SeqID_8738; Strand=+; Position=3-137
  misc_feature (2)..(18): Xaa can be any naturally occurring amino acid
  misc_feature (27)..(42): Xaa can be any naturally occurring amino acid
MXXXXXXXXXXXXXXXXXESLHEGVDXXXXXXXXXXXXXXXXVKK

SEQ ID NO: 29042 - protein, 81 aa, Diabrotica virgifera
  misc_feature: Coding regions on vcDNA: vcDNA=SeqID_8739; Strand=+; Position=1-246
  misc_feature (5)..(15): Xaa can be any naturally occurring amino acid
  misc_feature (56)..(65): Xaa can be any naturally occurring amino acid
PFASXXXXXXXXXXXFYAKRTNYFCYVDNSLRTEKIIFSILYRNNPVPWRPSGYEXXXXXXXXXXFSISERAIKLIIVSAL

SEQ ID NO: 29043 - protein, 267 aa, Diabrotica virgifera
  misc_feature: Coding regions on vcDNA: vcDNA=SeqID_8740; Strand=+; Position=25-828
  misc_feature: Homolog annotation: Hit_ID=AAT38512.1; Match level="QueryCoverage =93%, HitCoverage=50%, E-value=6e-42, Identity=40%"; Hit description =pheromone-degrading enzyme [Phyllopertha diversa]
  misc_feature: Gene Ontology Annotation: Molecular function=fatty acid (omega-1) -hydroxylase activity; Cellular component=extracellular space; Biological process=prostaglandin metabolism
  misc_feature: Pfam annotation: Pfam_ID=p450; Match level="Score=-205.0, E-value =0.084, Copies=1"; Pfam description=Cytochrome P450
  misc_feature (149)..(155): Xaa can be any naturally occurring amino acid
  misc_feature (231)..(231): Xaa can be any naturally occurring amino acid
  misc_feature (236)..(236): Xaa can be any naturally occurring amino acid
  misc_feature (243)..(243): Xaa can be any naturally occurring amino acid
MIGIGVIILLFTFIYFYWLSWINTKYMRKIPGPKPNIFFGNLLIFAFVPSYMYLDIFMRFIQEYGKLFKVYDGPFSVVLVATDEKFVEHILSSTEYIDKAAQYDYLKGWLGDGLLVSTGTKWKQRRRMLTPAFHFSILENFIDVFDSVXXXXXXXLQREVGKNSVDISELVSLYTLDVICEAAMGTKLNAQTDSTSSYVRSTKSMCCIIMNRILSPLDPSLYPFTLNYFLXKRALXVLHAYTXHVIEKKYGRNAKRDIVLIQHEHWH

SEQ ID NO: 29044 - protein, 105 aa, Diabrotica virgifera
  misc_feature: Coding regions on vcDNA: vcDNA=SeqID_8741; Strand=-; Position=102-419
  misc_feature (20)..(32): Xaa can be any naturally occurring amino acid
  misc_feature (39)..(48): Xaa can be any naturally occurring amino acid
  misc_feature (59)..(69): Xaa can be any naturally occurring amino acid
  misc_feature (78)..(98): Xaa can be any naturally occurring amino acid
SPLPHFPPLKVNPTLFHKYXXXXXXXXXXXXXLFPLNPXXXXXXXXXXLNFRLFLSQRXXXXXXXXXXXLPLVILKLXXXXXXXXXXXXXXXXXXXXXSIFLNPL

SEQ ID NO: 29045 - protein, 133 aa, Diabrotica virgifera
  misc_feature: Coding regions on vcDNA: vcDNA=SeqID_8742; Strand=+; Position=354-752
  misc_feature (84)..(91): Xaa can be any naturally occurring amino acid
  misc_feature (103)..(133): Xaa can be any naturally occurring amino acid
QLSLYLHETFNVLLYFVISFSTTCSSNIVISIIINLGMLESTGIQNITPFPPSPRSLQAPLSALSFSALFHLVLWFSIAHLSTXXXXXXXXLHSTLPSSLLLXXXXXXXXXXXXXXXXXXXXXXXXXXXXXXX

SEQ ID NO: 29046 - protein, 117 aa, Diabrotica virgifera
  misc_feature: Coding regions on vcDNA: vcDNA=SeqID_8743; Strand=-; Position=1-351
  misc_feature (9)..(14): Xaa can be any naturally occurring amino acid
  misc_feature (18)..(25): Xaa can be any naturally occurring amino acid
  misc_feature (32)..(75): Xaa can be any naturally occurring amino acid
  misc_feature (81)..(88): Xaa can be any naturally occurring amino acid
  misc_feature (100)..(112): Xaa can be any naturally occurring amino acid
RGQNTAGHXXXXXXGARXXXXXXXXVFLMNRXXXXXXXXXXXXXXXXXXXXXXXXXXXXXXXXXXXXXXXXXXXXENKNNXXXXXXXXILLNKKIINHHXXXXXXXXXXXXXYAAPP

SEQ ID NO: 29047 - protein, 60 aa, Diabrotica virgifera
  misc_feature: Coding regions on vcDNA: vcDNA=SeqID_8744; Strand=-; Position=0-179
LYRWVNLENNKYAIIEDYSLVLQGSSTIKSLIMKITYFLSIKLASHYMTSFFTVNKRYIL

SEQ ID NO: 29048 - protein, 87 aa, Diabrotica virgifera
  misc_feature: Coding regions on vcDNA: vcDNA=SeqID_8745; Strand=-; Position=1-261
  misc_feature (1)..(10): Xaa can be any naturally occurring amino acid
  misc_feature (12)..(34): Xaa can be any naturally occurring amino acid
  misc_feature (38)..(87): Xaa can be any naturally occurring amino acid
XXXXXXXXXXPXXXXXXXXXXXXXXXXXXXXXXXLWGXXXXXXXXXXXXXXXXXXXXXXXXXXXXXXXXXXXXXXXXXXXXXXXXXX

SEQ ID NO: 29049 - protein, 161 aa, Diabrotica virgifera
  misc_feature: Coding regions on vcDNA: vcDNA=SeqID_8746; Strand=+; Position=415-896
  misc_feature: Homolog annotation: Hit_ID=NP_002084.2; Match level="QueryCoverage =100%, HitCoverage=36%, E-value=2e-65, Identity=77%"; Hit description= glycogen synthase kinase 3 beta [Homo sapiens] gb|AAH00251.1| Glycogen synthase kinase 3 beta
  misc_feature: Gene Ontology Annotation: Molecular function=glycogen synthase kinase 3 activity; Cellular component=cellular_component unknown; Biological process=mitotic spindle orientation
  misc_feature (138)..(138): Xaa can be any naturally occurring amino acid
MSGRPRTTSFAEGNKQALNPPLGDMKISSGGYIGKDGSKVTTVVARPGQGPDRPQEVSYTDTKVIGNGSFGVVYQAKLCDTFELVAIKKVLQDKRFKNRELQIMQKLEHCNIVKLTYYFYSSGDKKDEVYLHLVLEYXPGTVYKVARHYSKAKHTIPIIHI

SEQ ID NO: 29050 - protein, 52 aa, Diabrotica virgifera
  misc_feature: Coding regions on vcDNA: vcDNA=SeqID_8747; Strand=-; Position=2-157
  misc_feature (23)..(42): Xaa can be any naturally occurring amino acid
LIRYRKNNALPFNTDIIIYNSFXXXXXXXXXXXXXXXXXXXXVIYSSPDPQG

SEQ ID NO: 29051 - protein, 91 aa, Diabrotica virgifera
  misc_feature: Coding regions on vcDNA: vcDNA=SeqID_8748; Strand=+; Position=160-435
NNCRLLHLKTEYPYYDFFFYLSYWDTGNHINDRDLVREKHAVSRKPGMPNGKERQPRSNVAYTLQDKLPDDREIPDITVEEDNRTHKCIWD

SEQ ID NO: 29052 - protein, 234 aa, Diabrotica virgifera
  misc_feature: Coding regions on vcDNA: vcDNA=SeqID_8749; Strand=+; Position=178-879
  misc_feature (54)..(60): Xaa can be any naturally occurring amino acid
  misc_feature (126)..(134): Xaa can be any naturally occurring amino acid
  misc_feature (225)..(225): Xaa can be any naturally occurring amino acid
PSALKIMEKKVKIVTFIKRKLVYKGYSYNSVRNGPDGKIYWRCDESFTKCGGTXXXXXXXKVLQGKPHNHAPTPTQVAVKAVTHRIREEVASTSSTTQDVVSSALRRMENKVKQATFISTKRGKRXXXXXXXXXNTTRNGANGKIYWRCDASFTKCCGSVITDAASNVLPGQPHNHSPSPTKIAVKAVRHRIRETAASSSFTAQDVVSSALTGISDEVKVLLPKXKNYESQVLQ

SEQ ID NO: 29053 - protein, 24 aa, Diabrotica virgifera
  misc_feature: Coding regions on vcDNA: vcDNA=SeqID_8750; Strand=-; Position=0-71
  misc_feature (1)..(20): Xaa can be any naturally occurring amino acid
XXXXXXXXXXXXXXXXXXXXPSIP

SEQ ID NO: 29054 - protein, 157 aa, Diabrotica virgifera
  misc_feature: Coding regions on vcDNA: vcDNA=SeqID_8751; Strand=-; Position=2-472
  misc_feature: Homolog annotation: Hit_ID=XP_307144.1; Match level="QueryCoverage =79%, HitCoverage=33%, E-value=6e-15, Identity=39%"; Hit description =ENSANGP00000024852 [Anopheles gambiae]
  misc_feature (61)..(69): Xaa can be any naturally occurring amino acid
MEKTKYMNASRFKKTRLTQMIIDNYRFEEVDTFKYLGTMISRDNERIDLKQKLQAANRAYXXXXXXXXXKKLSRNTKMQIYKTTTIRPVVMYAIETNTLTLKEEEQLKVFERKIMRNILGPKVINENERRPWMNHEIGQWTEGENIVKEAKARTHAS

SEQ ID NO: 29055 - protein, 258 aa, Diabrotica virgifera
  misc_feature: Coding regions on vcDNA: vcDNA=SeqID_8752; Strand=+; Position=3-776
  misc_feature: Homolog annotation: Hit_ID=XP_397249.1; Match level="QueryCoverage =95%, HitCoverage=56%, E-value=4e-66, Identity=50%"; Hit description =similar to Zgc:63807 [Apis mellifera]
  misc_feature: Gene Ontology Annotation: Molecular function=folylpolyglutamate synthase activity; Cellular component=mitochondrion; Biological process=glutamate metabolism
  misc_feature: Pfam annotation: Pfam_ID=Mur_ligase; Match level="Score=-58.1, E -value=0.03, Copies=1"; Pfam description=Mur ligase family, catalytic domain
  misc_feature (109)..(116): Xaa can be any naturally occurring amino acid
  misc_feature (215)..(215): Xaa can be any naturally occurring amino acid
NTRSYQEALQALNELQTNADYIKNVVNQPRNASNIPEVIKFLGRTGLSVTDLDRLSVIHVTGTNGKGSTCAYTEKILRSHGCTTGFFSSPHLLDVRERIRINGKPISKXXXXXXXXKLYNLLNKQKDYPADMPLYFRFMTLLAFHIFLDHKVDVAILEVGIGGEYDCTNVIRKTSVVGITPLDFDHMALLGNTLESIAWNKAGIMKAGCSAITVXQPPNAFKVFEERSVKKNCSLTVVESDYYNATNSDIPLHGRQTN

SEQ ID NO: 29056 - protein, 34 aa, Diabrotica virgifera
  misc_feature: Coding regions on vcDNA: vcDNA=SeqID_8753; Strand=-; Position=2-103
  misc_feature (1)..(7): Xaa can be any naturally occurring amino acid
  misc_feature (9)..(10): Xaa can be any naturally occurring amino acid
  misc_feature (13)..(25): Xaa can be any naturally occurring amino acid
  misc_feature (28)..(28): Xaa can be any naturally occurring amino acid
  misc_feature (33)..(33): Xaa can be any naturally occurring amino acid
XXXXXXXLXXNHXXXXXXXXXXXXXLKXLINNXI

SEQ ID NO: 29057 - protein, 28 aa, Diabrotica virgifera
  misc_feature: Coding regions on vcDNA: vcDNA=SeqID_8754; Strand=-; Position=1-84
  misc_feature (1)..(28): Xaa can be any naturally occurring amino acid
XXXXXXXXXXXXXXXXXXXXXXXXXXXX

SEQ ID NO: 29058 - protein, 130 aa, Diabrotica virgifera
  misc_feature: Coding regions on vcDNA: vcDNA=SeqID_8755; Strand=+; Position=525-914
  misc_feature (49)..(55): Xaa can be any naturally occurring amino acid
  misc_feature (65)..(100): Xaa can be any naturally occurring amino acid
  misc_feature (115)..(123): Xaa can be any naturally occurring amino acid
YKFHTAGTHSTPANLPVRPCPAQLSTRTPLFIYAYYRIKLDVPYSFSSXXXXXXXSTGTPSPPIXXXXXXXXXXXXXXXXXXXXXXXXXXXXXXXXXXXXFFYSPLPPPLQSPLXXXXXXXXXPLPSPPP

SEQ ID NO: 29059 - protein, 78 aa, Diabrotica virgifera
  misc_feature: Coding regions on vcDNA: vcDNA=SeqID_8756; Strand=-; Position=213-449
  misc_feature (20)..(29): Xaa can be any naturally occurring amino acid
YCVRFWVHLYHTQHLNPAVXXXXXXXXXXKLQWFQPSCGSWYEGTQTQKPSEYLHTVKNRVSSPAPYSLTIPPHSFAS

SEQ ID NO: 29060 - protein, 95 aa, Diabrotica virgifera
  misc_feature: Coding regions on vcDNA: vcDNA=SeqID_8757; Strand=-; Position=169-456
  misc_feature (28)..(37): Xaa can be any naturally occurring amino acid
  misc_feature (43)..(50): Xaa can be any naturally occurring amino acid
  misc_feature (79)..(88): Xaa can be any naturally occurring amino acid
CGIGRVSLGFDYESKRPESHGFDSRCKXXXXXXXXXXDCKYIXXXXXXXXNAYLKFLPTIIIVQKSFFLCGIFQCVCVXXXXXXXXXXGIALKIT

SEQ ID NO: 29061 - protein, 70 aa, Diabrotica virgifera
  misc_feature: Coding regions on vcDNA: vcDNA=SeqID_8758; Strand=+; Position=1-210
  misc_feature (26)..(38): Xaa can be any naturally occurring amino acid
  misc_feature (41)..(48): Xaa can be any naturally occurring amino acid
  misc_feature (58)..(69): Xaa can be any naturally occurring amino acid
YLRDNSVILLGEFKSIIKIATSMLDXXXXXXXXXXXXXCSXXXXXXXXSLNRCEPGWXXXXXXXXXXXXK

SEQ ID NO: 29062 - protein, 133 aa, Diabrotica virgifera
  misc_feature: Coding regions on vcDNA: vcDNA=SeqID_8759; Strand=+; Position=472-873
  misc_feature (43)..(51): Xaa can be any naturally occurring amino acid
  misc_feature (72)..(78): Xaa can be any naturally occurring amino acid
  misc_feature (86)..(92): Xaa can be any naturally occurring amino acid
KCSKKFVVIKMTYFVSLSNLNNFIKDKKDSEDLVIKWRDIKWXXXXXXXXXQFSFNSTLDEDSEKYNKNVGXXXXXXXWNFLEIKXXXXXXXIKMWNIYNQLLDSIPPHLPKPQKHNEKSQHPLVESLQRRCQ

SEQ ID NO: 29063 - protein, 46 aa, Diabrotica virgifera
  misc_feature: Coding regions on vcDNA: vcDNA=SeqID_8760; Strand=+; Position=136-276
CYRTNLKSFLLFVCYKWSTISCCRRCKINEINTYIVTRYKTIITMT

SEQ ID NO: 29064 - protein, 79 aa, Diabrotica virgifera
  misc_feature: Coding regions on vcDNA: vcDNA=SeqID_8761; Strand=-; Position=98-337
  misc_feature (5)..(29): Xaa can be any naturally occurring amino acid
  misc_feature (70)..(76): Xaa can be any naturally occurring amino acid
  misc_feature (78)..(79): Xaa can be any naturally occurring amino acid
GAPLXXXXXXXXXXXXXXXXXXXXXXXXXSHPHPIKNLKRAPPFYKKYLLPQFINFNPPWGAPILLSIDXXXXXXXCXX

SEQ ID NO: 29065 - protein, 294 aa, Diabrotica virgifera
  misc_feature: Coding regions on vcDNA: vcDNA=SeqID_8762; Strand=+; Position=3-884
  misc_feature: Homolog annotation: Hit_ID=EAL39934.1; Match level="QueryCoverage =90%, HitCoverage=34%, E-value=2e-45, Identity=37%"; Hit description =ENSANGP00000028171 [Anopheles gambiae str. PEST] ref|XP_556470.1| ENSANGP00000028171 [Anopheles gambiae st
  misc_feature: Pfam annotation: Pfam_ID=RVT_1; Match level="Score=89.1, E-value=1.1e- 23, Copies=1"; Pfam description=Reverse transcriptase (RNA-dependent
  misc_feature (5)..(28): Xaa can be any naturally occurring amino acid
  misc_feature (268)..(268): Xaa can be any naturally occurring amino acid
ILCPXXXXXXXXXXXXXXXXXXXXXXXXILAILIRNKIKTKVENCLGEYQAGFRAQRSVIDQIFAMKQILSSSYEFNLALNMLFIDFKQAYDTIKRSKVYETLEYFEFPPKIVRLTKCILSDTKSKVMIEGRVSDSFITNRGLRQGDPLSTDFFNLILEKIIRECNIYTKGTVYHHRHQCVAYADDITLITRRPAELREIFNRLERTAKEYGLEINEEKTKYMVMKGNENHLGQSFKIQSPSKRYNFEIAGQFDYLGVTLTNRNEENXEIAKRMAKSSKSAGSLNKILRSKIIS

SEQ ID NO: 29066 - protein, 52 aa, Diabrotica virgifera
  misc_feature: Coding regions on vcDNA: vcDNA=SeqID_8763; Strand=+; Position=2-157
  misc_feature (1)..(29): Xaa can be any naturally occurring amino acid
XXXXXXXXXXXXXXXXXXXXXXXXXXXXXVDYVNLVMLIILAVDNGLFSEYI

SEQ ID NO: 29067 - protein, 201 aa, Diabrotica virgifera
  misc_feature: Coding regions on vcDNA: vcDNA=SeqID_8764; Strand=+; Position=2-607
  misc_feature: Homolog annotation: Hit_ID=AAL68373.2; Match level="QueryCoverage =96%, HitCoverage=97%, E-value=1e-31, Identity=39%"; Hit description =SD01117p [Drosophila melanogaster]
  misc_feature: Pfam annotation: Pfam_ID=UPF0172; Match level="Score=171.0, E-value =2.6e-48, Copies=1"; Pfam description=Uncharacterised protein family (UPF01
  misc_feature (179)..(185): Xaa can be any naturally occurring amino acid
IFDSIKMTSIKFTEQAYCKMILHASKYPHCTVNGILLTKSSPNNKEVEFVDCVPLFHVCINLTPMAEIALMQIDEYASKKNLTIAGYYVAPENPRDTSFDKMYNRISDKIASNCSPSYVVIVNSTANTIQRGKIALKVGQYNDGSLKQCDDISVSDDAMNVCISGLNDSLYEKLVDFDXXXXXXXLDWTNSELNKEIHSFL

SEQ ID NO: 29068 - protein, 59 aa, Diabrotica virgifera
  misc_feature: Coding regions on vcDNA: vcDNA=SeqID_8765; Strand=+; Position=22-198
  misc_feature (53)..(59): Xaa can be any naturally occurring amino acid
KTYARPYWGRDHILVPYVKKVSPSHPVLKNILCERIIGERPNPCSKCKKEYCXXXXXXX

SEQ ID NO: 29069 - protein, 143 aa, Diabrotica virgifera
  misc_feature: Coding regions on vcDNA: vcDNA=SeqID_8766; Strand=-; Position=3-431
  misc_feature (6)..(13): Xaa can be any naturally occurring amino acid
  misc_feature (35)..(41): Xaa can be any naturally occurring amino acid
  misc_feature (43)..(116): Xaa can be any naturally occurring amino acid
  misc_feature (118)..(131): Xaa can be any naturally occurring amino acid
  misc_feature (135)..(142): Xaa can be any naturally occurring amino acid
NFKKRXXXXXXXXCYPNYKLLFHHWGSHFLFSIGXXXXXXXVXXXXXXXXXXXXXXXXXXXXXXXXXXXXXXXXXXXXXXXXXXXXXXXXXXXXXXXXXXXXXXXXXXXXXXXXXXEXXXXXXXXXXXXXXPFIXXXXXXXXD

SEQ ID NO: 29070 - protein, 155 aa, Diabrotica virgifera
  misc_feature: Coding regions on vcDNA: vcDNA=SeqID_8767; Strand=-; Position=0-464
RDCVEVQDRISDQDWKRLTVTSITGHPNMMSSIDQNALQSMATRPGWNNHANTEAHESEQNIIRPRGSTSYASGKRSINETGWPGRSGWRMRSGMKLSVGNLMMHSRSRGAGEIIRGFRWGLRPGKEVQCPDPCHPPGVQKILAIMAERRILPFS

SEQ ID NO: 29071 - protein, 47 aa, Diabrotica virgifera
  misc_feature: Coding regions on vcDNA: vcDNA=SeqID_8768; Strand=-; Position=1-141
STTSAIISFISCFSRREVGGARTPQSSSSGGQSPALRLMSLHMGVGF

SEQ ID NO: 29072 - protein, 125 aa, Diabrotica virgifera
  misc_feature: Coding regions on vcDNA: vcDNA=SeqID_8769; Strand=+; Position=203-577
  misc_feature: Homolog annotation: Hit_ID=BAC30271.1; Match level="QueryCoverage =92%, HitCoverage=27%, E-value=1e-17, Identity=35%"; Hit description =unnamed protein product [Mus musculus]
  misc_feature (88)..(88): Xaa can be any naturally occurring amino acid
MFRDLLKCLSVLLYIERPAETTYQDPQAVPEFFHYAWPYFLLFMLIEIIVLYMENEPICRLIDGLTSISHGLIQHSGILLYRVRESHXYYHIHQHLCLIILPWINSMTWDLAARGVDFGYYWGHI

SEQ ID NO: 29073 - protein, 44 aa, Diabrotica virgifera
  misc_feature: Coding regions on vcDNA: vcDNA=SeqID_8770; Strand=+; Position=3-137
  misc_feature (2)..(10): Xaa can be any naturally occurring amino acid
  misc_feature (13)..(13): Xaa can be any naturally occurring amino acid
  misc_feature (22)..(22): Xaa can be any naturally occurring amino acid
  misc_feature (26)..(34): Xaa can be any naturally occurring amino acid
  misc_feature (36)..(43): Xaa can be any naturally occurring amino acid
TXXXXXXXXXDNXDCDLDVGLXFIIXXXXXXXXXFXXXXXXXXS

SEQ ID NO: 29074 - protein, 46 aa, Diabrotica virgifera
  misc_feature: Coding regions on vcDNA: vcDNA=SeqID_8771; Strand=+; Position=636-773
ALALLDEGDTDCKLVAIDDHDPLADDIIVILDEELHFPGLLLASVE

SEQ ID NO: 29075 - protein, 66 aa, Diabrotica virgifera; identical to SEQ ID NO: 26808
  misc_feature: Coding regions on vcDNA: vcDNA=SeqID_8772; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 29076 - protein, 48 aa, Diabrotica virgifera
  misc_feature: Coding regions on vcDNA: vcDNA=SeqID_8773; Strand=-; Position=1-144
  misc_feature (2)..(48): Xaa can be any naturally occurring amino acid
PXXXXXXXXXXXXXXXXXXXXXXXXXXXXXXXXXXXXXXXXXXXXXXX

SEQ ID NO: 29077 - protein, 56 aa, Diabrotica virgifera
  misc_feature: Coding regions on vcDNA: vcDNA=SeqID_8774; Strand=+; Position=1-168
  misc_feature (3)..(56): Xaa can be any naturally occurring amino acid
MRXXXXXXXXXXXXXXXXXXXXXXXXXXXXXXXXXXXXXXXXXXXXXXXXXXXXXX

SEQ ID NO: 29078 - protein, 82 aa, Diabrotica virgifera
  misc_feature: Coding regions on vcDNA: vcDNA=SeqID_8775; Strand=+; Position=874-1119
  misc_feature (3)..(9): Xaa can be any naturally occurring amino acid
  misc_feature (33)..(39): Xaa can be any naturally occurring amino acid
  misc_feature (44)..(67): Xaa can be any naturally occurring amino acid
  misc_feature (75)..(81): Xaa can be any naturally occurring amino acid
KPXXXXXXXLFYLPQLFKTLKGLAPPWGDPLLXXXXXXXFFPIXXXXXXXXXXXXXXXXXXXXXXXXLKIHINSXXXXXXXC

SEQ ID NO: 29079 - protein, 55 aa, Diabrotica virgifera
  misc_feature: Coding regions on vcDNA: vcDNA=SeqID_8776; Strand=-; Position=0-164
  misc_feature (4)..(54): Xaa can be any naturally occurring amino acid
KKLXXXXXXXXXXXXXXXXXXXXXXXXXXXXXXXXXXXXXXXXXXXXXXXXXXXL

SEQ ID NO: 29080 - protein, 346 aa, Diabrotica virgifera
  misc_feature: Coding regions on vcDNA: vcDNA=SeqID_8777; Strand=+; Position=1-1041
  misc_feature (1)..(219): Xaa can be any naturally occurring amino acid
  misc_feature (222)..(222): Xaa can be any naturally occurring amino acid
  misc_feature (224)..(243): Xaa can be any naturally occurring amino acid
  misc_feature (245)..(245): Xaa can be any naturally occurring amino acid
  misc_feature (254)..(277): Xaa can be any naturally occurring amino acid
  misc_feature (279)..(296): Xaa can be any naturally occurring amino acid
  misc_feature (311)..(323): Xaa can be any naturally occurring amino acid
  misc_feature (332)..(342): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGMXRXXXXXXXXXXXXXXXXXXXXLXFFLKTRDPXXXXXXXXXXXXXXXXXXXXXXXXGXXXXXXXXXXXXXXXXXXPPFLVKEKIPFENTXXXXXXXXXXXXXPPPGGVNVXXXXXXXXXXXRPPF

SEQ ID NO: 29081 - protein, 28 aa, Diabrotica virgifera
  misc_feature: Coding regions on vcDNA: vcDNA=SeqID_8778; Strand=-; Position=0-83
  misc_feature (3)..(27): Xaa can be any naturally occurring amino acid
FSXXXXXXXXXXXXXXXXXXXXXXXXXP

SEQ ID NO: 29082 - protein, 49 aa, Diabrotica virgifera
  misc_feature: Coding regions on vcDNA: vcDNA=SeqID_8779; Strand=-; Position=2-148
  misc_feature (22)..(22): Xaa can be any naturally occurring amino acid
  misc_feature (26)..(49): Xaa can be any naturally occurring amino acid
LYPTSSRILLSIDSPINYAVSXGNYXXXXXXXXXXXXXXXXXXXXXXXX

SEQ ID NO: 29083 - protein, 299 aa, Diabrotica virgifera
  misc_feature: Coding regions on vcDNA: vcDNA=SeqID_8780; Strand=+; Position=44-941
  misc_feature: Homolog annotation: Hit_ID=EAL27955.1; Match level="QueryCoverage =91%, HitCoverage=58%, E-value=1e-86, Identity=61%"; Hit description =GA18898-PA [Drosophila pseudoobscura]
  misc_feature: Gene Ontology Annotation: Molecular function=translation factor activity, nucleic acid binding; Cellular component=mitochondrion; Biological process=protein biosynthesis
  misc_feature: Pfam annotation: Pfam_ID=GatB_N; Match level="Score=307.7, E-value =1.9e-89, Copies=1"; Pfam description=PET112 family, N terminal region
  misc_feature (25)..(25): Xaa can be any naturally occurring amino acid
  misc_feature (49)..(73): Xaa can be any naturally occurring amino acid
  misc_feature (232)..(232): Xaa can be any naturally occurring amino acid
  misc_feature (252)..(252): Xaa can be any naturally occurring amino acid
  misc_feature (254)..(254): Xaa can be any naturally occurring amino acid
  misc_feature (269)..(269): Xaa can be any naturally occurring amino acid
  misc_feature (273)..(273): Xaa can be any naturally occurring amino acid
  misc_feature (277)..(277): Xaa can be any naturally occurring amino acid
  misc_feature (282)..(282): Xaa can be any naturally occurring amino acid
MVLKKASKYFMKLGVAKRRVSQVSXVVGLEVHAQINSASKLFSGASTKXXXXXXXXXXXXXXXXXXXXXXXXXRCVEAGVLTALSLNCKVNPISYFDRKHYFYADLPTGYQITQQRQPLAVGGHLEFQVFTPGVHKAPYTTNVKIKQLQLEQDSGKSLHDEQRSFVDLNRAGVPLMELVFDPDLKDGEEAAALVKELISILQRIQTCSCKMEEGALRVDANVSIHKESEPLXTRTEIKNIGSVRGVAGAIVXEXRQIKLKEAGQTIANXTRAXDASXKTTVXMRDKEVQQDYRYMPEPK

SEQ ID NO: 29084 - protein, 81 aa, Diabrotica virgifera
  misc_feature: Coding regions on vcDNA: vcDNA=SeqID_8781; Strand=+; Position=1-243
  misc_feature (1)..(79): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXWG

SEQ ID NO: 29085 - protein, 64 aa, Diabrotica virgifera
  misc_feature: Coding regions on vcDNA: vcDNA=SeqID_8782; Strand=+; Position=3-197
  misc_feature: Homolog annotation: Hit_ID=XP_320584.1; Match level="QueryCoverage =95%, HitCoverage=5%, E-value=9e-12, Identity=54%"; Hit description =ENSANGP00000015265 [Anopheles gambiae]
  misc_feature: Pfam annotation: Pfam_ID=LRR_1; Match level="Score=22.8, E-value =0.001, Copies=2"; Pfam description=Leucine Rich Repeat
LMGHSTLEQLNLGYNQLQMIDKEAFIGMPALRDLILTNNSIADTRRAPFWNLPALKACILSKII

SEQ ID NO: 29086 - protein, 102 aa, Diabrotica virgifera
  misc_feature: Coding regions on vcDNA: vcDNA=SeqID_8783; Strand=-; Position=3-308
  misc_feature (2)..(22): Xaa can be any naturally occurring amino acid
  misc_feature (64)..(64): Xaa can be any naturally occurring amino acid
  misc_feature (79)..(92): Xaa can be any naturally occurring amino acid
  misc_feature (94)..(95): Xaa can be any naturally occurring amino acid
  misc_feature (97)..(97): Xaa can be any naturally occurring amino acid
  misc_feature (99)..(99): Xaa can be any naturally occurring amino acid
  misc_feature (102)..(102): Xaa can be any naturally occurring amino acid
RXXXXXXXXXXXXXXXXXXXXXLPPTRKFKADRINNNCSPIKTLSHLGPHLISIDLPNKIRCIXKVFILYPKNGSKIYXXXXXXXXXXXXXXPXXIXLXYNX

SEQ ID NO: 29087 - protein, 266 aa, Diabrotica virgifera
  misc_feature: Coding regions on vcDNA: vcDNA=SeqID_8784; Strand=-; Position=18-818
  misc_feature (2)..(19): Xaa can be any naturally occurring amino acid
  misc_feature (25)..(31): Xaa can be any naturally occurring amino acid
  misc_feature (37)..(52): Xaa can be any naturally occurring amino acid
  misc_feature (62)..(72): Xaa can be any naturally occurring amino acid
  misc_feature (74)..(86): Xaa can be any naturally occurring amino acid
  misc_feature (91)..(226): Xaa can be any naturally occurring amino acid
  misc_feature (238)..(244): Xaa can be any naturally occurring amino acid
KXXXXXXXXXXXXXXXXXXPFISHXXXXXXXGFWCLXXXXXXXXXXXXXXXXEALYFNAKRXXXXXXXXXXXAXXXXXXXXXXXXXQFFNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIHIGTKEIKFSXXXXXXXASIQYCHLMTLILFLKTGKVRS

SEQ ID NO: 29088 - protein, 99 aa, Diabrotica virgifera
  misc_feature: Coding regions on vcDNA: vcDNA=SeqID_8785; Strand=+; Position=407-706
  misc_feature (88)..(97): Xaa can be any naturally occurring amino acid
LELNCEIDLIHIHMQIHPYDVILYLTYDYLVVGIDLLLTDMIRAIQIVPNDREDHDHIVVYIVRVYTSDRGIAAHIVALLITNMTFCXXXXXXXXXXVI

SEQ ID NO: 29089 - protein, 108 aa, Diabrotica virgifera; identical to SEQ ID NO: 27732
  misc_feature: Coding regions on vcDNA: vcDNA=SeqID_8786; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 29090 - protein, 48 aa, Diabrotica virgifera
  misc_feature: Coding regions on vcDNA: vcDNA=SeqID_8787; Strand=+; Position=1-144
  misc_feature (3)..(25): Xaa can be any naturally occurring amino acid
  misc_feature (28)..(47): Xaa can be any naturally occurring amino acid
IIXXXXXXXXXXXXXXXXXXXXXXXRDXXXXXXXXXXXXXXXXXXXXL

SEQ ID NO: 29091 - protein, 277 aa, Diabrotica virgifera
  misc_feature: Coding regions on vcDNA: vcDNA=SeqID_8788; Strand=+; Position=73-903
  misc_feature: Homolog annotation: Hit_ID=EAL39100.1; Match level="QueryCoverage =87%, HitCoverage=36%, E-value=9e-10, Identity=28%"; Hit description =ENSANGP00000026588 [Anopheles gambiae str. PEST] ref|XP_553274.1| ENSANGP00000026588 [Anopheles gambiae st
MKVTVLQIVVSALLIASTKCLQQDSIPNKISPEDVNFLVEPIPEAKHDSPPPFSFVNTVKEVENMIISNPKLPRLTRGEIIDLLENITKADNTFTILQQASLIPENHRAPKAVMKVLPITPDAANTNNVEELYTKRPVTQIVDYNHIGQGSDDSVFMDFDVPKVQFDPVPANEEYKPITVEENFNGNPFNVPNPTYKRKTTTSTTTTSTTAATTSDPTRHYFVERKPQGLRRKTTTTTATTVSPSVSTHRQRSRKPMRHRTTTRTTRHPNHRYEDEH

SEQ ID NO: 29092 - protein, 45 aa, Diabrotica virgifera
  misc_feature: Coding regions on vcDNA: vcDNA=SeqID_8789; Strand=+; Position=1-135
  misc_feature (1)..(44): Xaa can be any naturally occurring amino acid
XXXXXXXXXXXXXXXXXXXXXXXXXXXXXXXXXXXXXXXXXXXXA

SEQ ID NO: 29093 - protein, 255 aa, Diabrotica virgifera
  misc_feature: Coding regions on vcDNA: vcDNA=SeqID_8790; Strand=-; Position=1-765
  misc_feature (5)..(197): Xaa can be any naturally occurring amino acid
  misc_feature (201)..(238): Xaa can be any naturally occurring amino acid
  misc_feature (241)..(255): Xaa can be any naturally occurring amino acid
YRVSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFRXXXXXXXXXXXXXXXXXXXXXXXXXXXXXXXXXXXXXXEVXXXXXXXXXXXXXXX

SEQ ID NO: 29094 - protein, 110 aa, Diabrotica virgifera
  misc_feature: Coding regions on vcDNA: vcDNA=SeqID_8791; Strand=+; Position=339-671
MGKCPYLENKLATSEGFEPTEVEYAKCPFLQGEIMKYSENNALEQSTSDDKNLFCGLVIHKDATYEGMLTAKKLGEKLANNLIAKGALEVMSKAQAIIHNQQSVPPVTSS

SEQ ID NO: 29095 - protein, 94 aa, Diabrotica virgifera
  misc_feature: Coding regions on vcDNA: vcDNA=SeqID_8792; Strand=-; Position=50-334
  misc_feature (75)..(82): Xaa can be any naturally occurring amino acid
LDLLKNKLYTNVDLIEYYGLSSFIYTISIMNDHFMIVQLFQHFFINITTRRCYNIGIYHFRSHLEYPSQNMISLXXXXXXXXVRKREPLQNGEG

SEQ ID NO: 29096 - protein, 29 aa, Diabrotica virgifera
  misc_feature: Coding regions on vcDNA: vcDNA=SeqID_8793; Strand=-; Position=14-103
NKKNLKTDQQRRTTKLLMSNNYSIIIFLS

SEQ ID NO: 29097 - protein, 200 aa, Diabrotica virgifera
  misc_feature: Coding regions on vcDNA: vcDNA=SeqID_8794; Strand=+; Position=101-703
  misc_feature (3)..(14): Xaa can be any naturally occurring amino acid
  misc_feature (18)..(26): Xaa can be any naturally occurring amino acid
  misc_feature (30)..(42): Xaa can be any naturally occurring amino acid
  misc_feature (52)..(84): Xaa can be any naturally occurring amino acid
  misc_feature (92)..(158): Xaa can be any naturally occurring amino acid
  misc_feature (161)..(169): Xaa can be any naturally occurring amino acid
  misc_feature (189)..(197): Xaa can be any naturally occurring amino acid
YIXXXXXXXXXXXXPGSXXXXXXXXXIKEXXXXXXXXXXXXXEVFVYILFLXXXXXXXXXXXXXXXXXXXXXXXXXXXXXXXXXDKIFYLKXXXXXXXXXXXXXXXXXXXXXXXXXXXXXXXXXXXXXXXXXXXXXXXXXXXXXXXXXXXXXXXXXXXKVXXXXXXXXXAVFDRARYIILVFFEVDEGXXXXXXXXXDLF

SEQ ID NO: 29098 - protein, 25 aa, Diabrotica virgifera
  misc_feature: Coding regions on vcDNA: vcDNA=SeqID_8795; Strand=-; Position=0-74
  misc_feature (3)..(23): Xaa can be any naturally occurring amino acid
KNXXXXXXXXXXXXXXXXXXXXXTP

SEQ ID NO: 29099 - protein, 243 aa, Diabrotica virgifera
  misc_feature: Coding regions on vcDNA: vcDNA=SeqID_8796; Strand=+; Position=155-883
  misc_feature: Homolog annotation: Hit_ID=XP_394381.1; Match level="QueryCoverage =91%, HitCoverage=69%, E-value=5e-63, Identity=47%"; Hit description =similar to ENSANGP00000002356 [Apis mellifera]
  misc_feature: Gene Ontology Annotation: Molecular function=sodium/potassium -exchanging ATPase activity; Cellular component=integral to membrane; Biological process=transport
  misc_feature: Pfam annotation: Pfam_ID=Na_K-ATPase; Match level="Score=-26.9, E -value=1.2e-11, Copies=1"; Pfam description=Sodium / potassium ATPase beta chain
  misc_feature (117)..(122): Xaa can be any naturally occurring amino acid
  misc_feature (181)..(181): Xaa can be any naturally occurring amino acid
  misc_feature (213)..(213): Xaa can be any naturally occurring amino acid
  misc_feature (215)..(215): Xaa can be any naturally occurring amino acid
  misc_feature (221)..(221): Xaa can be any naturally occurring amino acid
  misc_feature (228)..(236): Xaa can be any naturally occurring amino acid
  misc_feature (239)..(239): Xaa can be any naturally occurring amino acid
MTMQQPSDYYDRENNRFIRRVYQKKQGLILGRKGPELAKIGLFYLIFYGMLAALVAVCMWVFFQTLDPRIPKWQLDESLIGTNPGLGFRPMPEKNEESTLIWFQGSNKTSYSYWVEXXXXXXDKYYVPSKIAKGNGQIKTCSHHDYPTSGEVCEVDVRDWEECNRDQFFNYHKNSPCIFIXLNKIYNWEPMYYDDPYDLPEEMPDNLKQHIRXIXNTRELXNVWVSCXXXXXXXXXYLXPITY

SEQ ID NO: 29100 - protein, 116 aa, Diabrotica virgifera
  misc_feature: Coding regions on vcDNA: vcDNA=SeqID_8797; Strand=+; Position=89-439
  misc_feature: Homolog annotation: Hit_ID=BAB88642.1; Match level="QueryCoverage =97%, HitCoverage=37%, E-value=4e-24, Identity=49%"; Hit description =NADH dehydrogenase subunit 5 [Leptura aethiops]
  misc_feature: Pfam annotation: Pfam_ID=NADH5_C; Match level="Score=-62.3, E-value =0.0017, Copies=1"; Pfam description=NADH dehydrogenase subunit 5 C -terminu
  misc_feature (39)..(39): Xaa can be any naturally occurring amino acid
  misc_feature (51)..(58): Xaa can be any naturally occurring amino acid
  misc_feature (67)..(67): Xaa can be any naturally occurring amino acid
  misc_feature (89)..(95): Xaa can be any naturally occurring amino acid
  misc_feature (97)..(97): Xaa can be any naturally occurring amino acid
  misc_feature (115)..(115): Xaa can be any naturally occurring amino acid
TGRFNYLALNILSETGYLILKGIRGLILFVVFSGRLFSXLVFSTPIFICLXXXXXXXXLIFIIVGVXLGYELAKFKISYNLLRLNNISXXXXXXXIXNIPFLSTLGINYYPIYFXG

SEQ ID NO: 29101 - protein, 244 aa, Diabrotica virgifera
  misc_feature: Coding regions on vcDNA: vcDNA=SeqID_8798; Strand=+; Position=1-732
  misc_feature (1)..(243): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXL

SEQ ID NO: 29102 - protein, 87 aa, Diabrotica virgifera
  misc_feature: Coding regions on vcDNA: vcDNA=SeqID_8799; Strand=+; Position=111-374
  misc_feature: Homolog annotation: Hit_ID=EAA03636.3; Match level="QueryCoverage =82%, HitCoverage=96%, E-value=4e-30, Identity=76%"; Hit description =ENSANGP00000018659 [Anopheles gambiae str. PEST] ref|XP_560418.1| ENSANGP00000018659 [Anopheles gambiae st
  misc_feature: Gene Ontology Annotation: Molecular function=molecular_function unknown; Cellular component=cellular_component unknown; Biological process=regulation of cell cycle
  misc_feature: Pfam annotation: Pfam_ID=CKS; Match level="Score=180.2, E-value=4.5e -51, Copies=1"; Pfam description=Cyclin-dependent kinase regulatory su
MASMSREELINSIYYSDKYYDDVFEYRHVVLPKEMVSVVPKTHLMSEDEWRGIGVQQSKGWVHYMIHLPEPHILLFKRPITTPPPSQ

SEQ ID NO: 29103 - protein, 126 aa, Diabrotica virgifera
  misc_feature: Coding regions on vcDNA: vcDNA=SeqID_8800; Strand=-; Position=1-378
  misc_feature (3)..(12): Xaa can be any naturally occurring amino acid
  misc_feature (18)..(35): Xaa can be any naturally occurring amino acid
  misc_feature (40)..(51): Xaa can be any naturally occurring amino acid
  misc_feature (62)..(126): Xaa can be any naturally occurring amino acid
KRXXXXXXXXXXSRVFVXXXXXXXXXXXXXXXXXXKLNKXXXXXXXXXXXXFHKKTKIMLPXXXXXXXXXXXXXXXXXXXXXXXXXXXXXXXXXXXXXXXXXXXXXXXXXXXXXXXXXXXXXXXXX

SEQ ID NO: 29104 - protein, 121 aa, Diabrotica virgifera
  misc_feature: Coding regions on vcDNA: vcDNA=SeqID_8801; Strand=-; Position=1-363
  misc_feature (6)..(11): Xaa can be any naturally occurring amino acid
  misc_feature (26)..(39): Xaa can be any naturally occurring amino acid
  misc_feature (41)..(73): Xaa can be any naturally occurring amino acid
  misc_feature (76)..(84): Xaa can be any naturally occurring amino acid
MNVIYXXXXXXDVKGKSISLQKDYVXXXXXXXXXXXXXXLXXXXXXXXXXXXXXXXXXXXXXXXXXXXXXXXXPIXXXXXXXXXFLTFTKKYFSISNINAGREGGAAGEFRAGSRRASQLS

SEQ ID NO: 29105 - protein, 45 aa, Diabrotica virgifera
  misc_feature: Coding regions on vcDNA: vcDNA=SeqID_8802; Strand=-; Position=272-409
LSPIYTKILNLYIISGIFILSTLSTFDIYTWHVFTYAILYLVFFT

SEQ ID NO: 29106 - protein, 183 aa, Diabrotica virgifera
  misc_feature: Coding regions on vcDNA: vcDNA=SeqID_8803; Strand=+; Position=1-553
  misc_feature: Homolog annotation: Hit_ID=NP_503526.1; Match level="QueryCoverage =71%, HitCoverage=34%, E-value=4e-14, Identity=33%"; Hit description =predicted CDS, reverse transcriptase family member (5C378) [Caenorhabditis elegans]
  misc_feature (108)..(108): Xaa can be any naturally occurring amino acid
ASSYWDFPSDFAILFTVDTVDTLETVAILKALSEFKIDHRYANIIRKIYENATTTISHHCMTENTKIGREVRQGDTVSPKLFISVMEYIFQRLECDSKGIDIDGNLLXFSDGILLLTDDLKEARVMLVQLQQVTQRVGLKINYRKTKMMTNLVPNDLTDIKKSPIQLVYLDIHMCIWITKTWD

SEQ ID NO: 29107 - protein, 24 aa, Diabrotica virgifera
  misc_feature: Coding regions on vcDNA: vcDNA=SeqID_8804; Strand=-; Position=2-73
PYYFFSPIYLNQNMILYRCEPGWF

SEQ ID NO: 29108 - protein, 28 aa, Diabrotica virgifera
  misc_feature: Coding regions on vcDNA: vcDNA=SeqID_8805; Strand=+; Position=1-84
  misc_feature (5)..(22): Xaa can be any naturally occurring amino acid
LHYLXXXXXXXXXXXXXXXXXXYRVNKG

SEQ ID NO: 29109 - protein, 37 aa, Diabrotica virgifera
  misc_feature: Coding regions on vcDNA: vcDNA=SeqID_8806; Strand=+; Position=1-111
  misc_feature (2)..(33): Xaa can be any naturally occurring amino acid
  misc_feature (37)..(37): Xaa can be any naturally occurring amino acid
LXXXXXXXXXXXXXXXXXXXXXXXXXXXXXXXXLFIX

SEQ ID NO: 29110 - protein, 30 aa, Diabrotica virgifera
  misc_feature: Coding regions on vcDNA: vcDNA=SeqID_8807; Strand=-; Position=30-122
KCHYYKNKISHHGSNQLSIKKNLSTFTKKS

SEQ ID NO: 29111 - protein, 102 aa, Diabrotica virgifera
  misc_feature: Coding regions on vcDNA: vcDNA=SeqID_8808; Strand=+; Position=154-462
  misc_feature (51)..(57): Xaa can be any naturally occurring amino acid
EKQVVVFATSLNMYLEPDPEIKRNVIHNLNQEYGKALLDVNKCLELRNKLXXXXXXXEEQLDISNSKFTIGASIKEGEVFLQNTADVVNRSKDVVSDIKTVL

SEQ ID NO: 29112 - protein, 102 aa, Diabrotica virgifera
  misc_feature: Coding regions on vcDNA: vcDNA=SeqID_8809; Strand=-; Position=1-309
CLVNRVYRIRDHVAFSPNGRQRIQRGSGKMRPHRLPAIWIADSPSGGGPCFSGRASPSSYDNLIVNCCCSVQLALLLFLDSNRKEVKMVIKRRVKLKYRVIR

SEQ ID NO: 29113 - protein, 49 aa, Diabrotica virgifera
  misc_feature: Coding regions on vcDNA: vcDNA=SeqID_8810; Strand=-; Position=1-147
KCETLTIYGYSKEMHFILKSNFCESRLSVNLSLLRYAQKVKHTLLGGWA

SEQ ID NO: 29114 - protein, 84 aa, Diabrotica virgifera
  misc_feature: Coding regions on vcDNA: vcDNA=SeqID_8811; Strand=+; Position=12-266
  misc_feature (27)..(33): Xaa can be any naturally occurring amino acid
EGTMVSRLVLALVFLIIFVDAEYAIIXXXXXXXIAPYGSWSDQDILISCSVSIIIDLKKDKLFCLIKIHDILFTWNSVVMLLYI

SEQ ID NO: 29115 - protein, 69 aa, Diabrotica virgifera
  misc_feature: Coding regions on vcDNA: vcDNA=SeqID_8812; Strand=-; Position=61-270
IKWYSFPLLCASISSISTVTSFYAVSSRSYHTARSSGALWFTYRRSSESMLIIRYLIQDELRKYSNTFS

SEQ ID NO: 29116 - protein, 273 aa, Diabrotica virgifera
  misc_feature: Coding regions on vcDNA: vcDNA=SeqID_8813; Strand=-; Position=1-819
  misc_feature (1)..(256): Xaa can be any naturally occurring amino acid
  misc_feature (259)..(273): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 29117 - protein, 57 aa, Diabrotica virgifera
  misc_feature: Coding regions on vcDNA: vcDNA=SeqID_8814; Strand=-; Position=235-408
  misc_feature (5)..(13): Xaa can be any naturally occurring amino acid
  misc_feature (37)..(48): Xaa can be any naturally occurring amino acid
  misc_feature (50)..(56): Xaa can be any naturally occurring amino acid
HITFXXXXXXXXXEYIITYTKIRNIFYRNSYLKITFXXXXXXXXXXXXIXXXXXXXI

SEQ ID NO: 29118 - protein, 75 aa, Diabrotica virgifera
  misc_feature: Coding regions on vcDNA: vcDNA=SeqID_8815; Strand=+; Position=94-321
  misc_feature: Homolog annotation: Hit_ID=CAE69100.1; Match level="QueryCoverage =68%, HitCoverage=53%, E-value=3e-19, Identity=70%"; Hit description =Hypothetical protein CBG15126 [Caenorhabditis briggsae]
  misc_feature: Gene Ontology Annotation: Molecular function=structural molecule activity; Cellular component=intermediate filament; Biological process=cytoskeleton organization and biogenesis
  misc_feature: Pfam annotation: Pfam_ID=Collagen; Match level="Score=-48.6, E-value =0.093, Copies=1"; Pfam description=Collagen triple helix repeat (20 copi
MFKFLIISIVVTIVYGKPGGLGYGGYGGSGGYGGYGGYGGYGGYGGYGGYGGHGGHGGYGGYGGYVCNCCYRCKQ

SEQ ID NO: 29119 - protein, 58 aa, Diabrotica virgifera
  misc_feature: Coding regions on vcDNA: vcDNA=SeqID_8816; Strand=-; Position=335-511
YMDDNSSIREYNYLHLCISNSIVEHMKLFTRSCLFNIRVIIHMMLCQLMLQEYYMFII

SEQ ID NO: 29120 - protein, 64 aa, Diabrotica virgifera
  misc_feature: Coding regions on vcDNA: vcDNA=SeqID_8817; Strand=-; Position=3-194
  misc_feature (2)..(9): Xaa can be any naturally occurring amino acid
  misc_feature (12)..(52): Xaa can be any naturally occurring amino acid
PXXXXXXXXIYXXXXXXXXXXXXXXXXXXXXXXXXXXXXXXXXXXXXXXXXXPLHSTFNKKLND

SEQ ID NO: 29121 - protein, 290 aa, Diabrotica virgifera
  misc_feature: Coding regions on vcDNA: vcDNA=SeqID_8818; Strand=+; Position=2-870
  misc_feature: Homolog annotation: Hit_ID=XP_311407.1; Match level="QueryCoverage =100%, HitCoverage=29%, E-value=1e-112, Identity=65%"; Hit description=ENSANGP00000016784 [Anopheles gambiae]
  misc_feature: Gene Ontology Annotation: Molecular function=signal transducer activity; Cellular component=small nucleolar ribonucleoprotein complex; Biological process=signal transduction
  misc_feature: Pfam annotation: Pfam_ID=WD40; Match level="Score=54.4, E-value=3.3e -13, Copies=2"; Pfam description=WD domain, G-beta repeat
  misc_feature (254)..(254): Xaa can be any naturally occurring amino acid
SSLDSTVRAFDIIRYRNFRTFTSTRPVQFACVAVDSSGEFVAAGGQDVFEIYLWSVKTGRLLEILAGHEGPVSSLVFSPTLTSTVLVSVSWDKTMKIWDAIEKGSAHETIELTADGICTAFKPDGQEVAVATLNGQITVFNVKTSTQVSLIEGRNDLGSGIAETDLVTAKQTLKAKSFTSLCWSADGESLIAGGQSKNVCIYSVSEGLIVKKFEITQNRSLDAVDDFINRRKLTEFDNIALVEEREEREGGNVXLKLPGVRKGDMAARSIKPEVRVFSLQFSPTGQTWAA

SEQ ID NO: 29122 - protein, 66 aa, Diabrotica virgifera; identical to SEQ ID NO: 26808
  misc_feature: Coding regions on vcDNA: vcDNA=SeqID_8819; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 29123 - protein, 95 aa, Diabrotica virgifera
  misc_feature: Coding regions on vcDNA: vcDNA=SeqID_8820; Strand=+; Position=216-503
  misc_feature (26)..(42): Xaa can be any naturally occurring amino acid
  misc_feature (73)..(79): Xaa can be any naturally occurring amino acid
NAIRSQRDPLFYEIKQIYESAPDSEXXXXXXXXXXXXXXXXXHKILLTLTCYTKMTTKNSHTFSYAVINFYLXXXXXXXKSPITLYISIISTEKR

SEQ ID NO: 29124 - protein, 30 aa, Diabrotica virgifera
  misc_feature: Coding regions on vcDNA: vcDNA=SeqID_8821; Strand=-; Position=0-89
  misc_feature (2)..(29): Xaa can be any naturally occurring amino acid
SXXXXXXXXXXXXXXXXXXXXXXXXXXXXP

SEQ ID NO: 29125 - protein, 103 aa, Diabrotica virgifera
  misc_feature: Coding regions on vcDNA: vcDNA=SeqID_8822; Strand=+; Position=386-697
  misc_feature (17)..(17): Xaa can be any naturally occurring amino acid
  misc_feature (20)..(26): Xaa can be any naturally occurring amino acid
  misc_feature (35)..(52): Xaa can be any naturally occurring amino acid
  misc_feature (56)..(69): Xaa can be any naturally occurring amino acid
  misc_feature (80)..(80): Xaa can be any naturally occurring amino acid
  misc_feature (90)..(99): Xaa can be any naturally occurring amino acid
  misc_feature (103)..(103): Xaa can be any naturally occurring amino acid
MVLYSMRSYSLILLRFXVCXXXXXXXGKLYKYGIXXXXXXXXXXXXXXXXXXVFSXXXXXXXXXXXXXXLVPVLLLIIGXGYQPERLEAXXXXXXXXXXISLX

SEQ ID NO: 29126 - protein, 203 aa, Diabrotica virgifera
  misc_feature: Coding regions on vcDNA: vcDNA=SeqID_8823; Strand=+; Position=86-695
  misc_feature: Homolog annotation: Hit_ID=NP_663622.1; Match level="QueryCoverage =97%, HitCoverage=22%, E-value=5e-22, Identity=28%"; Hit description =unknown MGC21654 product [Homo sapiens] dbj|BAB71182.1| unnamed protein product [Homo sapiens]
  misc_feature (163)..(163): Xaa can be any naturally occurring amino acid
SFKDIIKRAEFITNDLDGGDNKILAILSGQGILYFLNTEEDKILSQLQCDIEINRFVCTPNGTHAICNIQQYLSPPVEIRVQKVRKKFLINRKRSLAEVQFVKQEIDSILDIKKLKFILKEYGEYPENYRIKIWERLLDLPNNVGSYNNVINHKTIIAFVDLXKKYPLEDKLFLTSLKKLLSNLVTWCPFFANVEYLPVFVFP

SEQ ID NO: 29127 - protein, 254 aa, Diabrotica virgifera
  misc_feature: Coding regions on vcDNA: vcDNA=SeqID_8824; Strand=-; Position=0-761
  misc_feature (8)..(251): Xaa can be any naturally occurring amino acid
HPTLPSSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTVG

SEQ ID NO: 29128 - protein, 39 aa, Diabrotica virgifera
  misc_feature: Coding regions on vcDNA: vcDNA=SeqID_8825; Strand=-; Position=1-117
  misc_feature (4)..(36): Xaa can be any naturally occurring amino acid
QKKXXXXXXXXXXXXXXXXXXXXXXXXXXXXXXXXXLKN

SEQ ID NO: 29129 - protein, 46 aa, Diabrotica virgifera
  misc_feature: Coding regions on vcDNA: vcDNA=SeqID_8826; Strand=+; Position=64-201
GDRLRPYLACETLNPHSAYCGAMIGKPRERGGRKEEPSSSIPKSSS

SEQ ID NO: 29130 - protein, 32 aa, Diabrotica virgifera
  misc_feature: Coding regions on vcDNA: vcDNA=SeqID_8827; Strand=-; Position=0-95
  misc_feature (1)..(27): Xaa can be any naturally occurring amino acid
XXXXXXXXXXXXXXXXXXXXXXXXXXXPFHPA

SEQ ID NO: 29131 - protein, 28 aa, Diabrotica virgifera
  misc_feature: Coding regions on vcDNA: vcDNA=SeqID_8828; Strand=-; Position=1-84
  misc_feature (2)..(8): Xaa can be any naturally occurring amino acid
  misc_feature (12)..(20): Xaa can be any naturally occurring amino acid
  misc_feature (23)..(28): Xaa can be any naturally occurring amino acid
NXXXXXXXLKNXXXXXXXXXFSXXXXXX

SEQ ID NO: 29132 - protein, 18 aa, Diabrotica virgifera
  misc_feature: Coding regions on vcDNA: vcDNA=SeqID_8829; Strand=-; Position=1-54
LKSSYLIFSGYKIARTRG

SEQ ID NO: 29133 - protein, 59 aa, Diabrotica virgifera
  misc_feature: Coding regions on vcDNA: vcDNA=SeqID_8830; Strand=+; Position=274-453
QLVESSGTVFVSAACLCVSEKDNTNNFVKFTFFPKVKLYSFRNDLCLSTKTFRNDPPLY

SEQ ID NO: 29134 - protein, 65 aa, Diabrotica virgifera
  misc_feature: Coding regions on vcDNA: vcDNA=SeqID_8831; Strand=+; Position=89-286
  misc_feature (1)..(9): Xaa can be any naturally occurring amino acid
XXXXXXXXXVKCFSTLKISQCSKIYSIFYILTDISKINNFTLIDLKNPPCTPFLLKSPLTLSFTA

SEQ ID NO: 29135 - protein, 161 aa, Diabrotica virgifera
  misc_feature: Coding regions on vcDNA: vcDNA=SeqID_8832; Strand=+; Position=38-523
MLSSKVSTCTRTTKSTKDHQIKPSVPSVLEGIEVIKKSKKPMRSKHLRHSDVLDQEVDHGNESQPSTVVSALTQQNAKDLLQSVKASAFDRTREYGSQKSMVESKESVLGTKEIISEEFDSNYLLPPTRTVLPKASTCKITVSETKGNVDNAISEEELSKL

SEQ ID NO: 29136 - protein, 37 aa, Diabrotica virgifera
  misc_feature: Coding regions on vcDNA: vcDNA=SeqID_8833; Strand=-; Position=45-158
  misc_feature (5)..(5): Xaa can be any naturally occurring amino acid
FIKIXNNINTYTQILNINLPHFLNNNINFIINTLTIN

SEQ ID NO: 29137 - protein, 64 aa, Diabrotica virgifera
  misc_feature: Coding regions on vcDNA: vcDNA=SeqID_8834; Strand=+; Position=2-196
  misc_feature (5)..(22): Xaa can be any naturally occurring amino acid
  misc_feature (27)..(43): Xaa can be any naturally occurring amino acid
FQRIXXXXXXXXXXXXXXXXXXIVFQXXXXXXXXXXXXXXXXXVLYCYVILSLINGKFTVYFDI

SEQ ID NO: 29138 - protein, 312 aa, Diabrotica virgifera
  misc_feature: Coding regions on vcDNA: vcDNA=SeqID_8835; Strand=-; Position=3-937
  misc_feature: Homolog annotation: Hit_ID=AAF87760.1; Match level="QueryCoverage =100%, HitCoverage=70%, E-value=1e-128, Identity=76%"; Hit description=cytochrome oxidase subunit I [Diabrotica virgifera zeae]
  misc_feature: Pfam annotation: Pfam_ID=COX1; Match level="Score=122.7, E-value=9.1e- 34, Copies=1"; Pfam description=Cytochrome C and Quinol oxidase polyp
  misc_feature (7)..(7): Xaa can be any naturally occurring amino acid
  misc_feature (11)..(11): Xaa can be any naturally occurring amino acid
  misc_feature (20)..(20): Xaa can be any naturally occurring amino acid
  misc_feature (33)..(39): Xaa can be any naturally occurring amino acid
  misc_feature (58)..(58): Xaa can be any naturally occurring amino acid
  misc_feature (71)..(71): Xaa can be any naturally occurring amino acid
  misc_feature (88)..(88): Xaa can be any naturally occurring amino acid
  misc_feature (123)..(123): Xaa can be any naturally occurring amino acid
  misc_feature (140)..(140): Xaa can be any naturally occurring amino acid
  misc_feature (143)..(149): Xaa can be any naturally occurring amino acid
  misc_feature (196)..(196): Xaa can be any naturally occurring amino acid
  misc_feature (203)..(219): Xaa can be any naturally occurring amino acid
  misc_feature (250)..(250): Xaa can be any naturally occurring amino acid
  misc_feature (266)..(273): Xaa can be any naturally occurring amino acid
  misc_feature (294)..(294): Xaa can be any naturally occurring amino acid
VLAGAIXILLXDRNLNTSFXDPAGGGDPILYQXXXXXXXHPEVYILILPGFGLISHMXRQERRKKEAFGTXGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAHFHYVLSIGAVFAIIAGFIQXFPLFTGXXXXXXXXXXXXXXXXXGVNLTFFPQHFLGLIGIPRRYSDYPDVFILXNIVSSIGSLISLIGVXXXXXXXXEAFSFQRKRLRPLRITSSIEXLQFNPPAEHRYSELPILS

SEQ ID NO: 29139 - protein, 136 aa, Diabrotica virgifera
  misc_feature: Coding regions on vcDNA: vcDNA=SeqID_8836; Strand=+; Position=512-919
  misc_feature: Homolog annotation: Hit_ID=XP_394650.1; Match level="QueryCoverage =77%, HitCoverage=36%, E-value=6e-43, Identity=75%"; Hit description =similar to CG33202-PB [Apis mellifera]
  misc_feature: Pfam annotation: Pfam_ID=I-set; Match level="Score=-13.5, E-value =0.012, Copies=1"; Pfam description=Immunoglobulin I-set domain
  misc_feature (109)..(109): Xaa can be any naturally occurring amino acid
  misc_feature (127)..(127): Xaa can be any naturally occurring amino acid
MESSRLLIYTLWMLIFPELFTVFHEGEAAYAVKRFTGLYTGPYFDPTTTTNITTQLGTHAYIPCKIKQLGNKSVSWIRRRDAHILTVDRYTFIADDRFSAFFVEATDTXTLQVKYVQARDAGQYECXVSTDPKMSH

SEQ ID NO: 29140 - protein, 272 aa, Diabrotica virgifera
  misc_feature: Coding regions on vcDNA: vcDNA=SeqID_8837; Strand=+; Position=41-856
  misc_feature: Homolog annotation: Hit_ID=EAA00192.2; Match level="QueryCoverage =91%, HitCoverage=47%, E-value=1e-46, Identity=36%"; Hit description =ENSANGP00000008929 [Anopheles gambiae str. PEST] ref|XP_551801.1| ENSANGP00000008929 [Anopheles gambiae st
  misc_feature: Gene Ontology Annotation: Molecular function=cation transporter activity; Cellular component=integral to plasma membrane; Biological process=cation transport
  misc_feature (228)..(228): Xaa can be any naturally occurring amino acid
  misc_feature (243)..(243): Xaa can be any naturally occurring amino acid
  misc_feature (247)..(247): Xaa can be any naturally occurring amino acid
  misc_feature (264)..(264): Xaa can be any naturally occurring amino acid
MKNKEEEDPVDLIFKDASMCSKYVIFMFLSLGFLAAYSGCVFTYVFLARDVKYRCLIEECEPSPTDTIYEPKWLKRLVPYTGSVPDSCHRYALRNDSCSTEATSGNNETFRCDKFVYQTKDVTLVHDFDLNCDENAWKLTMVGTISMTGELVCLAYTGFISDKYGRKTLLIASTLMSTVVGVIKSFSVSYNMYVFLEFIDSIFGAAMYYGAFILAMEFVAPRNRNIVXIVICSLYAFGGCYMXIIAXLFPYWRNMLRVLYFPRXICILFFWT

SEQ ID NO: 29141 - protein, 71 aa, Diabrotica virgifera
  misc_feature: Coding regions on vcDNA: vcDNA=SeqID_8838; Strand=-; Position=2-214
  misc_feature (33)..(42): Xaa can be any naturally occurring amino acid
  misc_feature (55)..(61): Xaa can be any naturally occurring amino acid
NKEISCLDVLSLKIVKIYVIDWGSFESEGGENXXXXXXXXXXCKGVSQRCIIFTXXXXXXXRSSFSKHYTP

SEQ ID NO: 29142 - protein, 63 aa, Diabrotica virgifera
  misc_feature: Coding regions on vcDNA: vcDNA=SeqID_8839; Strand=+; Position=489-680
NISNCATDSSHRQLFSFISSNANQVDPCHAFPSPYQKVALYVTVAVATAFPPFYLDWTPHTDV

SEQ ID NO: 29143 - protein, 42 aa, Diabrotica virgifera
  misc_feature: Coding regions on vcDNA: vcDNA=SeqID_8840; Strand=-; Position=2-127
  misc_feature (1)..(36): Xaa can be any naturally occurring amino acid
  misc_feature (38)..(38): Xaa can be any naturally occurring amino acid
XXXXXXXXXXXXXXXXXXXXXXXXXXXXXXXXXXXXTXKINS

SEQ ID NO: 29144 - protein, 65 aa, Diabrotica virgifera
  misc_feature: Coding regions on vcDNA: vcDNA=SeqID_8841; Strand=+; Position=167-364
CLCLPLPILNDKGYISSKNPASISNLSEKNIEKSLILQQDIRSIATIQHRIHLISGIRFPRRICG

SEQ ID NO: 29145 - protein, 109 aa, Diabrotica virgifera
  misc_feature: Coding regions on vcDNA: vcDNA=SeqID_8842; Strand=+; Position=536-865
DDRNLRTMQKTRSTLKLQYEKFCVGVAEPSHAVTELINNTAKSTIVLLSLRFIDIRVLLHCFGSLFSDVLLVPTCTVNGRNVKLIYISIYCKVKIKRKYFNYIVFTIKC

SEQ ID NO: 29146 - protein, 55 aa, Diabrotica virgifera
  misc_feature: Coding regions on vcDNA: vcDNA=SeqID_8843; Strand=-; Position=0-164
  misc_feature (8)..(17): Xaa can be any naturally occurring amino acid
  misc_feature (30)..(36): Xaa can be any naturally occurring amino acid
  misc_feature (41)..(52): Xaa can be any naturally occurring amino acid
KKIKLLHXXXXXXXXXXKASCFHPPPPSSXXXXXXXLCYPXXXXXXXXXXXXRGR

SEQ ID NO: 29147 - protein, 20 aa, Diabrotica virgifera
  misc_feature: Coding regions on vcDNA: vcDNA=SeqID_8844; Strand=-; Position=2-61
  misc_feature (4)..(13): Xaa can be any naturally occurring amino acid
  misc_feature (16)..(20): Xaa can be any naturally occurring amino acid
LKNXXXXXXXXXXLVXXXXX

SEQ ID NO: 29148 - protein, 65 aa, Diabrotica virgifera
  misc_feature: Coding regions on vcDNA: vcDNA=SeqID_8845; Strand=-; Position=1-195
  misc_feature (2)..(12): Xaa can be any naturally occurring amino acid
  misc_feature (22)..(30): Xaa can be any naturally occurring amino acid
  misc_feature (32)..(40): Xaa can be any naturally occurring amino acid
  misc_feature (51)..(63): Xaa can be any naturally occurring amino acid
FXXXXXXXXXXXNQLGSHRFKXXXXXXXXXEXXXXXXXXXNINLIQHRGRXXXXXXXXXXXXXLL

SEQ ID NO: 29149 - protein, 79 aa, Diabrotica virgifera
  misc_feature: Coding regions on vcDNA: vcDNA=SeqID_8846; Strand=-; Position=2-238
  misc_feature (1)..(12): Xaa can be any naturally occurring amino acid
  misc_feature (16)..(26): Xaa can be any naturally occurring amino acid
  misc_feature (34)..(34): Xaa can be any naturally occurring amino acid
  misc_feature (36)..(43): Xaa can be any naturally occurring amino acid
  misc_feature (46)..(59): Xaa can be any naturally occurring amino acid
  misc_feature (65)..(78): Xaa can be any naturally occurring amino acid
XXXXXXXXXXXXGPFXXXXXXXXXXXTNLAHTGXNXXXXXXXXSNXXXXXXXXXXXXXXPTSRSXXXXXXXXXXXXXXV

SEQ ID NO: 29150 - protein, 231 aa, Diabrotica virgifera
  misc_feature: Coding regions on vcDNA: vcDNA=SeqID_8847; Strand=-; Position=2-694
  misc_feature (8)..(26): Xaa can be any naturally occurring amino acid
  misc_feature (39)..(45): Xaa can be any naturally occurring amino acid
  misc_feature (48)..(53): Xaa can be any naturally occurring amino acid
  misc_feature (57)..(62): Xaa can be any naturally occurring amino acid
  misc_feature (89)..(89): Xaa can be any naturally occurring amino acid
  misc_feature (95)..(95): Xaa can be any naturally occurring amino acid
  misc_feature (101)..(231): Xaa can be any naturally occurring amino acid
CGGGAPPXXXXXXXXXXXXXXXXXXXPPRPPRPGYPPKXXXXXXXGTXXXXXXAHPXXXXXXPHGGAPLYYRLDLSQKKLRCIPKGNYXLYQKKXGSKNLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29151 - protein, 241 aa, Diabrotica virgifera
  misc_feature: Coding regions on vcDNA: vcDNA=SeqID_8848; Strand=+; Position=62-787
  misc_feature: Homolog annotation: Hit_ID=NP_001005317.1; Match level="QueryCoverage= 78%, HitCoverage=62%, E-value=2e-27, Identity=35%"; Hit description =si:busm1-173m20.16 [Danio rerio] emb|CAD59047.1| SI:dZ173M20.16 (novel transposase) [Danio rerio]
  misc_feature (207)..(207): Xaa can be any naturally occurring amino acid
MIDIFNDDLDLLEIIEHGFPRRVFVRPNYFQTMDNLTFFRTFRFYILTLIEDRLEFPDNRNNSLSPMNQLLTCLRYFASSGFLITVAQFMHIDVATASRTIARVSRELATLYPRFIKMPTTQREILTHQEKFYSMFRFPRIIGAVDGTHIRIQSPGGNDAEVFRNRKSFFSLNVQVVCDADMKFENVVARWPGSTHDATIFYNSRLXASFIANEFRNCILIGDSGYPLQEYFMTPLKSAKY

SEQ ID NO: 29152 - protein, 179 aa, Diabrotica virgifera
  misc_feature: Coding regions on vcDNA: vcDNA=SeqID_8849; Strand=-; Position=1-537
  misc_feature (6)..(22): Xaa can be any naturally occurring amino acid
  misc_feature (32)..(38): Xaa can be any naturally occurring amino acid
  misc_feature (77)..(108): Xaa can be any naturally occurring amino acid
  misc_feature (110)..(122): Xaa can be any naturally occurring amino acid
  misc_feature (125)..(163): Xaa can be any naturally occurring amino acid
  misc_feature (167)..(167): Xaa can be any naturally occurring amino acid
  misc_feature (169)..(178): Xaa can be any naturally occurring amino acid
VGPPRXXXXXXXXXXXXXXXXXAAPPPFKPPXXXXXXXCTQIKKKGSPPIKTLYPTGGGPIFIFDWTSPKKFRVFPXXXXXXXXXXXXXXXXXXXXXXXXXXXXXXXXPXXXXXXXXXXXXXKKXXXXXXXXXXXXXXXXXXXXXXXXXXXXXXXXXXXXXXXQPFXPXXXXXXXXXXP

SEQ ID NO: 29153 - protein, 178 aa, Diabrotica virgifera
  misc_feature: Coding regions on vcDNA: vcDNA=SeqID_8850; Strand=+; Position=258-789
  misc_feature: Homolog annotation: Hit_ID=XP_394279.1; Match level="QueryCoverage =83%, HitCoverage=35%, E-value=3e-42, Identity=59%"; Hit description =similar to solute carrier family 41 member 1 [Apis mellifera]
  misc_feature: Pfam annotation: Pfam_ID=MgtE; Match level="Score=-38.4, E-value =0.099, Copies=1"; Pfam description=Divalent cation transporter
  misc_feature (149)..(149): Xaa can be any naturally occurring amino acid
MESPSQSNVLKSSPSLDMKKISSNSLDNVDNENGVLPDVVATKIFKQGEQFEESYLSTAIQVFIPFLIAGFGMVFAGLVLDKIQHWTVFEQITELVILIPALLGLKGNLEMTLASRLSTQANLGHMDTTKQKISIIVRSLTLIQCQAIXVVGFLGGLVAVEMGGHQEPRCPIRPRISF

SEQ ID NO: 29154 - protein, 54 aa, Diabrotica virgifera
  misc_feature: Coding regions on vcDNA: vcDNA=SeqID_8851; Strand=+; Position=247-408
NNIRKDLIIYICPCYLIKILLLITCILTGLPLYTYTLLPLLSLYTLMVLLFIHM

SEQ ID NO: 29155 - protein, 58 aa, Diabrotica virgifera
  misc_feature: Coding regions on vcDNA: vcDNA=SeqID_8852; Strand=-; Position=220-396
  misc_feature (22)..(22): Xaa can be any naturally occurring amino acid
GQIGKHKLAGGFSGRLAVFWLXPLFTYIRKKNSAPNEARAGVGAHGGRATCSTSSPIV

SEQ ID NO: 29156 - protein, 75 aa, Diabrotica virgifera
  misc_feature: Coding regions on vcDNA: vcDNA=SeqID_8853; Strand=-; Position=1-225
  misc_feature (1)..(7): Xaa can be any naturally occurring amino acid
  misc_feature (16)..(42): Xaa can be any naturally occurring amino acid
  misc_feature (48)..(60): Xaa can be any naturally occurring amino acid
  misc_feature (62)..(69): Xaa can be any naturally occurring amino acid
  misc_feature (74)..(74): Xaa can be any naturally occurring amino acid
XXXXXXXGCYPKVNLXXXXXXXXXXXXXXXXXXXXXXXXXXXHPHLKXXXXXXXXXXXXXLXXXXXXXXVSRLXK

SEQ ID NO: 29157 - protein, 65 aa, Diabrotica virgifera
  misc_feature: Coding regions on vcDNA: vcDNA=SeqID_8854; Strand=-; Position=96-293
KSSIFSSEGMLYRALQLLRVQVNFHNRLYILCRSYKKNLYSGMSCITYFLNLGMCNYDSGPSKFS

SEQ ID NO: 29158 - protein, 243 aa, Diabrotica virgifera
  misc_feature: Coding regions on vcDNA: vcDNA=SeqID_8855; Strand=-; Position=1-729
  misc_feature (4)..(243): Xaa can be any naturally occurring amino acid
AFYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29159 - protein, 44 aa, Diabrotica virgifera
  misc_feature: Coding regions on vcDNA: vcDNA=SeqID_8856; Strand=-; Position=1-132
  misc_feature (6)..(44): Xaa can be any naturally occurring amino acid
WDQKIXXXXXXXXXXXXXXXXXXXXXXXXXXXXXXXXXXXXXXX

SEQ ID NO: 29160 - protein, 277 aa, Diabrotica virgifera
  misc_feature: Coding regions on vcDNA: vcDNA=SeqID_8857; Strand=+; Position=3-836
  misc_feature (2)..(248): Xaa can be any naturally occurring amino acid
DXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNSVFLLESSIDIKIATRCWIKLYWWSSIY

SEQ ID NO: 29161 - protein, 167 aa, Diabrotica virgifera
  misc_feature: Coding regions on vcDNA: vcDNA=SeqID_8858; Strand=+; Position=491-991
  misc_feature (7)..(7): Xaa can be any naturally occurring amino acid
  misc_feature (17)..(108): Xaa can be any naturally occurring amino acid
  misc_feature (111)..(166): Xaa can be any naturally occurring amino acid
KYFSYIXKLIVKFNLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYSXXXXXXXXXXXXXXXXXXXXXXXXXXXXXXXXXXXXXXXXXXXXXXXXXXXXXXXXG

SEQ ID NO: 29162 - protein, 315 aa, Diabrotica virgifera
  misc_feature: Coding regions on vcDNA: vcDNA=SeqID_8859; Strand=+; Position=3-950
  misc_feature: Homolog annotation: Hit_ID=XP_308960.1; Match level="QueryCoverage =90%, HitCoverage=58%, E-value=2e-67, Identity=46%"; Hit description =ENSANGP00000022672 [Anopheles gambiae]
  misc_feature: Pfam annotation: Pfam_ID=rve; Match level="Score=39.8, E-value=7.9e -09, Copies=1"; Pfam description=Integrase core domain
  misc_feature (84)..(90): Xaa can be any naturally occurring amino acid
  misc_feature (117)..(117): Xaa can be any naturally occurring amino acid
  misc_feature (188)..(193): Xaa can be any naturally occurring amino acid
  misc_feature (238)..(238): Xaa can be any naturally occurring amino acid
  misc_feature (264)..(264): Xaa can be any naturally occurring amino acid
VIRVGGRIQNAEVGYDQKHPIILSKSHKLTKLIIQNEHYRNLHAGAQTLLNIVRLTYWPISGRSVVRDILRKCITCFRAKPLHXXXXXXXLPASRITPSKPFERCGVDYAGPFHIRXISLEGKKIIKGYLCIFVCLVTKACHLELVNDLTTQGFLNCFKRFISRRGLPRNIYSDNGSNFVGANNHFQXXXXXXRDRVNQCTFARYLSELSINWHFILSYSPHFGGLWEEAVKSANIIXRGVGDTSLTYDDLNTEIAQTEACLNXSRPLTPLSEDPTDFYVLTSDFFNWVSIGGVAAGDFLNLNPGRIQGFNWKRR

SEQ ID NO: 29163 - protein, 69 aa, Diabrotica virgifera
  misc_feature: Coding regions on vcDNA: vcDNA=SeqID_8860; Strand=+; Position=268-477
FNLLEINKWLNIVFITGYAIKSQINKTNIVWKVCFGDLTILVLLKCQLEYVSWRVLFFDSAVFLLICHI

SEQ ID NO: 29164 - protein, 254 aa, Diabrotica virgifera
  misc_feature: Coding regions on vcDNA: vcDNA=SeqID_8861; Strand=-; Position=3-764
  misc_feature (7)..(217): Xaa can be any naturally occurring amino acid
  misc_feature (219)..(238): Xaa can be any naturally occurring amino acid
  misc_feature (241)..(254): Xaa can be any naturally occurring amino acid
YRGFSSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXXXXXXXXXRYXXXXXXXXXXXXXX

SEQ ID NO: 29165 - protein, 198 aa, Diabrotica virgifera
  misc_feature: Coding regions on vcDNA: vcDNA=SeqID_8862; Strand=+; Position=188-784
  misc_feature: Homolog annotation: Hit_ID=XP_317108.1; Match level="QueryCoverage =92%, HitCoverage=91%, E-value=5e-38, Identity=45%"; Hit description =ENSANGP00000019691 [Anopheles gambiae]
  misc_feature: Pfam annotation: Pfam_ID=Lactamase_B; Match level="Score=55.0, E -value=2.1e-13, Copies=1"; Pfam description=Metallo-beta-lactamase superfamily
  misc_feature (169)..(181): Xaa can be any naturally occurring amino acid
MDMQDVKVLFDGYSKLEGGDYYANCSCVLIKGPHNVIVDTMTPWDGDKLLNALKEENISCSDINYVVSTHGHSDHTGCNYLFKNAIHIVGFSISHKDKYHTDPDFRNGEHYKINDKIKVIPTPGHTLQDVSVIVETDKGVLAVTGDLFEKFDDLDNEDIWLAGGNDSEXXXXXXXXXXXXXLIFMVPGHGTMLEGPKK

SEQ ID NO: 29166 - protein, 66 aa, Diabrotica virgifera; identical to SEQ ID NO: 26808
  misc_feature: Coding regions on vcDNA: vcDNA=SeqID_8863; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 29167 - protein, 238 aa, Diabrotica virgifera
  misc_feature: Coding regions on vcDNA: vcDNA=SeqID_8864; Strand=+; Position=201-914
  misc_feature: Homolog annotation: Hit_ID=AAH57246.1; Match level="QueryCoverage =95%, HitCoverage=85%, E-value=4e-60, Identity=50%"; Hit description =LOC402868 protein [Danio rerio]
  misc_feature: Gene Ontology Annotation: Molecular function=pyridoxamine-phosphate oxidase activity; Cellular component=cellular_component unknown; Biological process=coenzymes and prosthetic group metabolism
  misc_feature: Pfam annotation: Pfam_ID=Pyridox_oxidase; Match level="Score=82.2, E -value=1.4e-21, Copies=1"; Pfam description=Pyridoxamine 5'-phosphate oxidase
  misc_feature (174)..(174): Xaa can be any naturally occurring amino acid
  misc_feature (190)..(190): Xaa can be any naturally occurring amino acid
  misc_feature (203)..(203): Xaa can be any naturally occurring amino acid
  misc_feature (207)..(207): Xaa can be any naturally occurring amino acid
MDLTGMRANYKSKLASFLEKDIEVKEPYDLFEKWFKLVKEDPRTVEANAMCVSTATKDGFPSARYCLLKGFTKDGFIFFTHYTSRKGKELEENPRAALTFYWEHFNRSVRIEGDVEKLPFSDADEYFSKRPYRSQIGALCSNQSIPVEGRHILEQKAEELASKYSEGQVPRPPXMGGYLVKPRRFEFWQXQTDRIHDRIIFRXPSCXNEPDGIVTRPAERSWIYERLTLNYYHKSDFK

SEQ ID NO: 29168 - protein, 268 aa, Diabrotica virgifera
  misc_feature: Coding regions on vcDNA: vcDNA=SeqID_8865; Strand=+; Position=57-863
  misc_feature: Homolog annotation: Hit_ID=EAL42101.1; Match level="QueryCoverage =89%, HitCoverage=99%, E-value=3e-14, Identity=25%"; Hit description =ENSANGP00000027443 [Anopheles gambiae str. PEST] ref|XP_560625.1| ENSANGP00000027443 [Anopheles gambiae st
  misc_feature: Gene Ontology Annotation: Biological process=reproduction
  misc_feature (130)..(136): Xaa can be any naturally occurring amino acid
  misc_feature (177)..(183): Xaa can be any naturally occurring amino acid
ILNISASLIHVDAFDLKHIVSTNDTPEPVDNLDGETTTTDEPMAKTRRKNKKNPQDSEVDKSDNTTNDKLIDTSQEETAVEETTVEKDNKDKEDPPTPPEETETEEATVEKDSLTTQEEIAAEETTVENXXXXXXXPLPTPEETAIEAATVEKDKNRDDSLSTQEEIAAEETTVEKXXXXXXXSLTTQEKTAVQETTMKKDKKGKKNKNNEDPLTSDAAENTPEITAVEETTIEKDKKNKNKEGPLTSDVAEETPETTAVGISYKWGC

SEQ ID NO: 29169 - protein, 253 aa, Diabrotica virgifera
  misc_feature: Coding regions on vcDNA: vcDNA=SeqID_8866; Strand=+; Position=18-775
  misc_feature: Homolog annotation: Hit_ID=NP_476592.1; Match level="QueryCoverage =100%, HitCoverage=49%, E-value=4e-80, Identity=55%"; Hit description= CG10501-PA, isoform A [Drosophila melanogaster] gb|AAF53760.1| CG10501-PA, isoform A [Drosophila
  misc_feature: Gene Ontology Annotation: Molecular function=carboxy-lyase activity; Cellular component=cellular_component unknown; Biological process =catecholamine metabolism
  misc_feature: Pfam annotation: Pfam_ID=Pyridoxal_deC; Match level="Score=70.8, E -value=1.7e-19, Copies=1"; Pfam description=Pyridoxal-dependent decarboxylase con
  misc_feature (198)..(198): Xaa can be any naturally occurring amino acid
  misc_feature (205)..(205): Xaa can be any naturally occurring amino acid
MDVESFREFGKASVDYIADYIENIRKKKVLPSVEPGYLQNEIPELAPLSGEPWQNILPDVDRVILPGLTHWHSPHFHAYFPTANSFPGVVGELFLSGLGSISTDWQSNPACVELEVRMMDWLAKMLGLPEHFLNESEGPGGGVIQNAASESTLVGLLSGKQRTVKHILDKNPNLTPEDVKGKLIAYTSKESNSSVEKXSLLASVXMRLLPTDSDCRLRGDTLQEAIQKDKAEGLIPWCVVASLGTTGTCAFDD

SEQ ID NO: 29170 - protein, 72 aa, Diabrotica virgifera
  misc_feature: Coding regions on vcDNA: vcDNA=SeqID_8867; Strand=-; Position=177-395
  misc_feature (63)..(68): Xaa can be any naturally occurring amino acid
LKSKVSVRLFGMLGNIDPSTKKLQQFSKQRRAAIPQFWRLVSTRIVCIQDRIVGHIVSRGQKXXXXXXYVNI

SEQ ID NO: 29171 - protein, 47 aa, Diabrotica virgifera
  misc_feature: Coding regions on vcDNA: vcDNA=SeqID_8868; Strand=-; Position=3-143
VLYVQIMNLLYDVCTYNGILMKISWLIHPHKFDHTKDIFNYSYIVNE

SEQ ID NO: 29172 - protein, 19 aa, Diabrotica virgifera
  misc_feature: Coding regions on vcDNA: vcDNA=SeqID_8869; Strand=-; Position=37-96
ILTYLLIKSKIQLFYLIIL

SEQ ID NO: 29173 - protein, 219 aa, Diabrotica virgifera
  misc_feature: Coding regions on vcDNA: vcDNA=SeqID_8870; Strand=-; Position=2-658
  misc_feature (16)..(219): Xaa can be any naturally occurring amino acid
AFNKKAHDYATVARSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29174 - protein, 134 aa, Diabrotica virgifera
  misc_feature: Coding regions on vcDNA: vcDNA=SeqID_8871; Strand=+; Position=2-403
  misc_feature (1)..(23): Xaa can be any naturally occurring amino acid
  misc_feature (25)..(25): Xaa can be any naturally occurring amino acid
  misc_feature (27)..(86): Xaa can be any naturally occurring amino acid
XXXXXXXXXXXXXXXXXXXXXXXIXLXXXXXXXXXXXXXXXXXXXXXXXXXXXXXXXXXXXXXXXXXXXXXXXXXXXXXXXXXXXXLRDNSGYFFWGELNPKIKIGGPPRVGLKVYNWGDQSYIFKIVLNLLKF

SEQ ID NO: 29175 - protein, 189 aa, Diabrotica virgifera
  misc_feature: Coding regions on vcDNA: vcDNA=SeqID_8872; Strand=-; Position=2-568
  misc_feature (7)..(12): Xaa can be any naturally occurring amino acid
  misc_feature (15)..(49): Xaa can be any naturally occurring amino acid
  misc_feature (53)..(189): Xaa can be any naturally occurring amino acid
PFWGFWXXXXXXFLXXXXXXXXXXXXXXXXXXXXXXXXXXXXXXXXXXXGQNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29176 - protein, 157 aa, Diabrotica virgifera
  misc_feature: Coding regions on vcDNA: vcDNA=SeqID_8873; Strand=+; Position=2-475
TAEDKARCLQLARAQIACSPTAVMNMDTKPNCILEEIYERSKNSTCPVVTRAIHQAQWSKMGTPNLWLIITPIPIHLSIICDGNRNESVLERVSFLKLSPRCIAQTKNITLLPTSSGVETAITSYLKTPITPVAQLLTMPRHLLNTIQPTHINTQKR

SEQ ID NO: 29177 - protein, 61 aa, Diabrotica virgifera
  misc_feature: Coding regions on vcDNA: vcDNA=SeqID_8874; Strand=-; Position=254-439
  misc_feature (26)..(35): Xaa can be any naturally occurring amino acid
  misc_feature (50)..(56): Xaa can be any naturally occurring amino acid
IKVMMDINKYFHVLTICKFSCLVFTXXXXXXXXXXLISSLTIYYGNNITXXXXXXXDNKSI

SEQ ID NO: 29178 - protein, 37 aa, Diabrotica virgifera
  misc_feature: Coding regions on vcDNA: vcDNA=SeqID_8875; Strand=-; Position=181-294
  misc_feature (20)..(30): Xaa can be any naturally occurring amino acid
RVILEKFSFYIDVLSLVSRXXXXXXXXXXXHVFRYSI

SEQ ID NO: 29179 - protein, 95 aa, Diabrotica virgifera
  misc_feature: Coding regions on vcDNA: vcDNA=SeqID_8876; Strand=+; Position=215-502
KPPPPPPQDPGFSVGILSGAFFAFKMGGGRLKGSKFKKGGWEAPKLNSGAGVRGVTQFNRFGKIPLFPRGGKRKKAPPNPPSQKLPTLKGKGNPP

SEQ ID NO: 29180 - protein, 252 aa, Diabrotica virgifera
  misc_feature: Coding regions on vcDNA: vcDNA=SeqID_8877; Strand=-; Position=0-755
  misc_feature (5)..(5): Xaa can be any naturally occurring amino acid
  misc_feature (8)..(250): Xaa can be any naturally occurring amino acid
LKKLXNNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGT

SEQ ID NO: 29181 - protein, 73 aa, Diabrotica virgifera
  misc_feature: Coding regions on vcDNA: vcDNA=SeqID_8878; Strand=-; Position=146-367
  misc_feature (48)..(56): Xaa can be any naturally occurring amino acid
WRVCCLIFLLLRRYSYFYRNKYWWEYVPQALTRFFFIRKCVSAHNNKXXXXXXXXXSFFYSLKQSVRLCFSLI

SEQ ID NO: 29182 - protein, 81 aa, Diabrotica virgifera
  misc_feature: Coding regions on vcDNA: vcDNA=SeqID_8879; Strand=-; Position=2-244
  misc_feature (4)..(11): Xaa can be any naturally occurring amino acid
  misc_feature (16)..(27): Xaa can be any naturally occurring amino acid
  misc_feature (35)..(35): Xaa can be any naturally occurring amino acid
  misc_feature (38)..(46): Xaa can be any naturally occurring amino acid
  misc_feature (52)..(80): Xaa can be any naturally occurring amino acid
GLNXXXXXXXXRTDLXXXXXXXXXXXXPTSRSQSXLSXXXXXXXXXVIPKVXXXXXXXXXXXXXXXXXXXXXXXXXXXXXP

SEQ ID NO: 29183 - protein, 260 aa, Diabrotica virgifera
  misc_feature: Coding regions on vcDNA: vcDNA=SeqID_8880; Strand=+; Position=71-853
  misc_feature: Homolog annotation: Hit_ID=XP_233972.2; Match level="QueryCoverage =75%, HitCoverage=9%, E-value=1e-09, Identity=28%"; Hit description =similar to tudor protein [Rattus norvegicus]
  misc_feature: Pfam annotation: Pfam_ID=TUDOR; Match level="Score=82.9, E-value=8.3e- 22, Copies=1"; Pfam description=Tudor domain
MTERTEDSGYENDISHSYDGINWKLDSIYNIRVANIYDPSKFWIVHFTEELDLFFSFMNSFYNEKYEEYRMPIESMKRNTYCAVYTDNGFYRALIVEITNRVRPDDRIIVFLLDFGYTSTVSPDNIYRLYEKMYHMPRCAIRACLYGVEPYDSDTWTTQATEKLKELTQGKILMCQLCAIDDEYKIVYIRIVDTAHVPEQIDIGETLIIKKMAKLARKKDMKMTEKHIEKFIPKVRYPHLCPSFDLLENGTMPSSVHVGV

SEQ ID NO: 29184 - protein, 178 aa, Diabrotica virgifera
  misc_feature: Coding regions on vcDNA: vcDNA=SeqID_8881; Strand=+; Position=368-901
  misc_feature: Homolog annotation: Hit_ID=XP_391837.1; Match level="QueryCoverage =54%, HitCoverage=6%, E-value=8e-15, Identity=45%"; Hit description =similar to ENSANGP00000010474 [Apis mellifera]
MESEDALKYYLEEVKDTQHDINHIEEEIHIPNEAEQATDFLQNAGLGDLSKLYQQGKEITENVIKNSVHQRNLSEKQAQTIRSRVRILNQTLRSRQPRRKQRQDIRDISWNAETSSTGTRSRSATPDSLDSLDNLDEITYDDQNLTSLSPFSLDLDTRIVNHQNKKFTETTRGDVAHT

SEQ ID NO: 29185 - protein, 209 aa, Diabrotica virgifera
  misc_feature: Coding regions on vcDNA: vcDNA=SeqID_8882; Strand=+; Position=13-642
FLVEKFWKMAIIKDMMILLTLWLSVNLAMCRENLDDGHQKILHHVLRKFHKRHICQELCSSGLGGHSCGRDCLDVFQQIYNMQQSTSNNLTESHNDNNVPRSDMCPVLCKYHLGKPLCVCSKVQHIVPSKAIDFLEICSEFCNTYNYRISGCQKCSIYQDITPPRKSASGLPDLDPDDIDWNEWCTLKCREGDGGAACACDRGAFGLVS

SEQ ID NO: 29186 - protein, 86 aa, Diabrotica virgifera
  misc_feature: Coding regions on vcDNA: vcDNA=SeqID_8883; Strand=+; Position=1-261
  misc_feature (2)..(17): Xaa can be any naturally occurring amino acid
  misc_feature (19)..(19): Xaa can be any naturally occurring amino acid
  misc_feature (21)..(39): Xaa can be any naturally occurring amino acid
  misc_feature (41)..(51): Xaa can be any naturally occurring amino acid
  misc_feature (56)..(64): Xaa can be any naturally occurring amino acid
KXXXXXXXXXXXXXXXXYXIXXXXXXXXXXXXXXXXXXXKXXXXXXXXXXXKFLIXXXXXXXXXLKGYSVFLLGRSIDIKMRPQVG

SEQ ID NO: 29187 - protein, 37 aa, Diabrotica virgifera
  misc_feature: Coding regions on vcDNA: vcDNA=SeqID_8884; Strand=+; Position=3-113
  misc_feature (4)..(4): Xaa can be any naturally occurring amino acid
  misc_feature (6)..(21): Xaa can be any naturally occurring amino acid
  misc_feature (27)..(27): Xaa can be any naturally occurring amino acid
NGRXWXXXXXXXXXXXXXXXXGKSLNXFKDESPYRVY

SEQ ID NO: 29188 - protein, 130 aa, Diabrotica virgifera
  misc_feature: Coding regions on vcDNA: vcDNA=SeqID_8885; Strand=+; Position=542-931
  misc_feature (31)..(47): Xaa can be any naturally occurring amino acid
  misc_feature (49)..(76): Xaa can be any naturally occurring amino acid
  misc_feature (79)..(79): Xaa can be any naturally occurring amino acid
  misc_feature (81)..(101): Xaa can be any naturally occurring amino acid
  misc_feature (107)..(128): Xaa can be any naturally occurring amino acid
SVGRRDFIFNTKRHVFNKQVKKMLPNSFIKXXXXXXXXXXXXXXXXXLXXXXXXXXXXXXXXXXXXXXXXXXXXXXYFXIXXXXXXXXXXXXXXXXXXXXXHPLKYXXXXXXXXXXXXXXXXXXXXXXLK

SEQ ID NO: 29189 - protein, 123 aa, Diabrotica virgifera
  misc_feature: Coding regions on vcDNA: vcDNA=SeqID_8886; Strand=+; Position=119-487
  misc_feature: Homolog annotation: Hit_ID=XP_392465.1; Match level="QueryCoverage =97%, HitCoverage=16%, E-value=3e-27, Identity=50%"; Hit description =similar to Bmsqd-2 [Apis mellifera]
  misc_feature: Gene Ontology Annotation: Molecular function=mRNA binding; Cellular component=nuclear speck; Biological process=mRNA catabolism
  misc_feature: Pfam annotation: Pfam_ID=RRM_1; Match level="Score=11.4, E-value =0.0042, Copies=1"; Pfam description=RNA recognition motif. (a.k.a. RRM, RB
  misc_feature (39)..(39): Xaa can be any naturally occurring amino acid
  misc_feature (60)..(60): Xaa can be any naturally occurring amino acid
  misc_feature (89)..(89): Xaa can be any naturally occurring amino acid
  misc_feature (93)..(93): Xaa can be any naturally occurring amino acid
ESIESIHVKTDPSMGRSRRTAYREFTTLDTIDKSIDAEXYDITDRKVEPEKAKVRHARIXVRGLTCELSDDEIQTYFSQYGKIVDIEMXESRXKNKKKGFCLMTIEYEKEAKELRTQPTQTIK

SEQ ID NO: 29190 - protein, 224 aa, Diabrotica virgifera
  misc_feature: Coding regions on vcDNA: vcDNA=SeqID_8887; Strand=-; Position=0-671
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(183): Xaa can be any naturally occurring amino acid
  misc_feature (186)..(193): Xaa can be any naturally occurring amino acid
  misc_feature (196)..(213): Xaa can be any naturally occurring amino acid
  misc_feature (215)..(221): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVGXXXXXXXXKRXXXXXXXXXXXXXXXXXXVXXXXXXXHAG

SEQ ID NO: 29191 - protein, 79 aa, Diabrotica virgifera
  misc_feature: Coding regions on vcDNA: vcDNA=SeqID_8888; Strand=+; Position=366-605
PLLIQILALYLAASSHTISALKYVSLLIVQPDQFLHITCSSFELIFVLVPYLLLFPHPYQLSSYCSTYVLLLSSNYCIS

SEQ ID NO: 29192 - protein, 46 aa, Diabrotica virgifera
  misc_feature: Coding regions on vcDNA: vcDNA=SeqID_8889; Strand=-; Position=0-137
  misc_feature (3)..(44): Xaa can be any naturally occurring amino acid
VSXXXXXXXXXXXXXXXXXXXXXXXXXXXXXXXXXXXXXXXXXXAG

SEQ ID NO: 29193 - protein, 76 aa, Diabrotica virgifera
  misc_feature: Coding regions on vcDNA: vcDNA=SeqID_8890; Strand=-; Position=288-518
DKVYQNGYINVCSELSLEVFQCSFPNCQLLLRIQQKMIPTRSNSSRSFTTRLSQDCLRRLSHMGGLSVTQHHYGAS

SEQ ID NO: 29194 - protein, 210 aa, Diabrotica virgifera
  misc_feature: Coding regions on vcDNA: vcDNA=SeqID_8891; Strand=+; Position=169-798
  misc_feature: Homolog annotation: Hit_ID=XP_392915.1; Match level="QueryCoverage =89%, HitCoverage=100%, E-value=5e-35, Identity=48%"; Hit description= similar to ENSANGP00000013960 [Apis mellifera]
MFTGLTSQVSSWMGSVKGDQEEKVPTPTEDSNVLVGSEKKEGSPTKASGGGGKLEMFSNVKNKVEGIGGWLGSSIPKLRKSDTDNPTDGQDQPPIAEASEPHTSEIHAPKDDDDNSSATEGADSGPQSAAESPTEDKDSQFVNVQTKALAGAKSFGRFLYSAVNKAGKTVSEASAKIKESVEKNSILGEFNREQETFMKSQNENSASPLP

SEQ ID NO: 29195 - protein, 147 aa, Diabrotica virgifera
  misc_feature: Coding regions on vcDNA: vcDNA=SeqID_8892; Strand=+; Position=2-445
  misc_feature: Homolog annotation: Hit_ID=XP_317365.1; Match level="QueryCoverage =88%, HitCoverage=22%, E-value=2e-14, Identity=30%"; Hit description =ENSANGP00000010401 [Anopheles gambiae]
  misc_feature (82)..(87): Xaa can be any naturally occurring amino acid
ICLPDAKAPRESYGNCKVTGWGKRILQLHARGAIMHHIDAQLIDKKQCTDTVNEKFQDSASTLKDHTLCVTSEIDQCKVDYXXXXXXTNDQGKYVLSGIYAWDTGCKQEGQIGGYIPTDVTWVEESLRKPLKELRRLDREYLLNSNK

SEQ ID NO: 29196 - protein, 55 aa, Diabrotica virgifera
  misc_feature: Coding regions on vcDNA: vcDNA=SeqID_8893; Strand=-; Position=281-448
RRSGVADAVERIATLKWDWAGHVARMIDNRWTKRILQWRPKRYDAYRSKGRPPTR

SEQ ID NO: 29197 - protein, 124 aa, Diabrotica virgifera
  misc_feature: Coding regions on vcDNA: vcDNA=SeqID_8894; Strand=-; Position=69-443
KCPPDTTQETVTTCSHRHYLSKKRFSTLAAEVSRTGYIFVLLPWPTCEDNSCYVVKAWRTPFLKSSFKTYLSFLTSSLRKPHIALLSSAIKFGILVGQGIGTGHFGGPRPIYRPGSSHACGCRQ

SEQ ID NO: 29198 - protein, 82 aa, Diabrotica virgifera
  misc_feature: Coding regions on vcDNA: vcDNA=SeqID_8895; Strand=-; Position=2-247
  misc_feature (6)..(12): Xaa can be any naturally occurring amino acid
  misc_feature (22)..(50): Xaa can be any naturally occurring amino acid
  misc_feature (52)..(79): Xaa can be any naturally occurring amino acid
FSDVTXXXXXXXRLSPKVIYSXXXXXXXXXXXXXXXXXXXXXXXXXXXXXPXXXXXXXXXXXXXXXXXXXXXXXXXXXXLSS

SEQ ID NO: 29199 - protein, 66 aa, Diabrotica virgifera
  misc_feature: Coding regions on vcDNA: vcDNA=SeqID_8896; Strand=-; Position=77-277
EMGMMSMVMSPCFSKMLKTHCFHKLYPCAKRNSKNFPILLCKIHISVTTLAYTFYALFVNVLIFLL

SEQ ID NO: 29200 - protein, 257 aa, Diabrotica virgifera
  misc_feature: Coding regions on vcDNA: vcDNA=SeqID_8897; Strand=+; Position=99-869
  misc_feature: Homolog annotation: Hit_ID=XP_309653.1; Match level="QueryCoverage =88%, HitCoverage=18%, E-value=3e-58, Identity=45%"; Hit description =ENSANGP00000003873 [Anopheles gambiae]
  misc_feature: Gene Ontology Annotation: Molecular function=receptor activity; Cellular component=integral to plasma membrane; Biological process =regulation of body size
  misc_feature: Pfam annotation: Pfam_ID=Laminin_EGF; Match level="Score=7.8, E-value= 0.0031, Copies=1"; Pfam description=Laminin EGF-like (Domains III and V)
MCISIYKSYRHKYFVCLITNRVCKDDLCICDVGWSGPQCQHCVGNVSNSTTGRSCQQCMKGYWGTTLNGDQCKKCQCGLDARDCNKNTGECNCLTKGTIGNTCDECDTLNHYHPDKDKNKACYYELTTDYRFTFNISKSSDKYFTRINYVNSPTKPDLDVDVRITCSKPAKVNLTVKTEGLEEKTILESLHCGMITTKISKHLYNFDDPRNISTTRFYAHVYDFQTPTVIEISFSQPPKLNLEQYAITLLTAKLYSK

SEQ ID NO: 29201 - protein, 134 aa, Diabrotica virgifera
  misc_feature: Coding regions on vcDNA: vcDNA=SeqID_8898; Strand=+; Position=33-434
  misc_feature (9)..(16): Xaa can be any naturally occurring amino acid
  misc_feature (35)..(51): Xaa can be any naturally occurring amino acid
  misc_feature (53)..(100): Xaa can be any naturally occurring amino acid
  misc_feature (102)..(122): Xaa can be any naturally occurring amino acid
TGFCILITXXXXXXXXFRAFNGTTYQHTRSVWMRXXXXXXXXXXXXXXXXXNXXXXXXXXXXXXXXXXXXXXXXXXXXXXXXXXXXXXXXXXXXXXXXXXLXXXXXXXXXXXXXXXXXXXXXILIRIIKCSYSK

SEQ ID NO: 29202 - protein, 58 aa, Diabrotica virgifera
  misc_feature: Coding regions on vcDNA: vcDNA=SeqID_8899; Strand=-; Position=1-174
  misc_feature (1)..(58): Xaa can be any naturally occurring amino acid
XXXXXXXXXXXXXXXXXXXXXXXXXXXXXXXXXXXXXXXXXXXXXXXXXXXXXXXXXX

SEQ ID NO: 29203 - protein, 271 aa, Diabrotica virgifera
  misc_feature: Coding regions on vcDNA: vcDNA=SeqID_8900; Strand=+; Position=16-828
  misc_feature: Homolog annotation: Hit_ID=XP_221732.2; Match level="QueryCoverage =84%, HitCoverage=64%, E-value=2e-24, Identity=34%"; Hit description =similar to lipase, member H; membrane-bound phosphatidic acid -selective phospholipase A1;
  misc_feature: Gene Ontology Annotation: Molecular function=phospholipase A1 activity; Cellular component=extracellular space; Biological process= lipid metabolism
  misc_feature: Pfam annotation: Pfam_ID=Lipase; Match level="Score=-19.8, E-value =5.3e-11, Copies=1"; Pfam description=Lipase
  misc_feature (245)..(245): Xaa can be any naturally occurring amino acid
  misc_feature (251)..(251): Xaa can be any naturally occurring amino acid
MRLHIKIFLFCAFVLAGINCIPDIPIALKKDFFQIYKGLAVEVKQLTGGNVTLDKLTFTHFERKHRENGTVLDSSNLEDVKYAKEKIVFILHGWASSATVDWVLEMKNAFLAIYPNSSVITIDWSGPASQPYSISSINTYDVGNFMADMILDLINKHNVDIKKFLLVGHSLGGQACGFAGKKLQSVGKILPRIIGLDPAGPLFSIRPKDKRLNSEDAEVVEVIHSDAGRFGFDHPCGTIDFFPNXGKWQPXMQRIDLLDITSVADPVTCDH

SEQ ID NO: 29204 - protein, 47 aa, Diabrotica virgifera
  misc_feature: Coding regions on vcDNA: vcDNA=SeqID_8901; Strand=-; Position=83-226
EKASYMSPARYRNQVRIAVKNKYVNRIQQKVHAEAARPTESYKMRPL

SEQ ID NO: 29205 - protein, 225 aa, Diabrotica virgifera
  misc_feature: Coding regions on vcDNA: vcDNA=SeqID_8902; Strand=-; Position=2-676
  misc_feature (10)..(24): Xaa can be any naturally occurring amino acid
  misc_feature (27)..(27): Xaa can be any naturally occurring amino acid
  misc_feature (29)..(225): Xaa can be any naturally occurring amino acid
VFKKIKLLLXXXXXXXXXXXXXXXIQXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29206 - protein, 71 aa, Diabrotica virgifera
  misc_feature: Coding regions on vcDNA: vcDNA=SeqID_8903; Strand=-; Position=200-415
QLVNITNIVILILFSNIAIVKMRMNSYTPQKIASQKNGDRKVVRLTARCDGYRKAVGNNFQMTSMSELDHR

SEQ ID NO: 29207 - protein, 100 aa, Diabrotica virgifera
  misc_feature: Coding regions on vcDNA: vcDNA=SeqID_8904; Strand=-; Position=2-301
  misc_feature (38)..(46): Xaa can be any naturally occurring amino acid
SYLISCRISYKLSWITSRNTQQYEIMIVLLLFTPIMTXXXXXXXXXLFHNTWFIARLINWKSLRVPLGYSFRVEVSNSNSNISSLKTYRTSDITSYITSW

SEQ ID NO: 29208 - protein, 52 aa, Diabrotica virgifera
  misc_feature: Coding regions on vcDNA: vcDNA=SeqID_8905; Strand=+; Position=223-381
KNCERLLYKPMSANASFPRYMMLNFFLHTDDLFIALKTYHGCIKYYVCGNFK

SEQ ID NO: 29209 - protein, 37 aa, Diabrotica virgifera
  misc_feature: Coding regions on vcDNA: vcDNA=SeqID_8906; Strand=-; Position=0-110
  misc_feature (9)..(36): Xaa can be any naturally occurring amino acid
KLYRGFSSXXXXXXXXXXXXXXXXXXXXXXXXXXXXS

SEQ ID NO: 29210 - protein, 211 aa, Diabrotica virgifera
  misc_feature: Coding regions on vcDNA: vcDNA=SeqID_8907; Strand=+; Position=3-635
  misc_feature: Homolog annotation: Hit_ID=AAF87760.1; Match level="QueryCoverage =100%, HitCoverage=47%, E-value=2e-75, Identity=72%"; Hit description= cytochrome oxidase subunit I [Diabrotica virgifera zeae]
  misc_feature: Pfam annotation: Pfam_ID=COX1; Match level="Score=-241.4, E-value =0.0048, Copies=1"; Pfam description=Cytochrome C and Quinol oxidase polype
  misc_feature (22)..(22): Xaa can be any naturally occurring amino acid
  misc_feature (39)..(39): Xaa can be any naturally occurring amino acid
  misc_feature (42)..(48): Xaa can be any naturally occurring amino acid
  misc_feature (75)..(81): Xaa can be any naturally occurring amino acid
  misc_feature (95)..(95): Xaa can be any naturally occurring amino acid
  misc_feature (103)..(119): Xaa can be any naturally occurring amino acid
  misc_feature (149)..(149): Xaa can be any naturally occurring amino acid
  misc_feature (165)..(172): Xaa can be any naturally occurring amino acid
  misc_feature (193)..(193): Xaa can be any naturally occurring amino acid
RAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFSFQRKRLRPLRITSSIEXLQFNPPAGHRYSELPILS

SEQ ID NO: 29211 - protein, 91 aa, Diabrotica virgifera
  misc_feature: Coding regions on vcDNA: vcDNA=SeqID_8908; Strand=-; Position=0-272
  misc_feature (5)..(11): Xaa can be any naturally occurring amino acid
  misc_feature (15)..(88): Xaa can be any naturally occurring amino acid
PVIPXXXXXXXQKNXXXXXXXXXXXXXXXXXXXXXXXXXXXXXXXXXXXXXXXXXXXXXXXXXXXXXXXXXXXXXXXXXXXXXXXXXXHPT

SEQ ID NO: 29212 - protein, 60 aa, Diabrotica virgifera
  misc_feature: Coding regions on vcDNA: vcDNA=SeqID_8909; Strand=+; Position=16-198
INDFVINERKTYYYRPIGSIGFMIYCFIAEGTILTHAEIVANNLLEADYRGHYSHGMNRL

SEQ ID NO: 29213 - protein, 160 aa, Diabrotica virgifera
  misc_feature: Coding regions on vcDNA: vcDNA=SeqID_8910; Strand=-; Position=2-481
  misc_feature (34)..(62): Xaa can be any naturally occurring amino acid
  misc_feature (68)..(98): Xaa can be any naturally occurring amino acid
  misc_feature (100)..(153): Xaa can be any naturally occurring amino acid
GGNKNIKRVSGRGGGGHVFLRFNFPKKFRCYPKXXXXXXXXXXXXXXXXXXXXXXXXXXXXXPQFNKXXXXXXXXXXXXXXXXXXXXXXXXXXXXXXXVXXXXXXXXXXXXXXXXXXXXXXXXXXXXXXXXXXXXXXXXXXXXXXXXXXXXXXVIQKGMF

SEQ ID NO: 29214 - protein, 24 aa, Diabrotica virgifera
  misc_feature: Coding regions on vcDNA: vcDNA=SeqID_8911; Strand=-; Position=0-71
  misc_feature (2)..(22): Xaa can be any naturally occurring amino acid
KXXXXXXXXXXXXXXXXXXXXXPP

SEQ ID NO: 29215 - protein, 60 aa, Diabrotica virgifera
  misc_feature: Coding regions on vcDNA: vcDNA=SeqID_8912; Strand=+; Position=272-451
IYLILEHELIISLLIISLHIAIRSLCVLFSSTAERIYIEVSGPLGSVNIPHYKIRRRQDR

SEQ ID NO: 29216 - protein, 126 aa, Diabrotica virgifera
  misc_feature: Coding regions on vcDNA: vcDNA=SeqID_8913; Strand=-; Position=40-417
  misc_feature: Homolog annotation: Hit_ID=AAV34842.1; Match level="QueryCoverage =84%, HitCoverage=94%, E-value=9e-23, Identity=50%"; Hit description =ribosomal protein L30 [Bombyx mori]
  misc_feature: Gene Ontology Annotation: Cellular component=cytosolic ribosome (sensu Eukarya); Biological process=protein biosynthesis
  misc_feature (46)..(53): Xaa can be any naturally occurring amino acid
ISKKGAPKKQKEGVGSFPPRLGLVKKFGKYCLGYKQALKTLGQGKXXXXXXXXTPPPLRESEIEYFAMLGKTGGPPFFGNKVGVGPPWGKYFRGGGMSLSDPGGRGILRSLPAFEGGGKKIKYWPF

SEQ ID NO: 29217 - protein, 186 aa, Diabrotica virgifera
  misc_feature: Coding regions on vcDNA: vcDNA=SeqID_8914; Strand=+; Position=542-1099
  misc_feature (31)..(47): Xaa can be any naturally occurring amino acid
  misc_feature (49)..(85): Xaa can be any naturally occurring amino acid
  misc_feature (87)..(100): Xaa can be any naturally occurring amino acid
  misc_feature (104)..(104): Xaa can be any naturally occurring amino acid
  misc_feature (107)..(133): Xaa can be any naturally occurring amino acid
  misc_feature (143)..(162): Xaa can be any naturally occurring amino acid
  misc_feature (165)..(181): Xaa can be any naturally occurring amino acid
SVGRRDFIFNTKRHVFNKQVKKMLPNSFIKXXXXXXXXXXXXXXXXXLXXXXXXXXXXXXXXXXXXXXXXXXXXXXXXXXXXXXXLXXXXXXXXXXXXXXAHPXKYXXXXXXXXXXXXXXXXXXXXXXXXXXXDIFKKRIKFXXXXXXXXXXXXXXXXXXXXLLXXXXXXXXXXXXXXXXXPRKPT

SEQ ID NO: 29218 - protein, 216 aa, Diabrotica virgifera
  misc_feature: Coding regions on vcDNA: vcDNA=SeqID_8915; Strand=-; Position=2-649
  misc_feature (1)..(28): Xaa can be any naturally occurring amino acid
  misc_feature (35)..(216): Xaa can be any naturally occurring amino acid
XXXXXXXXXXXXXXXXXXXXXXXXXXXXFNTRGHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29219 - protein, 103 aa, Diabrotica virgifera
  misc_feature: Coding regions on vcDNA: vcDNA=SeqID_8916; Strand=+; Position=149-460
  misc_feature (25)..(30): Xaa can be any naturally occurring amino acid
  misc_feature (36)..(68): Xaa can be any naturally occurring amino acid
SVFERIKQILCIDSSLCMCFVRNMXXXXXXLRCYSXXXXXXXXXXXXXXXXXXXXXXXXXXXXXXXXXEGRLLKRYFIMVCFGIIARINIFLIKYMVSFILMY

SEQ ID NO: 29220 - protein, 53 aa, Diabrotica virgifera
  misc_feature: Coding regions on vcDNA: vcDNA=SeqID_8917; Strand=+; Position=40-201
LLELDVDYKYQIREILPEPFNYTDYLLSCIIKGLIYDHLFHITTVENMYQQSD

SEQ ID NO: 29221 - protein, 304 aa, Diabrotica virgifera
  misc_feature: Coding regions on vcDNA: vcDNA=SeqID_8918; Strand=+; Position=58-970
  misc_feature: Homolog annotation: Hit_ID=XP_393223.1; Match level="QueryCoverage =100%, HitCoverage=95%, E-value=1e-109, Identity=60%"; Hit description=similar to G protein beta subunit-like [Apis mellifera]
  misc_feature: Gene Ontology Annotation: Molecular function=protein binding; Cellular component=Golgi membrane; Biological process=signal transduction
  misc_feature: Pfam annotation: Pfam_ID=WD40; Match level="Score=107.1, E-value=4.5e- 29, Copies=5"; Pfam description=WD domain, G-beta repeat
  misc_feature (40)..(46): Xaa can be any naturally occurring amino acid
  misc_feature (191)..(196): Xaa can be any naturally occurring amino acid
  misc_feature (223)..(223): Xaa can be any naturally occurring amino acid
  misc_feature (257)..(257): Xaa can be any naturally occurring amino acid
  misc_feature (277)..(277): Xaa can be any naturally occurring amino acid
  misc_feature (284)..(285): Xaa can be any naturally occurring amino acid
  misc_feature (296)..(296): Xaa can be any naturally occurring amino acid
MTIETLENDNIILATGGYDHTIKLWQTHTGICTRTLQHAXXXXXXXEITPDRQHLATASYQHIYMYDLTSNNPNAIVNYEGTSKNVTCVGFQEDGKWMYSGGEDSRARIWDLRSRNNQCPKIFEVQSAINCVALHPNQVELFVGDQNGIIYKWDLRTDHNEQLIPENDAMILDVEVSPDSQLMASVNNKGXXXXXXLISGMIDTPTKMIPKQKFEAHTRHTLXCKFSPDSNMLVTTSADTTARIWNCADFSLLQELXQPESQRWVWDADFSADGQYXFTASSDXXCRLWDVKTGAXERDYTGHQ

SEQ ID NO: 29222 - protein, 140 aa, Diabrotica virgifera
  misc_feature: Coding regions on vcDNA: vcDNA=SeqID_8919; Strand=-; Position=3-422
  misc_feature (36)..(137): Xaa can be any naturally occurring amino acid
KLTCSPNYKLNSNMGVPNFYYRFGTFPLKLPGFPKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGQN

SEQ ID NO: 29223 - protein, 74 aa, Diabrotica virgifera
  misc_feature: Coding regions on vcDNA: vcDNA=SeqID_8920; Strand=-; Position=647-871
  misc_feature (13)..(13): Xaa can be any naturally occurring amino acid
  misc_feature (48)..(55): Xaa can be any naturally occurring amino acid
  misc_feature (65)..(65): Xaa can be any naturally occurring amino acid
SYVTQLHFIILYXVTKKGQTFCQHLETSTVFSRVSSDEQNDIIEALAXXXXXXXXFFASGFGNTXEKVTRRHCL

SEQ ID NO: 29224 - protein, 67 aa, Diabrotica virgifera
  misc_feature: Coding regions on vcDNA: vcDNA=SeqID_8921; Strand=-; Position=1-201
  misc_feature (3)..(3): Xaa can be any naturally occurring amino acid
  misc_feature (7)..(7): Xaa can be any naturally occurring amino acid
  misc_feature (10)..(22): Xaa can be any naturally occurring amino acid
  misc_feature (25)..(62): Xaa can be any naturally occurring amino acid
KFXAFYXKNXXXXXXXXXXXXXHPXXXXXXXXXXXXXXXXXXXXXXXXXXXXXXXXXXXXXXQEDMF

SEQ ID NO: 29225 - protein, 140 aa, Diabrotica virgifera
  misc_feature: Coding regions on vcDNA: vcDNA=SeqID_8922; Strand=+; Position=3-425
  misc_feature (114)..(120): Xaa can be any naturally occurring amino acid
LFCQNHPPKILTSCPLHQGTKIPVRVRTSFLNDHPVGPPRRFHTPSFHPVNHKLSPPLCLHAPESPSSPLAAIFSLPPIHNTPSPPPPLTASPSLGSLMPPFLSLLLTSLPAAXXXXXXXSIPPPIAPDHYPYLLNHCVS

SEQ ID NO: 29226 - protein, 332 aa, Diabrotica virgifera
  misc_feature: Coding regions on vcDNA: vcDNA=SeqID_8923; Strand=-; Position=3-998
  misc_feature (4)..(10): Xaa can be any naturally occurring amino acid
  misc_feature (53)..(332): Xaa can be any naturally occurring amino acid
PPKXXXXXXXGGPDLKKKLAPPPNLKPLIPPWGVAIFIFDLTSAKKIRGYSLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29227 - protein, 59 aa, Diabrotica virgifera
  misc_feature: Coding regions on vcDNA: vcDNA=SeqID_8924; Strand=+; Position=73-249
  misc_feature (4)..(19): Xaa can be any naturally occurring amino acid
CGEXXXXXXXXXXXXXXXXHRGLSDNNKILIYRTNLGTNTVIYSIAVFLVRTSERIWVE

SEQ ID NO: 29228 - protein, 34 aa, Diabrotica virgifera; identical to SEQ ID NO: 27603
  misc_feature: Coding regions on vcDNA: vcDNA=SeqID_8925; Strand=-; Position=80-184

SEQ ID NO: 29229 - protein, 26 aa, Diabrotica virgifera
  misc_feature: Coding regions on vcDNA: vcDNA=SeqID_8926; Strand=-; Position=1-78
  misc_feature (1)..(25): Xaa can be any naturally occurring amino acid
XXXXXXXXXXXXXXXXXXXXXXXXXF

SEQ ID NO: 29230 - protein, 72 aa, Diabrotica virgifera
  misc_feature: Coding regions on vcDNA: vcDNA=SeqID_8927; Strand=-; Position=1-216
  misc_feature (3)..(10): Xaa can be any naturally occurring amino acid
  misc_feature (22)..(29): Xaa can be any naturally occurring amino acid
  misc_feature (31)..(31): Xaa can be any naturally occurring amino acid
  misc_feature (35)..(45): Xaa can be any naturally occurring amino acid
  misc_feature (51)..(64): Xaa can be any naturally occurring amino acid
FSXXXXXXXXDRNQPGSHRLNXXXXXXXXRXDLIXXXXXXXXXXXPTSRSXXXXXXXXXXXXXXVIPKVIYS

SEQ ID NO: 29231 - protein, 21 aa, Diabrotica virgifera
  misc_feature: Coding regions on vcDNA: vcDNA=SeqID_8928; Strand=-; Position=1-63
  misc_feature (1)..(19): Xaa can be any naturally occurring amino acid
XXXXXXXXXXXXXXXXXXXIN

SEQ ID NO: 29232 - protein, 238 aa, Diabrotica virgifera
  misc_feature: Coding regions on vcDNA: vcDNA=SeqID_8929; Strand=+; Position=1-714
VIKSTAYKFKMRNIQNFFRVLLVLHCYLVILVEPSYNNELVPEGYQTNYGNPYTDYPYRYATNGNIYTTDVYGLTSVLRSGYARGYSYQTYKANPSAGQSHRSASTNDVYVTDQYGRTTLQSGRSAVQSGDSNRGYRYQSYYTNPSVGQSYRSASNNDVYVTDQYGRTTLSSGRPGYSYQSYYGNRYADHAYRSASNNDVYITDQYERTTLQSGRTAVQSEDSNRGYFEQSYYRNPYA

SEQ ID NO: 29233 - protein, 58 aa, Diabrotica virgifera
  misc_feature: Coding regions on vcDNA: vcDNA=SeqID_8930; Strand=-; Position=344-520
PIFYKNRNKFNSYVLIHSNHRNQHNNNGLLLSYSLLTPKFSKMMDIANFLYLEYRVSK

SEQ ID NO: 29234 - protein, 55 aa, Diabrotica virgifera
  misc_feature: Coding regions on vcDNA: vcDNA=SeqID_8931; Strand=+; Position=3-170
  misc_feature (7)..(17): Xaa can be any naturally occurring amino acid
  misc_feature (20)..(27): Xaa can be any naturally occurring amino acid
  misc_feature (44)..(50): Xaa can be any naturally occurring amino acid
RLPPRPXXXXXXXXXXXLFXXXXXXXXVNVINIVRKIIYILSIXXXXXXXPVTYV

SEQ ID NO: 29235 - protein, 264 aa, Diabrotica virgifera
  misc_feature: Coding regions on vcDNA: vcDNA=SeqID_8932; Strand=-; Position=1-792
  misc_feature (2)..(2): Xaa can be any naturally occurring amino acid
  misc_feature (4)..(4): Xaa can be any naturally occurring amino acid
  misc_feature (9)..(264): Xaa can be any naturally occurring amino acid
HXQXNKLYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29236 - protein, 223 aa, Diabrotica virgifera
  misc_feature: Coding regions on vcDNA: vcDNA=SeqID_8933; Strand=+; Position=9-676
  misc_feature: Homolog annotation: Hit_ID=XP_393966.1; Match level="QueryCoverage =100%, HitCoverage=65%, E-value=4e-97, Identity=79%"; Hit description= similar to CG2446-PC [Apis mellifera]
  misc_feature (209)..(209): Xaa can be any naturally occurring amino acid
MASAKDTATFFTHGTCQHFEQVLKLYPQALRLKADRKAKKPEELIKLDNWYQNELPKRIKSRGKDAHLVHEELVQCMKWKQTRGKFFPQLSYLVKVNTPRAVMAETKRAFRKLPNLELAMSALSNLKGVGTTMASALLAAACPDSAPFMADECLMAIPDIEGIDYTTKEYLKFANHIKSVVERLNKAAEERSEAVRWSPHKDELALWTXYVVSEHKPELLSSI

SEQ ID NO: 29237 - protein, 17 aa, Diabrotica virgifera
  misc_feature: Coding regions on vcDNA: vcDNA=SeqID_8934; Strand=-; Position=33-83
YNKHVHHHHHLSTILKV

SEQ ID NO: 29238 - protein, 69 aa, Diabrotica virgifera
  misc_feature: Coding regions on vcDNA: vcDNA=SeqID_8935; Strand=+; Position=501-710
  misc_feature (4)..(11): Xaa can be any naturally occurring amino acid
MVYXXXXXXXXLFDHLDKHKMLPAYSYILSYSIIYYIYILCNIVFFFILYSSFSGCWQSFFHVLLCRCV

SEQ ID NO: 29239 - protein, 161 aa, Diabrotica virgifera
  misc_feature: Coding regions on vcDNA: vcDNA=SeqID_8936; Strand=+; Position=45-527
  misc_feature (4)..(11): Xaa can be any naturally occurring amino acid
  misc_feature (16)..(16): Xaa can be any naturally occurring amino acid
  misc_feature (19)..(20): Xaa can be any naturally occurring amino acid
  misc_feature (29)..(78): Xaa can be any naturally occurring amino acid
  misc_feature (132)..(157): Xaa can be any naturally occurring amino acid
GLDXXXXXXXXFIRIXFLXXKLNFFKDEXXXXXXXXXXXXXXXXXXXXXXXXXXXXXXXXXXXXXXXXXXXXXXXXXXDKYPRGTAIFFWEGQTVYEWAPPGGVKGFYLGGEPNFFNLGPPFLNLLVFGGEXXXXXXXXXXXXXXXXXXXXXXXXXXGAGP

SEQ ID NO: 29240 - protein, 302 aa, Diabrotica virgifera
  misc_feature: Coding regions on vcDNA: vcDNA=SeqID_8937; Strand=+; Position=3-908
  misc_feature (5)..(248): Xaa can be any naturally occurring amino acid
  misc_feature (251)..(268): Xaa can be any naturally occurring amino acid
  misc_feature (281)..(301): Xaa can be any naturally occurring amino acid
GRVGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEGXXXXXXXXXXXXXXXXXXKKLNFFKDETTYXXXXXXXXXXXXXXXXXXXXXG

SEQ ID NO: 29241 - protein, 69 aa, Diabrotica virgifera
  misc_feature: Coding regions on vcDNA: vcDNA=SeqID_8938; Strand=-; Position=225-434
  misc_feature (15)..(21): Xaa can be any naturally occurring amino acid
  misc_feature (32)..(40): Xaa can be any naturally occurring amino acid
CCNHAKIIFNHIERXXXXXXXVDNYVLLTLVXXXXXXXXXFKAVFYLQLFQEGRCSDGSKNKTLVIPPG

SEQ ID NO: 29242 - protein, 61 aa, Diabrotica virgifera
  misc_feature: Coding regions on vcDNA: vcDNA=SeqID_8939; Strand=-; Position=1-183
  misc_feature (27)..(61): Xaa can be any naturally occurring amino acid
PFITAFNKKPKAYAALARSTYLGHSKXXXXXXXXXXXXXXXXXXXXXXXXXXXXXXXXXXX

SEQ ID NO: 29243 - protein, 80 aa, Diabrotica virgifera
  misc_feature: Coding regions on vcDNA: vcDNA=SeqID_8940; Strand=-; Position=99-341
RDFETNTTHTFLTGFKDTRWDCKISGVNCPNFCTNSAVEKEEKECYNRAEVALDEVESDDFKEYTLYNKYELIRTYREVI

SEQ ID NO: 29244 - protein, 24 aa, Diabrotica virgifera
  misc_feature: Coding regions on vcDNA: vcDNA=SeqID_8941; Strand=-; Position=0-71
  misc_feature (1)..(18): Xaa can be any naturally occurring amino acid
  misc_feature (20)..(20): Xaa can be any naturally occurring amino acid
XXXXXXXXXXXXXXXXXXSXPSIP

SEQ ID NO: 29245 - protein, 79 aa, Diabrotica virgifera
  misc_feature: Coding regions on vcDNA: vcDNA=SeqID_8942; Strand=-; Position=48-287
  misc_feature (55)..(64): Xaa can be any naturally occurring amino acid
WSKQIKIVTSVLSTKALYCCSLGSPVTTRNAELVTRFAVYKEWYPCWIIRPVISXXXXXXXXXXWNSPLDQLGNLLTAK

SEQ ID NO: 29246 - protein, 40 aa, Diabrotica virgifera
  misc_feature: Coding regions on vcDNA: vcDNA=SeqID_8943; Strand=-; Position=2-121
FHGYTLNFITVELWVSMKVVMVPLSYYKSSTIFQPTSCCQ

SEQ ID NO: 29247 - protein, 272 aa, Diabrotica virgifera
  misc_feature: Coding regions on vcDNA: vcDNA=SeqID_8944; Strand=-; Position=0-815
  misc_feature (3)..(271): Xaa can be any naturally occurring amino acid
LFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXR

SEQ ID NO: 29248 - protein, 175 aa, Diabrotica virgifera
  misc_feature: Coding regions on vcDNA: vcDNA=SeqID_8945; Strand=-; Position=1-525
  misc_feature (8)..(18): Xaa can be any naturally occurring amino acid
  misc_feature (39)..(45): Xaa can be any naturally occurring amino acid
  misc_feature (58)..(63): Xaa can be any naturally occurring amino acid
  misc_feature (70)..(76): Xaa can be any naturally occurring amino acid
  misc_feature (89)..(98): Xaa can be any naturally occurring amino acid
  misc_feature (100)..(118): Xaa can be any naturally occurring amino acid
  misc_feature (120)..(146): Xaa can be any naturally occurring amino acid
  misc_feature (148)..(174): Xaa can be any naturally occurring amino acid
RGEERKKXXXXXXXXXXXERDPPSGGTPPPCFLRAGRHXXXXXXXGDPSLKKIRFVPXXXXXXNPNMGGXXXXXXXLKLPQKNFGFFPXXXXXXXXXXGXXXXXXXXXXXXXXXXXXXPXXXXXXXXXXXXXXXXXXXXXXXXXXXSXXXXXXXXXXXXXXXXXXXXXXXXXXXP

SEQ ID NO: 29249 - protein, 91 aa, Diabrotica virgifera
  misc_feature: Coding regions on vcDNA: vcDNA=SeqID_8946; Strand=-; Position=1-273
RQKFVQILRYHSIVFFIYVFGIKLIIVLFMKECINIKYIFSNERLQRNQHPLFQTKIQVVHHIGELSLFGMFGFVFHSDQYKKRDSILACS

SEQ ID NO: 29250 - protein, 213 aa, Diabrotica virgifera
  misc_feature: Coding regions on vcDNA: vcDNA=SeqID_8947; Strand=-; Position=1-639
  misc_feature (1)..(190): Xaa can be any naturally occurring amino acid
  misc_feature (193)..(213): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXXXXXXXX

SEQ ID NO: 29251 - protein, 273 aa, Diabrotica virgifera
  misc_feature: Coding regions on vcDNA: vcDNA=SeqID_8948; Strand=-; Position=1-819
  misc_feature (5)..(17): Xaa can be any naturally occurring amino acid
  misc_feature (19)..(29): Xaa can be any naturally occurring amino acid
  misc_feature (39)..(47): Xaa can be any naturally occurring amino acid
  misc_feature (49)..(62): Xaa can be any naturally occurring amino acid
  misc_feature (69)..(81): Xaa can be any naturally occurring amino acid
  misc_feature (83)..(243): Xaa can be any naturally occurring amino acid
  misc_feature (245)..(258): Xaa can be any naturally occurring amino acid
PEHLXXXXXXXXXXXXXFXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXKLVMMIILVLSRPQK

SEQ ID NO: 29252 - protein, 87 aa, Diabrotica virgifera
  misc_feature: Coding regions on vcDNA: vcDNA=SeqID_8949; Strand=-; Position=32-295
PSLSCAVIIQFNKNNDILFMSTVHLVGGIPRLCLFALGHHSIFFFFHLLSLCRVTCPFSLQHRNAFYDVFHSSSSLYLIIMYSISQS

SEQ ID NO: 29253 - protein, 288 aa, Diabrotica virgifera
  misc_feature: Coding regions on vcDNA: vcDNA=SeqID_8950; Strand=-; Position=2-865
  misc_feature (4)..(11): Xaa can be any naturally occurring amino acid
  misc_feature (17)..(17): Xaa can be any naturally occurring amino acid
  misc_feature (29)..(29): Xaa can be any naturally occurring amino acid
  misc_feature (39)..(283): Xaa can be any naturally occurring amino acid
KSTXXXXXXXXPIINLXPTSRSPIFIIDXNSPNKITLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNVIRF

SEQ ID NO: 29254 - protein, 165 aa, Diabrotica virgifera
  misc_feature: Coding regions on vcDNA: vcDNA=SeqID_8951; Strand=+; Position=124-621
  misc_feature: Homolog annotation: Hit_ID=NP_612351.2; Match level="QueryCoverage =94%, HitCoverage=23%, E-value=5e-26, Identity=40%"; Hit description =hypothetical protein BC008326 [Homo sapiens] gb|AAH40641.1| Hypothetical protein BC008326 [Homo
  misc_feature: Gene Ontology Annotation: Molecular function=beta-galactosidase activity; Cellular component=extracellular space
  misc_feature: Pfam annotation: Pfam_ID=Glyco_hydro_35; Match level="Score=-196.2, E- value=0.0049, Copies=1"; Pfam description=Glycosyl hydrolases family 35
  misc_feature (101)..(101): Xaa can be any naturally occurring amino acid
  misc_feature (115)..(115): Xaa can be any naturally occurring amino acid
  misc_feature (138)..(138): Xaa can be any naturally occurring amino acid
PVRSRYYLSANYFFIYNASDHYFRNLLTYWRTRLRQLIAAVLNTVETYLPWNLHEPYNGTFDFGSSGSDMQDFLDLESFLKITQEEDLFDILRPGPFISAXIISVDFPSWMIWGXPMGFRTDEDNYNHFISTNFNYFXSKNLLPYKFFKGGPIIAYSVENELLVP

SEQ ID NO: 29255 - protein, 69 aa, Diabrotica virgifera
  misc_feature: Coding regions on vcDNA: vcDNA=SeqID_8952; Strand=-; Position=3-209
SLTQAGDAVAVQGAAGPQIGTTINFISTFILTCTFSFYFEWRTSFVLFSLCPVIFFSVYFEQKVLQEDA

SEQ ID NO: 29256 - protein, 269 aa, Diabrotica virgifera
  misc_feature: Coding regions on vcDNA: vcDNA=SeqID_8953; Strand=+; Position=2-807
  misc_feature: Homolog annotation: Hit_ID=EAA06952.2; Match level="QueryCoverage =99%, HitCoverage=60%, E-value=1e-142, Identity=89%"; Hit description= ENSANGP00000021345 [Anopheles gambiae str. PEST] ref|XP_559454.1| ENSANGP00000021345 [Anopheles gambiae s
  misc_feature: Gene Ontology Annotation: Molecular function=iron-sulfur electron transfer carrier; Cellular component=membrane fraction; Biological process=mitochondrial electron transport, NADH to ubiquinone
  misc_feature: Pfam annotation: Pfam_ID=Complex1_49kDa; Match level="Score=327.5, E -value=2e-95, Copies=1"; Pfam description=Respiratory-chain NADH dehydrogenase,
  misc_feature (260)..(260): Xaa can be any naturally occurring amino acid
TEKLIEYKTYTQALPYFDRLDYVSMMCNEQCYSLAIEKLLNIDVPLRAKYIRVLFGELTRILNHIMGIGTHALDVGALTPFFWLFEEREKIMEFYERVSGARMHAAYVRPGGVSLDLPLGLMDDIYEFACKYNERIDEVEDVLTHNRIWVQRTKDIGVISAEDALNYGFSGVMLRGSGIKWDLRKQQPYDAYDHFEFDVPIGTNGDCYDRYLCRIEEMRQSLRIIDQCLNKMPAGEVKTDDAKLTPPSRAEMKTSMKALXHHFKLFTQG

SEQ ID NO: 29257 - protein, 143 aa, Diabrotica virgifera
  misc_feature: Coding regions on vcDNA: vcDNA=SeqID_8954; Strand=+; Position=840-1268
  misc_feature (32)..(32): Xaa can be any naturally occurring amino acid
  misc_feature (34)..(122): Xaa can be any naturally occurring amino acid
  misc_feature (128)..(141): Xaa can be any naturally occurring amino acid
KKLHANTNAIKYMFFYTAIGFTRSPPPEVHPXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFFSLGXXXXXXXXXXXXXXAL

SEQ ID NO: 29258 - protein, 66 aa, Diabrotica virgifera
  misc_feature: Coding regions on vcDNA: vcDNA=SeqID_8955; Strand=-; Position=2-199
KLQHPASRKRSICRHMFIEQSGIIFSCRTSPQNVSHPLTNTPYIQARILSGTKCFYAYKDLMKSKL

SEQ ID NO: 29259 - protein, 65 aa, Diabrotica virgifera
  misc_feature: Coding regions on vcDNA: vcDNA=SeqID_8956; Strand=-; Position=2-196
  misc_feature (25)..(44): Xaa can be any naturally occurring amino acid
  misc_feature (57)..(65): Xaa can be any naturally occurring amino acid
KTSSKNYNVFKFKPPAWDSFLLLNXXXXXXXXXXXXXXXXXXXXPVFLSSKPFTTSXXXXXXXXX

SEQ ID NO: 29260 - protein, 73 aa, Diabrotica virgifera
  misc_feature: Coding regions on vcDNA: vcDNA=SeqID_8957; Strand=-; Position=1-219
  misc_feature (1)..(73): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXX

SEQ ID NO: 29261 - protein, 211 aa, Diabrotica virgifera
  misc_feature: Coding regions on vcDNA: vcDNA=SeqID_8958; Strand=+; Position=105-739
  misc_feature: Homolog annotation: Hit_ID=EAL27644.1; Match level="QueryCoverage =92%, HitCoverage=36%, E-value=4e-48, Identity=49%"; Hit description =GA11581-PA [Drosophila pseudoobscura]
  misc_feature: Pfam annotation: Pfam_ID=TraB; Match level="Score=-65.5, E-value=9.8e- 06, Copies=1"; Pfam description=TraB family
  misc_feature (174)..(174): Xaa can be any naturally occurring amino acid
  misc_feature (183)..(183): Xaa can be any naturally occurring amino acid
MDNSLTNFELTESTIKIDPKSDPMEIVSIGDAESSSSNKSDDDFDNNLPKTVTLLKHEKTGAKVYLIGTAHFSKESQEDVAKVITNVLPHIVVLELCSSRTNILSLDEETVLEEAKNIDMQKIISTIRTNGAYNGLMYLLLLNLSANLTKEIGMAPGGEFRVAYKEASKIPHCXIHLGDRPIXITLQRALARLTWFQTIKLGVASTHIRSL

SEQ ID NO: 29262 - protein, 42 aa, Diabrotica virgifera
  misc_feature: Coding regions on vcDNA: vcDNA=SeqID_8959; Strand=+; Position=3-131
  misc_feature: Homolog annotation: Hit_ID=NP_492561.2; Match level="QueryCoverage =85%, HitCoverage=9%, E-value=1e-12, Identity=88%"; Hit description =mitochondrial substrate carrier family member (42.8 kD) (1K219) [Caenorhabditis elegans]
  misc_feature: Gene Ontology Annotation: Molecular function=phosphate carrier activity; Cellular component=integral to plasma membrane; Biological process=transport
HASGTLTALQWFIYDAFKVAMRMPRPPPPEMPESLKKKLEGK

SEQ ID NO: 29263 - protein, 317 aa, Diabrotica virgifera
  misc_feature: Coding regions on vcDNA: vcDNA=SeqID_8960; Strand=+; Position=26-976
  misc_feature: Homolog annotation: Hit_ID=XP_308737.1; Match level="QueryCoverage =92%, HitCoverage=23%, E-value=3e-44, Identity=37%"; Hit description =ENSANGP00000015074 [Anopheles gambiae]
  misc_feature: Pfam annotation: Pfam_ID=Peptidase_A17; Match level="Score=-43.2, E -value=0.00021, Copies=1"; Pfam description=Pao retrotransposon peptidase
  misc_feature (78)..(78): Xaa can be any naturally occurring amino acid
  misc_feature (258)..(258): Xaa can be any naturally occurring amino acid
YFSEKIILKSSMAAYGACVYLRTFYSDETISCALVSSKSRITPLKTVTLPRLELCAMVLLSKLNAKIISIFENQSIIXSVSLWSDSQVALSWCKSHPSRWSVFVAHRVALVQELTQNFTWLHIKSAQNAADLLSRGMSGSEILSSDFWWQGPKCLRDKNFNVSNLVNDKVLENLPEERKISLVVNSNVENFWIKIFSRFSNISRLKRTVAYVFRFISNCKKQKISEPLSVAELNYAMDFIIKKIQGDAFSKEISALKXNKFISNKNFMSLKTFLDSSNFLQSGGRLTNCPDIDYLQKHPDTAPIPILSSILSSKMNI

SEQ ID NO: 29264 - protein, 125 aa, Diabrotica virgifera
  misc_feature: Coding regions on vcDNA: vcDNA=SeqID_8961; Strand=-; Position=0-374
  misc_feature (93)..(99): Xaa can be any naturally occurring amino acid
ITLLQSNRRIHNNHSLYPDSFSSTFMIDLFAFSYISPYNLQISITFIIKIIHPVDVTKHAYQRLPRELWSVCLQFFCYCTSLHYFAIWIVSLXXXXXXXIVFVNKLFHNFKWVVKVHNTTLAHTL

SEQ ID NO: 29265 - protein, 137 aa, Diabrotica virgifera
  misc_feature: Coding regions on vcDNA: vcDNA=SeqID_8962; Strand=-; Position=538-951
  misc_feature (5)..(34): Xaa can be any naturally occurring amino acid
  misc_feature (37)..(57): Xaa can be any naturally occurring amino acid
  misc_feature (59)..(59): Xaa can be any naturally occurring amino acid
  misc_feature (61)..(107): Xaa can be any naturally occurring amino acid
FKYIXXXXXXXXXXXXXXXXXXXXXXXXXXXXXXDEXXXXXXXXXXXXXXXXXXXXXIXKXXXXXXXXXXXXXXXXXXXXXXXXXXXXXXXXXXXXXXXXXXXXXXXLIKEFGNIFFTCLLKTCLFVLNIKSRLPTD

SEQ ID NO: 29266 - protein, 66 aa, Diabrotica virgifera
  misc_feature: Coding regions on vcDNA: vcDNA=SeqID_8963; Strand=-; Position=2-199
  misc_feature (3)..(13): Xaa can be any naturally occurring amino acid
  misc_feature (21)..(21): Xaa can be any naturally occurring amino acid
  misc_feature (23)..(30): Xaa can be any naturally occurring amino acid
  misc_feature (33)..(40): Xaa can be any naturally occurring amino acid
  misc_feature (45)..(45): Xaa can be any naturally occurring amino acid
  misc_feature (52)..(65): Xaa can be any naturally occurring amino acid
PFXXXXXXXXXXXTNLAHTGXNXXXXXXXXSNXXXXXXXXPIINXNPTSRSXXXXXXXXXXXXXXV

SEQ ID NO: 29267 - protein, 108 aa, Diabrotica virgifera; identical to SEQ ID NO: 27732
  misc_feature: Coding regions on vcDNA: vcDNA=SeqID_8964; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 29268 - protein, 202 aa, Diabrotica virgifera
  misc_feature: Coding regions on vcDNA: vcDNA=SeqID_8965; Strand=+; Position=368-973
  misc_feature: Homolog annotation: Hit_ID=XP_396250.1; Match level="QueryCoverage =93%, HitCoverage=39%, E-value=6e-21, Identity=32%"; Hit description =similar to ENSANGP00000009437 [Apis mellifera]
  misc_feature: Pfam annotation: Pfam_ID=DUF895; Match level="Score=-69.0, E-value =0.009, Copies=1"; Pfam description=Eukaryotic protein of unknown functio
  misc_feature (161)..(161): Xaa can be any naturally occurring amino acid
  misc_feature (168)..(168): Xaa can be any naturally occurring amino acid
  misc_feature (171)..(171): Xaa can be any naturally occurring amino acid
  misc_feature (186)..(192): Xaa can be any naturally occurring amino acid
MTFTIIKVEKVLEGKDWPQIVAILIGSFVAFTSGLLYAWPSTFLLKITQDKVHYNISENEASYFTIVHAAGMLTLPILLVSIAQIIGRKTLLNLSTIPYITSFVLKAVCTNIWLLYLARFLAGAGDAIVFAALPVYIGEIATPKIRGIWGNSFYIAVFLGXCGNDIIXSYXHVQVTSLCGLAIPVXXXXXXXFMPESPYYLI

SEQ ID NO: 29269 - protein, 287 aa, Diabrotica virgifera
  misc_feature: Coding regions on vcDNA: vcDNA=SeqID_8966; Strand=+; Position=3-866
  misc_feature: Homolog annotation: Hit_ID=XP_321440.1; Match level="QueryCoverage =99%, HitCoverage=75%, E-value=5e-58, Identity=43%"; Hit description =ENSANGP00000022119 [Anopheles gambiae]
  misc_feature (233)..(233): Xaa can be any naturally occurring amino acid
  misc_feature (245)..(245): Xaa can be any naturally occurring amino acid
LQLVKILYDYFDSEPSESARNTVFLSLFSGTTANSRIQVLSKLVSLAIGIPSTKILVSARAWMQQLGNTSANSCKLAEAIVQDYFYFYKSNTDKITLLPKICPQFTANIITAIAENYFNTRGKELVFPPDILIETITKWLSENPSLCSAAQQKQALLPVGAISMEATTPIAGLVRWCVLAPIFKKDNEYYNKLHLALLTSIMEIPRAVPPKAVYVQHLVIPINPIIAYVNDLXDRQELRLDQILXDESLQLCLDRFAQIVQIAQSVKAINGHIDDLYYQLKMLPFNN

SEQ ID NO: 29270 - protein, 29 aa, Diabrotica virgifera
  misc_feature: Coding regions on vcDNA: vcDNA=SeqID_8967; Strand=+; Position=49-135
  misc_feature (24)..(29): Xaa can be any naturally occurring amino acid
HMVSFILIHDYVPCYPDVAAKFRXXXXXX

SEQ ID NO: 29271 - protein, 25 aa, Diabrotica virgifera
  misc_feature: Coding regions on vcDNA: vcDNA=SeqID_8968; Strand=+; Position=1-75
VPLVKHIILKAFLPLGTFSKSQFLS

SEQ ID NO: 29272 - protein, 68 aa, Diabrotica virgifera
  misc_feature: Coding regions on vcDNA: vcDNA=SeqID_8969; Strand=-; Position=78-284
  misc_feature (17)..(23): Xaa can be any naturally occurring amino acid
  misc_feature (25)..(35): Xaa can be any naturally occurring amino acid
  misc_feature (37)..(46): Xaa can be any naturally occurring amino acid
FSLEELDIFRSEFHFNXXXXXXXIXXXXXXXXXXXFXXXXXXXXXXLLIIPDSQGTKSILVIDNHKTQ

SEQ ID NO: 29273 - protein, 290 aa, Diabrotica virgifera
  misc_feature: Coding regions on vcDNA: vcDNA=SeqID_8970; Strand=+; Position=83-955
  misc_feature: Homolog annotation: Hit_ID=XP_307772.1; Match level="QueryCoverage =98%, HitCoverage=43%, E-value=2e-39, Identity=34%"; Hit description =ENSANGP00000013540 [Anopheles gambiae]
  misc_feature (29)..(42): Xaa can be any naturally occurring amino acid
  misc_feature (66)..(71): Xaa can be any naturally occurring amino acid
  misc_feature (230)..(230): Xaa can be any naturally occurring amino acid
VLCTKMEIDLEISDEDYVIEKAKASFKNXXXXXXXXXXXXXXMYPNNFGVQFEAYHIEKNAGHVKXXXXXXSELTIKFQQHQELWKEIEKLTIALRAEADNNDPEKQFLCEMFRHLSSDVQHKLLLFTADHCEDTMEHCRLLLLLLQRFPTAISSNGPRLVDTLISAEKHSVDGNFPVNPYRKLLVCDLLPLLANEKVKVDLPSKLLHKLLHKSIEFYFCYLGLNKGALXDSDTKIEDPWASLFSVIEFIGTQLSWGPYLINFSNIWSKESYWQRIVTFCQTKSKELSSK

SEQ ID NO: 29274 - protein, 62 aa, Diabrotica virgifera
  misc_feature: Coding regions on vcDNA: vcDNA=SeqID_8971; Strand=-; Position=0-185
  misc_feature (5)..(52): Xaa can be any naturally occurring amino acid
  misc_feature (55)..(61): Xaa can be any naturally occurring amino acid
IKKMXXXXXXXXXXXXXXXXXXXXXXXXXXXXXXXXXXXXXXXXXXXXXXXXLLXXXXXXXL

SEQ ID NO: 29275 - protein, 66 aa, Diabrotica virgifera
  misc_feature: Coding regions on vcDNA: vcDNA=SeqID_8972; Strand=-; Position=1-198
  misc_feature (3)..(13): Xaa can be any naturally occurring amino acid
  misc_feature (23)..(30): Xaa can be any naturally occurring amino acid
  misc_feature (33)..(40): Xaa can be any naturally occurring amino acid
  misc_feature (52)..(64): Xaa can be any naturally occurring amino acid
PFXXXXXXXXXXXTNLAHTGLNXXXXXXXXSNXXXXXXXXPIITLIQHRGRXXXXXXXXXXXXXLL

SEQ ID NO: 29276 - protein, 78 aa, Diabrotica virgifera
  misc_feature: Coding regions on vcDNA: vcDNA=SeqID_8973; Strand=-; Position=3-236
  misc_feature (27)..(35): Xaa can be any naturally occurring amino acid
  misc_feature (52)..(78): Xaa can be any naturally occurring amino acid
ILNKLCNKNDGGSTQNPRNLFYTLKTXXXXXXXXXLFMLPIPILILIIPFLXXXXXXXXXXXXXXXXXXXXXXXXXXX

SEQ ID NO: 29277 - protein, 60 aa, Diabrotica virgifera
  misc_feature: Coding regions on vcDNA: vcDNA=SeqID_8974; Strand=-; Position=60-242
  misc_feature (14)..(22): Xaa can be any naturally occurring amino acid
  misc_feature (36)..(43): Xaa can be any naturally occurring amino acid
LFCSSYIELRTTKXXXXXXXXXQSPDTQRSKSIKIXXXXXXXXSYNPTKLSLNQIFLYFY

SEQ ID NO: 29278 - protein, 181 aa, Diabrotica virgifera
  misc_feature: Coding regions on vcDNA: vcDNA=SeqID_8975; Strand=+; Position=185-730
  misc_feature (162)..(169): Xaa can be any naturally occurring amino acid
FLFILDNWMKYCQLSIGLFQHELLDGPETVTKLLVPFVVRMFVIVSPSYRPMTVIIYLSFLLVTACVLLVDQRLKNFKELNPSAQVSPTSTLCICPITEMIITKPSPKDHNSCWNSGKGRSDDDHIFVGTDFVYCAESVPFRDGSRSCWNKPYKIYRVIHAXXXXXXXXVAFTLNNSFQLQ

SEQ ID NO: 29279 - protein, 117 aa, Diabrotica virgifera
  misc_feature: Coding regions on vcDNA: vcDNA=SeqID_8976; Strand=+; Position=1-354
  misc_feature (1)..(100): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXINYLRDNSVILLKSSNR

SEQ ID NO: 29280 - protein, 139 aa, Diabrotica virgifera
  misc_feature: Coding regions on vcDNA: vcDNA=SeqID_8977; Strand=+; Position=861-1277
  misc_feature (9)..(9): Xaa can be any naturally occurring amino acid
  misc_feature (87)..(100): Xaa can be any naturally occurring amino acid
  misc_feature (102)..(111): Xaa can be any naturally occurring amino acid
  misc_feature (113)..(130): Xaa can be any naturally occurring amino acid
MIPMLIPQXWSLWFKVNVNIIFPMDGPTKTPSSSLVFERFGDLFARKTLNPGPSFREIFFTNWFHEAKFLFVKGGGRKKRFKGYFTXXXXXXXXXXXXXXGXXXXXXXXXXQXXXXXXXXXXXXXXXXXXPLPPPPTIV

SEQ ID NO: 29281 - protein, 91 aa, Diabrotica virgifera
  misc_feature: Coding regions on vcDNA: vcDNA=SeqID_8978; Strand=+; Position=373-648
  misc_feature (51)..(57): Xaa can be any naturally occurring amino acid
VNWMMYMLFLHFFTFDVIHVRKYLKVSTLSITVSSIINWEFASADLDMIMXXXXXXXHLQSVFMTAFIKALHYNLLIIDVIRHYHCIVCKM

SEQ ID NO: 29282 - protein, 58 aa, Diabrotica virgifera
  misc_feature: Coding regions on vcDNA: vcDNA=SeqID_8979; Strand=-; Position=1-174
  misc_feature (1)..(53): Xaa can be any naturally occurring amino acid
XXXXXXXXXXXXXXXXXXXXXXXXXXXXXXXXXXXXXXXXXXXXXXXXXXXXXHPHFQ

SEQ ID NO: 29283 - protein, 119 aa, Diabrotica virgifera
  misc_feature: Coding regions on vcDNA: vcDNA=SeqID_8980; Strand=+; Position=183-542
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid
NYAVIPKVIYSYXXXXXXXXXXXXXXXXXXXXXXXXXPXXXXXXXXXXXXXXXXXXXXXXSIGSSXXXXXXXLFXXXXXXXXXXXXXXXXXXXPFIPXXXXXXXXYATLARSKYRGHSN

SEQ ID NO: 29284 - protein, 36 aa, Diabrotica virgifera
  misc_feature: Coding regions on vcDNA: vcDNA=SeqID_8981; Strand=-; Position=0-107
  misc_feature (2)..(17): Xaa can be any naturally occurring amino acid
LXXXXXXXXXXXXXXXXHAIGNPDAVGRPREIPDPV

SEQ ID NO: 29285 - protein, 190 aa, Diabrotica virgifera
  misc_feature: Coding regions on vcDNA: vcDNA=SeqID_8982; Strand=+; Position=149-718
  misc_feature (23)..(47): Xaa can be any naturally occurring amino acid
  misc_feature (51)..(190): Xaa can be any naturally occurring amino acid
KNFTFSYLRVSRGFLINNSYTYXXXXXXXXXXXXXXXXXXXXXXXXXNEIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29286 - protein, 289 aa, Diabrotica virgifera
  misc_feature: Coding regions on vcDNA: vcDNA=SeqID_8983; Strand=-; Position=14-883
  misc_feature (1)..(17): Xaa can be any naturally occurring amino acid
  misc_feature (19)..(19): Xaa can be any naturally occurring amino acid
  misc_feature (21)..(209): Xaa can be any naturally occurring amino acid
  misc_feature (212)..(249): Xaa can be any naturally occurring amino acid
  misc_feature (252)..(260): Xaa can be any naturally occurring amino acid
XXXXXXXXXXXXXXXXXKXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHFXXXXXXXXXXXXXXXXXXXXXXXXXXXXXXXXXXXXXXEVXXXXXXXXXVKDSLPDTELTDRWSERFFIYLLREKRFY

SEQ ID NO: 29287 - protein, 282 aa, Diabrotica virgifera
  misc_feature: Coding regions on vcDNA: vcDNA=SeqID_8984; Strand=+; Position=1-846
  misc_feature (4)..(10): Xaa can be any naturally occurring amino acid
  misc_feature (35)..(43): Xaa can be any naturally occurring amino acid
  misc_feature (49)..(282): Xaa can be any naturally occurring amino acid
FFSXXXXXXXPLRKVKKNLSLNIVNSVSGENTFTXXXXXXXXXVPRVSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29288 - protein, 266 aa, Diabrotica virgifera
  misc_feature: Coding regions on vcDNA: vcDNA=SeqID_8985; Strand=-; Position=2-799
  misc_feature (1)..(8): Xaa can be any naturally occurring amino acid
  misc_feature (11)..(22): Xaa can be any naturally occurring amino acid
  misc_feature (26)..(250): Xaa can be any naturally occurring amino acid
  misc_feature (252)..(266): Xaa can be any naturally occurring amino acid
XXXXXXXXINXXXXXXXXXXXXAFYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXX

SEQ ID NO: 29289 - protein, 296 aa, Diabrotica virgifera
  misc_feature: Coding regions on vcDNA: vcDNA=SeqID_8986; Strand=+; Position=2-892
  misc_feature (14)..(22): Xaa can be any naturally occurring amino acid
  misc_feature (35)..(45): Xaa can be any naturally occurring amino acid
  misc_feature (51)..(59): Xaa can be any naturally occurring amino acid
  misc_feature (64)..(89): Xaa can be any naturally occurring amino acid
  misc_feature (92)..(287): Xaa can be any naturally occurring amino acid
  misc_feature (294)..(294): Xaa can be any naturally occurring amino acid
TSLSGKAGTPCWVXXXXXXXXXDPQQSVITYSCVXXXXXXXXXXXFSVPPXXXXXXXXXHIFIXXXXXXXXXXXXXXXXXXXXXXXXXXKSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKTYRVLXNY

SEQ ID NO: 29290 - protein, 59 aa, Diabrotica virgifera
  misc_feature: Coding regions on vcDNA: vcDNA=SeqID_8987; Strand=-; Position=716-895
  misc_feature (1)..(1): Xaa can be any naturally occurring amino acid
XNNAGRHTQYILMANCAKEMKYFRLKLPDFFDRRNDQACHSFIDVSARWYLLLTVREHP

SEQ ID NO: 29291 - protein, 275 aa, Diabrotica virgifera
  misc_feature: Coding regions on vcDNA: vcDNA=SeqID_8988; Strand=+; Position=3-830
  misc_feature: Homolog annotation: Hit_ID=XP_316918.1; Match level="QueryCoverage =96%, HitCoverage=92%, E-value=1e-105, Identity=70%"; Hit description= ENSANGP00000011127 [Anopheles gambiae]
  misc_feature: Gene Ontology Annotation: Molecular function=general RNA polymerase II transcription factor activity; Cellular component=transcription factor TFIIH complex; Biological process=DNA repair
  misc_feature: Pfam annotation: Pfam_ID=Tfb4; Match level="Score=408.8, E-value=6.7e- 120, Copies=1"; Pfam description=Transcription factor Tfb4
  misc_feature (51)..(51): Xaa can be any naturally occurring amino acid
  misc_feature (62)..(62): Xaa can be any naturally occurring amino acid
  misc_feature (115)..(115): Xaa can be any naturally occurring amino acid
  misc_feature (275)..(275): Xaa can be any naturally occurring amino acid
DAWGIIIDSNPGQKTSRESPHVLTHRVDSVIAFANSHLTQKSQNKLAIIGXHSKTSQFIYPXPRQKSLDIRQVDGQYEVFTAVEKITKRNLAKVLTTENQLVITESLLAGAIAMXALCYIARLQRTKPPGAKLNCRVLVITGSSCSASQYMNYMNVFFTAQKQNVVIDGCALDQHLSLLQQGCDITGGMYLKVPQLQGLLQYLLWVFLPEPPIREKLVLPPPLKVDYRAACFCHRQLIDIGYVCSVCLSIFCKFSPICTTCHTVFKMPALPSVKX

SEQ ID NO: 29292 - protein, 221 aa, Diabrotica virgifera
  misc_feature: Coding regions on vcDNA: vcDNA=SeqID_8989; Strand=-; Position=3-665
  misc_feature (3)..(10): Xaa can be any naturally occurring amino acid
  misc_feature (13)..(20): Xaa can be any naturally occurring amino acid
  misc_feature (32)..(44): Xaa can be any naturally occurring amino acid
  misc_feature (47)..(221): Xaa can be any naturally occurring amino acid
LNXXXXXXXXSNXXXXXXXXPIINLIQHRGRXXXXXXXXXXXXXLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29293 - protein, 263 aa, Diabrotica virgifera
  misc_feature: Coding regions on vcDNA: vcDNA=SeqID_8990; Strand=-; Position=1-789
  misc_feature (1)..(1): Xaa can be any naturally occurring amino acid
  misc_feature (4)..(246): Xaa can be any naturally occurring amino acid
  misc_feature (249)..(263): Xaa can be any naturally occurring amino acid
XLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 29294 - protein, 280 aa, Diabrotica virgifera
  misc_feature: Coding regions on vcDNA: vcDNA=SeqID_8991; Strand=-; Position=3-842
  misc_feature (3)..(33): Xaa can be any naturally occurring amino acid
  misc_feature (35)..(36): Xaa can be any naturally occurring amino acid
  misc_feature (40)..(264): Xaa can be any naturally occurring amino acid
  misc_feature (267)..(280): Xaa can be any naturally occurring amino acid
NHXXXXXXXXXXXXXXXXXXXXXXXXXXXXXXXKXXKLFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRYXXXXXXXXXXXXXX

SEQ ID NO: 29295 - protein, 302 aa, Diabrotica virgifera
  misc_feature: Coding regions on vcDNA: vcDNA=SeqID_8992; Strand=-; Position=1-906
  misc_feature (3)..(79): Xaa can be any naturally occurring amino acid
  misc_feature (84)..(302): Xaa can be any naturally occurring amino acid
KKXXXXXXXXXXXXXXXXXXXXXXXXXXXXXXXXXXXXXXXXXXXXXXXXXXXXXXXXXXXXXXXXXXXXXXXXXXXXXPHFQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29296 - protein, 266 aa, Diabrotica virgifera
  misc_feature: Coding regions on vcDNA: vcDNA=SeqID_8993; Strand=-; Position=1-798
  misc_feature (3)..(22): Xaa can be any naturally occurring amino acid
  misc_feature (24)..(250): Xaa can be any naturally occurring amino acid
  misc_feature (252)..(266): Xaa can be any naturally occurring amino acid
LKXXXXXXXXXXXXXXXXXXXXAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXX

SEQ ID NO: 29297 - protein, 105 aa, Diabrotica virgifera
  misc_feature: Coding regions on vcDNA: vcDNA=SeqID_8994; Strand=+; Position=509-824
  misc_feature: Homolog annotation: Hit_ID=NP_610536.1; Match level="QueryCoverage =98%, HitCoverage=17%, E-value=2e-22, Identity=53%"; Hit description =CG12140-PA [Drosophila melanogaster] gb|AAF58873.1| CG12140-PA [Drosophila melanogaster]
  misc_feature: Gene Ontology Annotation: Molecular function=electron acceptor activity; Cellular component=mitochondrial inner membrane; Biological process=electron transport
  misc_feature (51)..(51): Xaa can be any naturally occurring amino acid
  misc_feature (81)..(81): Xaa can be any naturally occurring amino acid
LHEKASHVSVHILSAPLIQPTALDELIPYCQEKGAPLNTPATEYKFEYLTXTGRFNIPDFTGAPMHNHDNYIDTLCHDVDXLREPADALCDETYPEYAASDILYH

SEQ ID NO: 29298 - protein, 284 aa, Diabrotica virgifera
  misc_feature: Coding regions on vcDNA: vcDNA=SeqID_8995; Strand=+; Position=105-954
  misc_feature: Homolog annotation: Hit_ID=XP_317137.1; Match level="QueryCoverage =81%, HitCoverage=35%, E-value=7e-34, Identity=35%"; Hit description =ENSANGP00000018252 [Anopheles gambiae]
  misc_feature: Gene Ontology Annotation: Molecular function=molecular_function unknown; Biological process=reproduction
  misc_feature: Pfam annotation: Pfam_ID=DUF229; Match level="Score=-267.8, E-value =0.029, Copies=1"; Pfam description=Protein of unknown function (DUF229)
  misc_feature (194)..(194): Xaa can be any naturally occurring amino acid
  misc_feature (207)..(207): Xaa can be any naturally occurring amino acid
  misc_feature (233)..(233): Xaa can be any naturally occurring amino acid
  misc_feature (247)..(247): Xaa can be any naturally occurring amino acid
  misc_feature (249)..(249): Xaa can be any naturally occurring amino acid
  misc_feature (264)..(265): Xaa can be any naturally occurring amino acid
YRITISVRVYQQDNIFSRIEIGGNLAIVEKKLDLGVFTINTPGCKIPYFQPFDKNILDYLEQPGTHVCNNGTPALFESDRDSIKIIEDSLPFYNVTNINNLTCCYKIFWREDPADSAADNKISYSKGCQTFVNKTEVKEEFIKVTCSYNNRDIYTDMFVFVPTKNMSHVKKDLNEDDSNLNILVIGLDAISRLXFHRQMPKTVNYLXNKLGAVEIIGYNKVGDNTFPNGIPVXTGKHIEEIQKDCWXHXYHYFDIGSFVWKRYXXKGYVRFLTRIIMDGNFYYQ

SEQ ID NO: 29299 - protein, 237 aa, Diabrotica virgifera
  misc_feature: Coding regions on vcDNA: vcDNA=SeqID_8996; Strand=+; Position=1-714
  misc_feature: Homolog annotation: Hit_ID=AAR82757.1; Match level="QueryCoverage =89%, HitCoverage=46%, E-value=2e-85, Identity=48%"; Hit description =RE50384p [Drosophila melanogaster]
DAASSPRAYHGTPDQYEAGDLSGKFGSPINHTTYKTYYNDTLLSLFGPRSILGRSIVLFKRNSRRWACSTIERGYSPSEARELRAIASFHNPNGHAFGYMKMRQLIHKDGSPSDTTIEVKLRHPGKNDRNVTREHNWAIYVNPVGVDATVKTLATRCVAGGYVWNPYFTQLADPLNTDLYQQECGPENPLRCHVGDLSARLGTIDIGLERKVFTPRLYDKISSNVKWIKDSMNNDER

SEQ ID NO: 29300 - protein, 216 aa, Diabrotica virgifera
  misc_feature: Coding regions on vcDNA: vcDNA=SeqID_8997; Strand=-; Position=1-648
  misc_feature (1)..(165): Xaa can be any naturally occurring amino acid
  misc_feature (168)..(206): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDFXXXXXXXXXXXXXXXXXXXXXXXXXXXXXXXXXXXXXXXRYGKDKIFSF

SEQ ID NO: 29301 - protein, 228 aa, Diabrotica virgifera
  misc_feature: Coding regions on vcDNA: vcDNA=SeqID_8998; Strand=+; Position=204-889
  misc_feature: Homolog annotation: Hit_ID=XP_393479.1; Match level="QueryCoverage =100%, HitCoverage=41%, E-value=1e-65, Identity=54%"; Hit description= similar to ENSANGP00000010200 [Apis mellifera]
  misc_feature: Gene Ontology Annotation: Molecular function=heat shock protein activity; Biological process=protein folding
  misc_feature: Pfam annotation: Pfam_ID=DnaJ; Match level="Score=110.5, E-value=4.3e- 30, Copies=1"; Pfam description=DnaJ domain
  misc_feature (123)..(131): Xaa can be any naturally occurring amino acid
  misc_feature (179)..(179): Xaa can be any naturally occurring amino acid
  misc_feature (201)..(201): Xaa can be any naturally occurring amino acid
MDLDSEDENVMEEDYYSFLNIPREASKEEINNAYRRLSRIYHPDKHVDPELKEKAEIMFNKTKKAYEVLSDPHRRAIYDSLGTKGLETEGWEIVQRTKTPAEIRAEYEQLAEERAERLKKQAXXXXXXXXXAVNATDLFNPYYDEFLDEEYESDFLTQFPNIEVSSMQFSQSVDFPLTXKDSCTLSGQLQTQNGTGGGGIXFSWRHIFSHKSWAEMGMTAGSGPALSF

SEQ ID NO: 29302 - protein, 256 aa, Diabrotica virgifera
  misc_feature: Coding regions on vcDNA: vcDNA=SeqID_8999; Strand=-; Position=2-769
  misc_feature (9)..(9): Xaa can be any naturally occurring amino acid
  misc_feature (13)..(13): Xaa can be any naturally occurring amino acid
  misc_feature (15)..(15): Xaa can be any naturally occurring amino acid
  misc_feature (17)..(240): Xaa can be any naturally occurring amino acid
  misc_feature (242)..(256): Xaa can be any naturally occurring amino acid
INSIGSLVXKKIXAXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXX

SEQ ID NO: 29303 - protein, 236 aa, Diabrotica virgifera
  misc_feature: Coding regions on vcDNA: vcDNA=SeqID_9000; Strand=+; Position=1-708
  misc_feature (16)..(23): Xaa can be any naturally occurring amino acid
  misc_feature (29)..(43): Xaa can be any naturally occurring amino acid
  misc_feature (46)..(236): Xaa can be any naturally occurring amino acid
IFHYFKIIKIIFLRKXXXXXXXXIVNQYXXXXXXXXXXXXXXXYLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29304 - protein, 216 aa, Diabrotica virgifera
  misc_feature: Coding regions on vcDNA: vcDNA=SeqID_9001; Strand=+; Position=78-725
  misc_feature (11)..(21): Xaa can be any naturally occurring amino acid
  misc_feature (35)..(216): Xaa can be any naturally occurring amino acid
SKHYSFFKYHXXXXXXXXXXXLSNNISYQLNTFIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29305 - protein, 56 aa, Diabrotica virgifera
  misc_feature: Coding regions on vcDNA: vcDNA=SeqID_9002; Strand=+; Position=1-171
  misc_feature (3)..(24): Xaa can be any naturally occurring amino acid
  misc_feature (26)..(33): Xaa can be any naturally occurring amino acid
PPXXXXXXXXXXXXXXXXXXXXXXRXXXXXXXXDRNQPGSHRFKLRSCKILKVEQT

SEQ ID NO: 29306 - protein, 77 aa, Diabrotica virgifera
  misc_feature: Coding regions on vcDNA: vcDNA=SeqID_9003; Strand=-; Position=1-231
  misc_feature (2)..(9): Xaa can be any naturally occurring amino acid
  misc_feature (15)..(31): Xaa can be any naturally occurring amino acid
  misc_feature (50)..(59): Xaa can be any naturally occurring amino acid
SXXXXXXXXPYSLPXXXXXXXXXXXXXXXXXYLSLIKSNFSSPLLLNKDXXXXXXXXXXLKGGRPTNSSPLTSRRTT

SEQ ID NO: 29307 - protein, 234 aa, Diabrotica virgifera
  misc_feature: Coding regions on vcDNA: vcDNA=SeqID_9004; Strand=+; Position=236-937
  misc_feature: Homolog annotation: Hit_ID=XP_309800.1; Match level="QueryCoverage =100%, HitCoverage=38%, E-value=9e-76, Identity=61%"; Hit description= ENSANGP00000012563 [Anopheles gambiae]
  misc_feature: Gene Ontology Annotation: Cellular component=synaptic vesicle; Biological process=calcium ion homeostasis
  misc_feature (112)..(121): Xaa can be any naturally occurring amino acid
  misc_feature (218)..(218): Xaa can be any naturally occurring amino acid
  misc_feature (222)..(222): Xaa can be any naturally occurring amino acid
TLGNLFVAGLAWLIIPADIGFKNQYFVYNSWRIFLLICSFPSFIVAALLCFLPESPKFLLTQGKSEEALAIFKYIYHVNTGNDPEDYPVKHLIYEQEELTLEQKAKIAKRGXXXXXXXXXXDNSKQLFVSPILKFTVISITINFTFHIGYYGLMMWFPEMFNRFDEYAKIHDGAEAGVCEVVDYVVSSGSHSGSVLCSDKISSSVFLESFDTVSAALXKYIXAVLGMDKLGRNF

SEQ ID NO: 29308 - protein, 99 aa, Diabrotica virgifera
  misc_feature: Coding regions on vcDNA: vcDNA=SeqID_9005; Strand=-; Position=1-300
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(99): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXX

SEQ ID NO: 29309 - protein, 186 aa, Diabrotica virgifera
  misc_feature: Coding regions on vcDNA: vcDNA=SeqID_9006; Strand=+; Position=97-657
  misc_feature: Homolog annotation: Hit_ID=EAA04293.2; Match level="QueryCoverage =95%, HitCoverage=91%, E-value=3e-43, Identity=48%"; Hit description =ENSANGP00000013275 [Anopheles gambiae str. PEST] ref|XP_565371.1| ENSANGP00000013275 [Anopheles gambiae st
  misc_feature: Gene Ontology Annotation: Molecular function=5-formyltetrahydrofolate cyclo-ligase activity; Cellular component=cytosol; Biological process= formate metabolism
  misc_feature: Pfam annotation: Pfam_ID=5-FTHF_cyc-lig; Match level="Score=183.3, E -value=5e-52, Copies=1"; Pfam description=5-formyltetrahydrofolate cyclo-ligase
  misc_feature (7)..(7): Xaa can be any naturally occurring amino acid
MGSDIKXEGKLGQLTPQERQRQSQIVKEKLFGLDQFKDARNISIYLSLDTEIDTEPIVRKIFQDQKRCFVPRYNKKVMEMVELHSMEDWTNLPVTKWNIKQPSFKDERKNALDEGLDLIILPGVAFTKNGDRLGHGGGYYDRFLRTVCKKQAKPPALIAVGFNVQVVDSIPTEETDYKLDMVLYSE

SEQ ID NO: 29310 - protein, 34 aa, Diabrotica virgifera
  misc_feature: Coding regions on vcDNA: vcDNA=SeqID_9007; Strand=-; Position=1-102
  misc_feature (3)..(34): Xaa can be any naturally occurring amino acid
EVXXXXXXXXXXXXXXXXXXXXXXXXXXXXXXXX

SEQ ID NO: 29311 - protein, 158 aa, Diabrotica virgifera
  misc_feature: Coding regions on vcDNA: vcDNA=SeqID_9008; Strand=+; Position=100-577
  misc_feature: Homolog annotation: Hit_ID=NP_060317.3; Match level="QueryCoverage =82%, HitCoverage=28%, E-value=8e-14, Identity=31%"; Hit description =chromosome 1 open reading frame 27 [Homo sapiens] gb|AAW30011.1| odorant response abnormal 4
  misc_feature (16)..(16): Xaa can be any naturally occurring amino acid
  misc_feature (108)..(125): Xaa can be any naturally occurring amino acid
MKTYIAVGLIVGQSSXDKDYVVHLAKTPPFQTDEDKKAGKSAPTPKSLEDFNPSWVADHAKQATRMLPGGFYVLGIFITAPDDILNPFHSKIKSLLQTVQNYLNTNKXXXXXXXXXXXXXXXXXXTKKYYSRSYDVNSHNVQNVDVKSVAKRWTNGTV

SEQ ID NO: 29312 - protein, 101 aa, Diabrotica virgifera
  misc_feature: Coding regions on vcDNA: vcDNA=SeqID_9009; Strand=+; Position=341-646
  misc_feature (10)..(15): Xaa can be any naturally occurring amino acid
  misc_feature (27)..(33): Xaa can be any naturally occurring amino acid
  misc_feature (38)..(46): Xaa can be any naturally occurring amino acid
  misc_feature (73)..(80): Xaa can be any naturally occurring amino acid
GKGSKIYLPXXXXXXVRRFHYGAVFNXXXXXXXRIILXXXXXXXXXDTFANLVKEPSSGYIVFIFFWFSQIFXXXXXXXXVFYFYIIICKDIFGYYLNLLE

SEQ ID NO: 29313 - protein, 267 aa, Diabrotica virgifera
  misc_feature: Coding regions on vcDNA: vcDNA=SeqID_9010; Strand=+; Position=25-829
  misc_feature: Homolog annotation: Hit_ID=EAA15064.2; Match level="QueryCoverage =67%, HitCoverage=48%, E-value=5e-22, Identity=34%"; Hit description =ENSANGP00000019373 [Anopheles gambiae str. PEST] ref|XP_552883.1| ENSANGP00000019373 [Anopheles gambiae st
  misc_feature: Gene Ontology Annotation: Molecular function=molecular_function unknown
  misc_feature: Pfam annotation: Pfam_ID=DUF227; Match level="Score=75.5, E-value =1.5e-19, Copies=1"; Pfam description=Domain of unknown function (DUF227)
  misc_feature (50)..(50): Xaa can be any naturally occurring amino acid
MESERIKDLNNLLKPALGENVEIVDKTITNLTQPGENYFSDIAQIASNNXNKDTNATKTEHFVAKCCIVDESLPKEFSMASRHMFKPEITFYNEIIPTMQKFAKEHGLKKVDFFAKLIAARYNLDGKEEPDQNAILLLENLQVAGYSNEDRHKGFDFDGAKLLLTDLATFHAIPLAIKLKDPDLFKKVFLDNCPGPPTFMDKSNDKGPGHGDNFCRYVDKLDAILDADEEKFKKGNMFDKPDPTKRSFLESYIKTCVIIRQRRTKME

SEQ ID NO: 29314 - protein, 37 aa, Diabrotica virgifera
  misc_feature: Coding regions on vcDNA: vcDNA=SeqID_9011; Strand=+; Position=64-174
  misc_feature (16)..(37): Xaa can be any naturally occurring amino acid
SNQFIITSLLSNLKSXXXXXXXXXXXXXXXXXXXXXX

SEQ ID NO: 29315 - protein, 236 aa, Diabrotica virgifera
  misc_feature: Coding regions on vcDNA: vcDNA=SeqID_9012; Strand=+; Position=193-903
  misc_feature: Homolog annotation: Hit_ID=XP_317365.1; Match level="QueryCoverage =56%, HitCoverage=23%, E-value=3e-22, Identity=39%"; Hit description =ENSANGP00000010401 [Anopheles gambiae]
  misc_feature (189)..(189): Xaa can be any naturally occurring amino acid
MDHRQRPTPAPCPFGTVRQPDGSCTKPNRDYLPPVTTQPPTTDDGYHYDRPSPPFELPGTDSSVTIPGPTTEHEGMDSKIKESIRLPDHKEENAESSKTNNVLIKPTTEGSTKGGTRPVKTPTRRPPPDNGGDEVQAPAGCAAALKCVQEIYCTAEGVVSPVPVVLTKDQELLRVPTTVCRDIETGILXKCCRDPNYKDPWPSANLVDGVDDGQYKEDDFYAHQLCDFRLARMTEE

SEQ ID NO: 29316 - protein, 71 aa, Diabrotica virgifera
  misc_feature: Coding regions on vcDNA: vcDNA=SeqID_9013; Strand=-; Position=1-213
  misc_feature (8)..(15): Xaa can be any naturally occurring amino acid
  misc_feature (17)..(17): Xaa can be any naturally occurring amino acid
  misc_feature (20)..(20): Xaa can be any naturally occurring amino acid
  misc_feature (26)..(26): Xaa can be any naturally occurring amino acid
  misc_feature (28)..(35): Xaa can be any naturally occurring amino acid
  misc_feature (38)..(45): Xaa can be any naturally occurring amino acid
  misc_feature (57)..(69): Xaa can be any naturally occurring amino acid
YFIYWSFXXXXXXXXKXRNXPGSHRXKXXXXXXXXSNXXXXXXXXPIINLIQHRGRXXXXXXXXXXXXXLL

SEQ ID NO: 29317 - protein, 112 aa, Diabrotica virgifera
  misc_feature: Coding regions on vcDNA: vcDNA=SeqID_9014; Strand=-; Position=0-335
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(98): Xaa can be any naturally occurring amino acid
  misc_feature (101)..(109): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXHPXXXXXXXXXGRG

SEQ ID NO: 29318 - protein, 250 aa, Diabrotica virgifera
  misc_feature: Coding regions on vcDNA: vcDNA=SeqID_9015; Strand=-; Position=1-750
  misc_feature (1)..(11): Xaa can be any naturally occurring amino acid
  misc_feature (13)..(250): Xaa can be any naturally occurring amino acid
XXXXXXXXXXXHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29319 - protein, 317 aa, Diabrotica virgifera
  misc_feature: Coding regions on vcDNA: vcDNA=SeqID_9016; Strand=-; Position=1-951
  misc_feature (5)..(24): Xaa can be any naturally occurring amino acid
  misc_feature (28)..(283): Xaa can be any naturally occurring amino acid
  misc_feature (286)..(317): Xaa can be any naturally occurring amino acid
KNGSXXXXXXXXXXXXXXXXXXXXINYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXXXXXXXXXXXXXXXXXXX

SEQ ID NO: 29320 - protein, 106 aa, Diabrotica virgifera
  misc_feature: Coding regions on vcDNA: vcDNA=SeqID_9017; Strand=-; Position=2-319
TPQLLVYKNSQHLCYYRGKCCNKLAARNKLLVYLSTDIEYCRTFTIYDGEVCPYSCRPLTLNKLRKRHQPVSILLLSNVPRYKRNLVISVFVIERVHCIIYYISKV

SEQ ID NO: 29321 - protein, 156 aa, Diabrotica virgifera
  misc_feature: Coding regions on vcDNA: vcDNA=SeqID_9018; Strand=-; Position=70-540
  misc_feature (1)..(121): Xaa can be any naturally occurring amino acid
  misc_feature (126)..(148): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNVSLXXXXXXXXXXXXXXXXXXXXXXXRIMSDENY

SEQ ID NO: 29322 - protein, 214 aa, Diabrotica virgifera
  misc_feature: Coding regions on vcDNA: vcDNA=SeqID_9019; Strand=+; Position=264-908
  misc_feature: Homolog annotation: Hit_ID=XP_317446.1; Match level="QueryCoverage =94%, HitCoverage=29%, E-value=4e-47, Identity=44%"; Hit description =ENSANGP00000011863 [Anopheles gambiae]
  misc_feature: Gene Ontology Annotation: Molecular function=acyl-CoA oxidase activity; Cellular component=peroxisome; Biological process=fatty acid metabolism
  misc_feature (38)..(38): Xaa can be any naturally occurring amino acid
  misc_feature (101)..(101): Xaa can be any naturally occurring amino acid
  misc_feature (142)..(150): Xaa can be any naturally occurring amino acid
  misc_feature (178)..(178): Xaa can be any naturally occurring amino acid
  misc_feature (184)..(184): Xaa can be any naturally occurring amino acid
  misc_feature (192)..(192): Xaa can be any naturally occurring amino acid
  misc_feature (194)..(194): Xaa can be any naturally occurring amino acid
MDVEDNKLVFRDLPVGPLTPYRRLSKFDWRKLKLFFEXQKWLKVQIQVWKTLEADPLFQRPRVEISTDEKQRMAALQLKKYIDYNFVNPDINKVPYKKRTXYNWACNQAIAVTFPEVSIKLALGQGLFTNTIVTLGTERHFXXXXXXXXXLSCLALTEISHGSNTKQMRTTATYDPQXQEFVIXTPDFEAAXCXVGNLGKHARTHYFLPTVPRG

SEQ ID NO: 29323 - protein, 308 aa, Diabrotica virgifera
  misc_feature: Coding regions on vcDNA: vcDNA=SeqID_9020; Strand=+; Position=2-925
  misc_feature (251)..(251): Xaa can be any naturally occurring amino acid
  misc_feature (254)..(271): Xaa can be any naturally occurring amino acid
RACISKKRLSADERLNSSCKTYYKVEVVTPKLRQNSTTKSQESTKRQQSQSPKRDDEKEKGLIVKFKKLRNSELIQLNNEATNFLFPKKDDSSEEEDDEANTTASSADSCSNTEIEDCKTSTPNIRNEDETSMDSTGRKKRRRTHAEAFIMDNQKYYKFETPGSSHCRLRYQGSYLPLVMKSPERPAKTEEDVKIEEPEEKKTKHVQSSKIKLSKYKFAFEQVPVHMGWYQAFKRLDNTEQTYPCFSNYLXEEXXXXXXXXXXXXXXXXXXLSHYQELLKGLMAVASVKSESSTRSSSPRRMSSSSSL

SEQ ID NO: 29324 - protein, 297 aa, Diabrotica virgifera
  misc_feature: Coding regions on vcDNA: vcDNA=SeqID_9021; Strand=+; Position=1-888
  misc_feature: Homolog annotation: Hit_ID=AAF87759.1; Match level="QueryCoverage =96%, HitCoverage=64%, E-value=1e-111, Identity=76%"; Hit description= cytochrome oxidase subunit I [Diabrotica virgifera virgifera]
  misc_feature: Pfam annotation: Pfam_ID=COX1; Match level="Score=98.7, E-value=1.5e -26, Copies=1"; Pfam description=Cytochrome C and Quinol oxidase polyp
  misc_feature (38)..(38): Xaa can be any naturally occurring amino acid
  misc_feature (69)..(69): Xaa can be any naturally occurring amino acid
  misc_feature (87)..(87): Xaa can be any naturally occurring amino acid
  misc_feature (115)..(123): Xaa can be any naturally occurring amino acid
  misc_feature (127)..(133): Xaa can be any naturally occurring amino acid
  misc_feature (144)..(151): Xaa can be any naturally occurring amino acid
  misc_feature (172)..(172): Xaa can be any naturally occurring amino acid
  misc_feature (207)..(207): Xaa can be any naturally occurring amino acid
  misc_feature (224)..(224): Xaa can be any naturally occurring amino acid
  misc_feature (227)..(233): Xaa can be any naturally occurring amino acid
  misc_feature (260)..(266): Xaa can be any naturally occurring amino acid
  misc_feature (279)..(279): Xaa can be any naturally occurring amino acid
  misc_feature (288)..(297): Xaa can be any naturally occurring amino acid
EWGVGTGRTVYPPQSSNIAHGGPSVDLAIFRLHLAGIXSSILGAINFITTVINIRPIGITFDRIPLFVXLVVITAILLLLSLPVLAXGAITILLTDRNLNTSFFDPAGGGDPILXXXXXXXXXHPEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIXMISLFTGIXXXXXXXXXX

SEQ ID NO: 29325 - protein, 182 aa, Diabrotica virgifera
  misc_feature: Coding regions on vcDNA: vcDNA=SeqID_9022; Strand=-; Position=234-782
  misc_feature (3)..(133): Xaa can be any naturally occurring amino acid
  misc_feature (135)..(153): Xaa can be any naturally occurring amino acid
  misc_feature (156)..(163): Xaa can be any naturally occurring amino acid
HPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXXXXXXXXXXXXXXXXXEIXXXXXXXXKKLDDYLKTSNVSITKKII

SEQ ID NO: 29326 - protein, 125 aa, Diabrotica virgifera
  misc_feature: Coding regions on vcDNA: vcDNA=SeqID_9023; Strand=+; Position=2-376
  misc_feature (34)..(43): Xaa can be any naturally occurring amino acid
  misc_feature (45)..(51): Xaa can be any naturally occurring amino acid
  misc_feature (56)..(125): Xaa can be any naturally occurring amino acid
AVRILYFSLYKINQKSSSLQSKGNRKNLYLHRSXXXXXXXXXXTXXXXXXXFSYLXXXXXXXXXXXXXXXXXXXXXXXXXXXXXXXXXXXXXXXXXXXXXXXXXXXXXXXXXXXXXXXXXXXXXX

SEQ ID NO: 29327 - protein, 91 aa, Diabrotica virgifera
  misc_feature: Coding regions on vcDNA: vcDNA=SeqID_9024; Strand=+; Position=3-278
  misc_feature (13)..(22): Xaa can be any naturally occurring amino acid
  misc_feature (73)..(82): Xaa can be any naturally occurring amino acid
DAWVFRIIPYVMXXXXXXXXXXNLIICITNYEDLGSATPEVYKMGAHENMIYKKLSIHHMKINIMINEVILKXXXXXXXXXXGFTSIGVAI

SEQ ID NO: 29328 - protein, 95 aa, Diabrotica virgifera
  misc_feature: Coding regions on vcDNA: vcDNA=SeqID_9025; Strand=-; Position=75-362
CNEVICCRTYILKIELCGSLDDLRSYSIVGQGISDVFDALFTYHGDLCFDVDNNYRSDILQTIVTYFSFPAVEYCHVGHVTPVDYYAHVPAVHAW

SEQ ID NO: 29329 - protein, 319 aa, Diabrotica virgifera
  misc_feature: Coding regions on vcDNA: vcDNA=SeqID_9026; Strand=-; Position=3-959
  misc_feature (1)..(12): Xaa can be any naturally occurring amino acid
  misc_feature (15)..(22): Xaa can be any naturally occurring amino acid
  misc_feature (25)..(49): Xaa can be any naturally occurring amino acid
  misc_feature (52)..(276): Xaa can be any naturally occurring amino acid
  misc_feature (279)..(314): Xaa can be any naturally occurring amino acid
XXXXXXXXXXXXITXXXXXXXXNKXXXXXXXXXXXXXXXXXXXXXXXXXFYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRYXXXXXXXXXXXXXXXXXXXXXXXXXXXXXXXXXXXXLEWVK

SEQ ID NO: 29330 - protein, 183 aa, Diabrotica virgifera
  misc_feature: Coding regions on vcDNA: vcDNA=SeqID_9027; Strand=+; Position=264-816
  misc_feature: Homolog annotation: Hit_ID=EAL29709.1; Match level="QueryCoverage =68%, HitCoverage=12%, E-value=2e-17, Identity=38%"; Hit description =GA12467-PA [Drosophila pseudoobscura]
  misc_feature (79)..(79): Xaa can be any naturally occurring amino acid
MVSYGQPNFYKPAYYYPNQVYPNFQKYGSPNDQKYGSPNITQSIMDVLYSVARNDDLQCIPRILCEMTTGTFNGSSDRXNLPLNIDMQSLLGFLSSLNGLSISPLVYFGRAALLGYTSKGNKGSCTSAYPNCPSDADKLVQYLNNYNGGFFRFFHGLKSQSYVPHQHNDALHKFWTELLWKVS

SEQ ID NO: 29331 - protein, 58 aa, Diabrotica virgifera
  misc_feature: Coding regions on vcDNA: vcDNA=SeqID_9028; Strand=+; Position=1-174
  misc_feature (1)..(15): Xaa can be any naturally occurring amino acid
  misc_feature (18)..(57): Xaa can be any naturally occurring amino acid
XXXXXXXXXXXXXXXYLXXXXXXXXXXXXXXXXXXXXXXXXXXXXXXXXXXXXXXXXV

SEQ ID NO: 29332 - protein, 64 aa, Diabrotica virgifera
  misc_feature: Coding regions on vcDNA: vcDNA=SeqID_9029; Strand=+; Position=203-397
  misc_feature (6)..(30): Xaa can be any naturally occurring amino acid
  misc_feature (32)..(43): Xaa can be any naturally occurring amino acid
GNLFLXXXXXXXXXXXXXXXXXXXXXXXXXPXXXXXXXXXXXXLKLLINNLLKLYRDFSCIIMI

SEQ ID NO: 29333 - protein, 38 aa, Diabrotica virgifera
  misc_feature: Coding regions on vcDNA: vcDNA=SeqID_9030; Strand=-; Position=1-114
  misc_feature (3)..(19): Xaa can be any naturally occurring amino acid
  misc_feature (22)..(32): Xaa can be any naturally occurring amino acid
  misc_feature (34)..(35): Xaa can be any naturally occurring amino acid
HPXXXXXXXXXXXXXXXXXNNXXXXXXXXXXXKXXKLL

SEQ ID NO: 29334 - protein, 56 aa, Diabrotica virgifera
  misc_feature: Coding regions on vcDNA: vcDNA=SeqID_9031; Strand=-; Position=173-343
FRKNLSLAVQLIQFLVQAIHILLFNLTISFRLILHLVKFCHIRKSDLPLSHSYFIW

SEQ ID NO: 29335 - protein, 186 aa, Diabrotica virgifera
  misc_feature: Coding regions on vcDNA: vcDNA=SeqID_9032; Strand=+; Position=253-813
  misc_feature: Gene Ontology Annotation: Molecular function=molecular_function unknown; Cellular component=cellular_component unknown; Biological process=cell growth and/or maintenance
  misc_feature: Pfam annotation: Pfam_ID=Sua5_yciO_yrdC; Match level="Score=110.4, E -value=4.6e-30, Copies=1"; Pfam description=yrdC domain
  misc_feature (170)..(175): Xaa can be any naturally occurring amino acid
MSLHIPVTSKNGYVIAVPTDTVYGIACDATNKSAIGNMYDIKCRNENKPLALCLSQVSDVKKIGYVSHLPQKLLDSLLPGPITIILPCVDKTLDHSLSIEGKVGVRIPDCSFIRSLSSGLGKPLALTSANLSNEKNAIEIDDFKNIWQKLPVIFDGGKLKEDNNASTVVXXXXXXIFNIVRKGVSW

SEQ ID NO: 29336 - protein, 269 aa, Diabrotica virgifera
  misc_feature: Coding regions on vcDNA: vcDNA=SeqID_9033; Strand=+; Position=3-812
  misc_feature: Homolog annotation: Hit_ID=EAA06354.2; Match level="QueryCoverage =94%, HitCoverage=81%, E-value=1e-113, Identity=68%"; Hit description= ENSANGP00000019906 [Anopheles gambiae str. PEST] ref|XP_566299.1| ENSANGP00000019906 [Anopheles gambiae s
  misc_feature: Gene Ontology Annotation: Molecular function=ATP binding; Cellular component=extracellular space; Biological process=cell adhesion
  misc_feature: Pfam annotation: Pfam_ID=EGF; Match level="Score=95.4, E-value=1.5e -25, Copies=4"; Pfam description=EGF-like domain
  misc_feature (228)..(228): Xaa can be any naturally occurring amino acid
  misc_feature (240)..(240): Xaa can be any naturally occurring amino acid
  misc_feature (256)..(264): Xaa can be any naturally occurring amino acid
SEVSYVNFTRKAGNKKYYYHFDRLQSYDQSILEAPVISIKTKGRVPRRPKEFSIFLPCIGNSSGIAKFGIGLLIETRKGKPLNGTPLRLKLKKECAQRNPDPECDKKCANQGRCNHEKICQCPEGYMGPYCRTALCYPQCMNGGNCTSPGICSCPPGFQGRHCEGGICGEKCLNGGKCIQKDTCECSKGYYGPHCEYSRCIIPCLNGGKCKAVNKCRCPRGFRGDHCXIGRAKPARSNCXLAWQHGTCVDDSCVCXXXXXXXXXHHMIM

SEQ ID NO: 29337 - protein, 183 aa, Diabrotica virgifera
  misc_feature: Coding regions on vcDNA: vcDNA=SeqID_9034; Strand=-; Position=132-683
  misc_feature (1)..(160): Xaa can be any naturally occurring amino acid
  misc_feature (164)..(174): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAHPXXXXXXXXXXXYLIDKYIVR

SEQ ID NO: 29338 - protein, 129 aa, Diabrotica virgifera
  misc_feature: Coding regions on vcDNA: vcDNA=SeqID_9035; Strand=+; Position=41-427
  misc_feature (46)..(70): Xaa can be any naturally occurring amino acid
  misc_feature (74)..(129): Xaa can be any naturally occurring amino acid
RKISHSTSLISTRSESFTFIKRKISIFSYLAYPGSISISIIIIIYXXXXXXXXXXXXXXXXXXXXXXXXXNEIXXXXXXXXXXXXXXXXXXXXXXXXXXXXXXXXXXXXXXXXXXXXXXXXXXXXXXXX

SEQ ID NO: 29339 - protein, 138 aa, Diabrotica virgifera
  misc_feature: Coding regions on vcDNA: vcDNA=SeqID_9036; Strand=+; Position=26-442
  misc_feature (62)..(67): Xaa can be any naturally occurring amino acid
  misc_feature (96)..(105): Xaa can be any naturally occurring amino acid
  misc_feature (129)..(137): Xaa can be any naturally occurring amino acid
LHQGLISYSSPRYGGRASDKRIFLNEKVLLKLDPNDAVMVDKGFLIEKECQEHLVKLIRPPXXXXXXQLSKQESVQTAEIARARVHVERAIQRIKXXXXXXXXXXTYLLPYCDDILKIICAIINISSPXXXXXXXXXL

SEQ ID NO: 29340 - protein, 308 aa, Diabrotica virgifera
  misc_feature: Coding regions on vcDNA: vcDNA=SeqID_9037; Strand=+; Position=33-956
  misc_feature (4)..(11): Xaa can be any naturally occurring amino acid
  misc_feature (255)..(255): Xaa can be any naturally occurring amino acid
  misc_feature (273)..(273): Xaa can be any naturally occurring amino acid
  misc_feature (292)..(292): Xaa can be any naturally occurring amino acid
  misc_feature (294)..(294): Xaa can be any naturally occurring amino acid
RTNXXXXXXXXPIPYHTETTIIRPIKYTKTSMKIIVEYAEPSAFQNKEEKSKTKKKKSREKMKENADEEKPNKKVKKRQSFIKRVWKKKDKHKDKHEEKVENKVEEEDEEEIYETVPPTVVEKVAVTDNKTVQMLSELHNILEHKMPIIIERMSNETHSPKLQSPTGSISPTIAETQENVIQSNVENVTEPPCPLLPPKAQKQDALSPFHDVPTNNKPVALPPKRRNTEPVKSLDQILDELDNEQQETNKKNKVXKLIKKFSEPDFYDTDVVXRTQKSGIHRPDIHSDELSXVXERVVKGTNAPMLIP

SEQ ID NO: 29341 - protein, 109 aa, Diabrotica virgifera
  misc_feature: Coding regions on vcDNA: vcDNA=SeqID_9038; Strand=+; Position=310-639
  misc_feature: Homolog annotation: Hit_ID=BAC82592.1; Match level="QueryCoverage =83%, HitCoverage=11%, E-value=1e-11, Identity=35%"; Hit description =reverse transcriptase [Ciona intestinalis]
  misc_feature: Gene Ontology Annotation: Molecular function=molecular_function unknown; Cellular component=cellular_component unknown; Biological process=biological_process unknown
METREAHFALNILRKDVFACFVDFEKAFDKVQHVKLMQILKNIGIDDKDIRVIKNLYWNQTAIVKIEDNYTDEISIQRGVRQGCILSPTLFNIYLDQLFKKALESTYST

SEQ ID NO: 29342 - protein, 291 aa, Diabrotica virgifera
  misc_feature: Coding regions on vcDNA: vcDNA=SeqID_9039; Strand=+; Position=2-874
  misc_feature (6)..(11): Xaa can be any naturally occurring amino acid
  misc_feature (40)..(46): Xaa can be any naturally occurring amino acid
  misc_feature (69)..(290): Xaa can be any naturally occurring amino acid
PRPIYXXXXXXIFYVKRNRKNLYLQRSVQFSIRGDESPSXXXXXXXLFVPRVSRGFIINHYIFHNFRIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXY

SEQ ID NO: 29343 - protein, 293 aa, Diabrotica virgifera
  misc_feature: Coding regions on vcDNA: vcDNA=SeqID_9040; Strand=+; Position=1-879
  misc_feature (3)..(89): Xaa can be any naturally occurring amino acid
  misc_feature (91)..(293): Xaa can be any naturally occurring amino acid
YLXXXXXXXXXXXXXXXXXXXXXXXXXXXXXXXXXXXXXXXXXXXXXXXXXXXXXXXXXXXXXXXXXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29344 - protein, 92 aa, Diabrotica virgifera
  misc_feature: Coding regions on vcDNA: vcDNA=SeqID_9041; Strand=+; Position=245-523
  misc_feature (25)..(31): Xaa can be any naturally occurring amino acid
  misc_feature (73)..(81): Xaa can be any naturally occurring amino acid
YSRCTRYRPTPTLSLQRQQRSSLYXXXXXXXLLLGLVHIIPRRRIHLRLRQKRLLKKSYSKNQTPDTTVMSQXXXXXXXXXIISHKTTLSYI

SEQ ID NO: 29345 - protein, 67 aa, Diabrotica virgifera
  misc_feature: Coding regions on vcDNA: vcDNA=SeqID_9042; Strand=-; Position=3-203
  misc_feature (8)..(14): Xaa can be any naturally occurring amino acid
RFVSFAKXXXXXXXAHSQCSISRGKNDVEHVIFQHVYCLTFQTRRSLHTILLSNAYSILYIIRITGQ

SEQ ID NO: 29346 - protein, 51 aa, Diabrotica virgifera
  misc_feature: Coding regions on vcDNA: vcDNA=SeqID_9043; Strand=-; Position=162-317
  misc_feature (32)..(39): Xaa can be any naturally occurring amino acid
NSVLILLKILKKECVFCSRVRSYTSIFMISTXXXXXXXXRRKIKFLYGCIP

SEQ ID NO: 29347 - protein, 72 aa, Diabrotica virgifera
  misc_feature: Coding regions on vcDNA: vcDNA=SeqID_9044; Strand=+; Position=109-327
  misc_feature (53)..(59): Xaa can be any naturally occurring amino acid
RRKHTKLSINTGESVITPCLHVFEILDILLKIVVQCAIVANEHFCVCGRFCFXXXXXXXSYRETKFQSFLGT

SEQ ID NO: 29348 - protein, 66 aa, Diabrotica virgifera; identical to SEQ ID NO: 26808
  misc_feature: Coding regions on vcDNA: vcDNA=SeqID_9045; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 29349 - protein, 23 aa, Diabrotica virgifera
  misc_feature: Coding regions on vcDNA: vcDNA=SeqID_9046; Strand=+; Position=3-71
  misc_feature (1)..(7): Xaa can be any naturally occurring amino acid
XXXXXXXFLPRYQGFIINNYTLT

SEQ ID NO: 29350 - protein, 160 aa, Diabrotica virgifera
  misc_feature: Coding regions on vcDNA: vcDNA=SeqID_9047; Strand=+; Position=103-585
LSTASEILDGQELVTQLEVLMTDNNCAFFRPSRLTFSLLKSEADKQLSHTINKTAKPADVNHTLTVMKELLLTCDTSSADLNMSSLFTSKVTIRYNNHEPCGNNAYLKWNFIPSFHIHDRSSPSTLRVILDKPTVQIRNDRNQMNMNRTNYLPNFYDTLL

SEQ ID NO: 29351 - protein, 127 aa, Diabrotica virgifera
  misc_feature: Coding regions on vcDNA: vcDNA=SeqID_9048; Strand=-; Position=334-717
  misc_feature (8)..(38): Xaa can be any naturally occurring amino acid
  misc_feature (54)..(87): Xaa can be any naturally occurring amino acid
  misc_feature (97)..(121): Xaa can be any naturally occurring amino acid
KLNKDSLXXXXXXXXXXXXXXXXXXXXXXXXXXXXXXXSVGGRVFIFSSNRRVXXXXXXXXXXXXXXXXXXXXXXXXXXXXXXXXXXNVNKVNLYLXXXXXXXXXXXXXXXXXXXXXXXXXILLMVI

SEQ ID NO: 29352 - protein, 288 aa, Diabrotica virgifera
  misc_feature: Coding regions on vcDNA: vcDNA=SeqID_9049; Strand=-; Position=69-935
  misc_feature (1)..(263): Xaa can be any naturally occurring amino acid
  misc_feature (266)..(278): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRYXXXXXXXXXXXXXLSTDTRLTIR

SEQ ID NO: 29353 - protein, 75 aa, Diabrotica virgifera
  misc_feature: Coding regions on vcDNA: vcDNA=SeqID_9050; Strand=+; Position=422-649
LGSGINSTQTAILCFICSSVTCSKSVLSSRMKIIYSMQQGYEFTPSVFWKPNSSSFSSLKICFLVSHLEVYFVRY

SEQ ID NO: 29354 - protein, 22 aa, Diabrotica virgifera
  misc_feature: Coding regions on vcDNA: vcDNA=SeqID_9051; Strand=-; Position=0-65
  misc_feature (3)..(13): Xaa can be any naturally occurring amino acid
  misc_feature (17)..(21): Xaa can be any naturally occurring amino acid
KKXXXXXXXXXXXFSSXXXXXA

SEQ ID NO: 29355 - protein, 212 aa, Diabrotica virgifera
  misc_feature: Coding regions on vcDNA: vcDNA=SeqID_9052; Strand=+; Position=1-639
  misc_feature: Homolog annotation: Hit_ID=EAA00130.3; Match level="QueryCoverage =89%, HitCoverage=15%, E-value=2e-24, Identity=36%"; Hit description =ENSANGP00000013352 [Anopheles gambiae str. PEST] ref|XP_551992.1| ENSANGP00000013352 [Anopheles gambiae st
TKYIILTDSLSSVQSIQYVYPSNPLVIKIKQEVHTAQLNGKIIIFLWIPSHIGIQGNEEADNAAKEAATSDSAECTETFTSADVKAAIKRKVRYMWEEKWKVSSAKLREIKKSIKPWPTLPTSRRDQVILTRLRLGHTRLTNSHVFSYKQEPRCDNCEEKLTIKHLLENCAALTPKRILYNIPNKLSDILGLQCNMSNLKRFLSAINILYNI

SEQ ID NO: 29356 - protein, 66 aa, Diabrotica virgifera
  misc_feature: Coding regions on vcDNA: vcDNA=SeqID_9053; Strand=+; Position=155-355
LTPCLLTNGVYDSWGHKMFSYCREWVLLTYLLRLFWYRIELCEIIITVAILTYERGDPHDYCGSRS

SEQ ID NO: 29357 - protein, 23 aa, Diabrotica virgifera
  misc_feature: Coding regions on vcDNA: vcDNA=SeqID_9054; Strand=-; Position=0-68
  misc_feature (8)..(22): Xaa can be any naturally occurring amino acid
SKKWIKNXXXXXXXXXXXXXXXP

SEQ ID NO: 29358 - protein, 266 aa, Diabrotica virgifera
  misc_feature: Coding regions on vcDNA: vcDNA=SeqID_9055; Strand=-; Position=1-798
  misc_feature (3)..(249): Xaa can be any naturally occurring amino acid
  misc_feature (252)..(266): Xaa can be any naturally occurring amino acid
KKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 29359 - protein, 173 aa, Diabrotica virgifera
  misc_feature: Coding regions on vcDNA: vcDNA=SeqID_9056; Strand=+; Position=187-708
  misc_feature: Homolog annotation: Hit_ID=CAA10770.1; Match level="QueryCoverage =97%, HitCoverage=51%, E-value=1e-24, Identity=32%"; Hit description =reverse transcriptase-like [Bos taurus]
MVIIKKTNIQTSIHLGNVPIERVDKYKYLGTWISEKNDQTTEIRTRIEIARNAFVKMKTVLCNKDLSLELRVRALRCYVFSILQYGLESWTLKQEHINKLQSFEMWCYRRMLRIAWTQRKTNTEVLREMGKECEIINTIKIRKLQYLGHVIRGPRYEMLRLIIQGKIRGGRSI

SEQ ID NO: 29360 - protein, 97 aa, Diabrotica virgifera
  misc_feature: Coding regions on vcDNA: vcDNA=SeqID_9057; Strand=+; Position=110-403
  misc_feature (4)..(15): Xaa can be any naturally occurring amino acid
  misc_feature (37)..(44): Xaa can be any naturally occurring amino acid
  misc_feature (59)..(65): Xaa can be any naturally occurring amino acid
  misc_feature (91)..(96): Xaa can be any naturally occurring amino acid
FIFXXXXXXXXXXXXYILCYFLTSTHLLNFSLDCYLXXXXXXXXTALSFSYISIYLANXXXXXXXQQHIYNYIYVHYHNHSYVPGFLIHTXXXXXXY

SEQ ID NO: 29361 - protein, 66 aa, Diabrotica virgifera
  misc_feature: Coding regions on vcDNA: vcDNA=SeqID_9058; Strand=+; Position=103-303
SPVMKRADLYFWPLEYYTINPGSVRDSMSFNSSLLRSQTLYTYMGRCGFSNLYSAIMADRRARYSV

SEQ ID NO: 29362 - protein, 26 aa, Diabrotica virgifera
  misc_feature: Coding regions on vcDNA: vcDNA=SeqID_9059; Strand=-; Position=2-79
  misc_feature (5)..(5): Xaa can be any naturally occurring amino acid
  misc_feature (17)..(17): Xaa can be any naturally occurring amino acid
  misc_feature (19)..(19): Xaa can be any naturally occurring amino acid
  misc_feature (24)..(25): Xaa can be any naturally occurring amino acid
KLYPXSRSHLYYRFDSXNXITLYXXR

SEQ ID NO: 29363 - protein, 321 aa, Diabrotica virgifera
  misc_feature: Coding regions on vcDNA: vcDNA=SeqID_9060; Strand=-; Position=1-963
  misc_feature (3)..(26): Xaa can be any naturally occurring amino acid
  misc_feature (28)..(41): Xaa can be any naturally occurring amino acid
  misc_feature (44)..(246): Xaa can be any naturally occurring amino acid
  misc_feature (249)..(287): Xaa can be any naturally occurring amino acid
  misc_feature (289)..(319): Xaa can be any naturally occurring amino acid
KNXXXXXXXXXXXXXXXXXXXXXXXXIXXXXXXXXXXXXXXNNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDFXXXXXXXXXXXXXXXXXXXXXXXXXXXXXXXXXXXXXXXGXXXXXXXXXXXXXXXXXXXXXXXXXXXXXXXEK

SEQ ID NO: 29364 - protein, 17 aa, Diabrotica virgifera
  misc_feature: Coding regions on vcDNA: vcDNA=SeqID_9061; Strand=-; Position=1-51
  misc_feature (2)..(17): Xaa can be any naturally occurring amino acid
RXXXXXXXXXXXXXXXX

SEQ ID NO: 29365 - protein, 125 aa, Diabrotica virgifera
  misc_feature: Coding regions on vcDNA: vcDNA=SeqID_9062; Strand=+; Position=3-380
  misc_feature (1)..(40): Xaa can be any naturally occurring amino acid
  misc_feature (45)..(96): Xaa can be any naturally occurring amino acid
XXXXXXXXXXXXXXXXXXXXXXXXXXXXXXXXXXXXXXXXKTRKXXXXXXXXXXXXXXXXXXXXXXXXXXXXXXXXXXXXXXXXXXXXXXXXXXXXNKITLRITGEFLLGRFKSIIKMWTPQGGI

SEQ ID NO: 29366 - protein, 52 aa, Diabrotica virgifera
  misc_feature: Coding regions on vcDNA: vcDNA=SeqID_9063; Strand=+; Position=101-259
MQVLKPYYIFNILLSLTYVTLKRTPGGCTDVYPTNVLRIWTERILNLEPCYT

SEQ ID NO: 29367 - protein, 261 aa, Diabrotica virgifera
  misc_feature: Coding regions on vcDNA: vcDNA=SeqID_9064; Strand=+; Position=78-863
  misc_feature: Homolog annotation: Hit_ID=EAA03861.2; Match level="QueryCoverage =98%, HitCoverage=98%, E-value=1e-122, Identity=82%"; Hit description= ENSANGP00000003103 [Anopheles gambiae str. PEST] ref|XP_560392.1| ENSANGP00000003103 [Anopheles gambiae s
  misc_feature: Gene Ontology Annotation: Molecular function=pre-mRNA splicing factor activity; Cellular component=small nuclear ribonucleoprotein complex; Biological process=mRNA splicing
  misc_feature: Pfam annotation: Pfam_ID=zf-U1; Match level="Score=3.3, E-value=0.05, Copies=1"; Pfam description=U1 zinc finger
MRIMDFQNRPGGKTGGGGVASWSETNRDRRERLRQLALETIDLQKDPYFMKNHLGSYECKLCLTLHNNEGSYLAHTQGKKHQANLARRAAKEAKDAPTLLQPEKPRVEPKKFVKIGRPGYRVTKQRDAESGQQSLLFQIDYPEISDMILPRHRFMSAYEQKIEPPDRKWQYLLFAAEPYETIAFKVPSREVEKTDSKFWTHWNKDTKQFFLQFAFKNDNKRTVNTVVQRHTIVGAAPPPPMLPVPPPPRPPMFNPIPPPPP

SEQ ID NO: 29368 - protein, 162 aa, Diabrotica virgifera
  misc_feature: Coding regions on vcDNA: vcDNA=SeqID_9065; Strand=+; Position=41-526
  misc_feature: Homolog annotation: Hit_ID=XP_319591.1; Match level="QueryCoverage =90%, HitCoverage=40%, E-value=5e-49, Identity=65%"; Hit description =ENSANGP00000016770 [Anopheles gambiae]
  misc_feature: Gene Ontology Annotation: Molecular function=electron transporter activity; Cellular component=cellular_component unknown; Biological process=brain development
  misc_feature: Pfam annotation: Pfam_ID=2-Hacid_dh_C; Match level="Score=70.0, E -value=6.3e-18, Copies=1"; Pfam description=D-isomer specific 2 -hydroxyacid dehyd
  misc_feature (70)..(77): Xaa can be any naturally occurring amino acid
  misc_feature (150)..(150): Xaa can be any naturally occurring amino acid
KRSGKTLGILGLGRIGKEVAIRMQAWGMTTIGYDPIVPASEAKKFNVEALELEQIWPRVDYITVHTPLIXXXXXXXXEAVLNKCKKGVKIVNVARGGIINESDLLKALKSGQCGGAALDVFEQEPPKDPVTLDLIQHEKVVATPHLGASXISYVWYVQHPLC

SEQ ID NO: 29369 - protein, 305 aa, Diabrotica virgifera
  misc_feature: Coding regions on vcDNA: vcDNA=SeqID_9066; Strand=+; Position=23-939
  misc_feature: Homolog annotation: Hit_ID=XP_310203.1; Match level="QueryCoverage =90%, HitCoverage=71%, E-value=9e-72, Identity=44%"; Hit description =ENSANGP00000011059 [Anopheles gambiae]
  misc_feature: Gene Ontology Annotation: Molecular function=acetylcholine receptor activity; Cellular component=nicotinic acetylcholine-gated receptor -channel complex; Biological process=synaptic transmission
  misc_feature: Pfam annotation: Pfam_ID=Neur_chan_LBD; Match level="Score=250.6, E -value=2.7e-72, Copies=1"; Pfam description=Neurotransmitter-gated ion-channel li
  misc_feature (275)..(275): Xaa can be any naturally occurring amino acid
  misc_feature (277)..(277): Xaa can be any naturally occurring amino acid
  misc_feature (279)..(279): Xaa can be any naturally occurring amino acid
MLIFIFLYSVVYFLGCVHSKFTTTKIGPQPIWNATFTDKLRQDLLLNYDKFSRPAQHYNVTTVKFGMGIRHLEFNELKSSLTVYAWLRMTWNDEKLKWDPEAYGNLSVLHLAEHELWQPDIYLYNSATSTAVNQFGNTHFLAYSDGKVLWVPPAQLVVLCGLNLKYWPFDTQECSLKFGSWTYSGDQIDLLHYNDNAEVGLEFIISNSEWELTNAVQTRHVKYYSCCAEAYPDITVNLTLNRISTSYKAIIVTPAFVVIMLNDVSFTLPPSAGEXIXIXACTAIVVSLFYVYFTQKLPIMGTEHP

SEQ ID NO: 29370 - protein, 246 aa, Diabrotica virgifera
  misc_feature: Coding regions on vcDNA: vcDNA=SeqID_9067; Strand=+; Position=94-834
  misc_feature (109)..(115): Xaa can be any naturally occurring amino acid
  misc_feature (157)..(169): Xaa can be any naturally occurring amino acid
  misc_feature (212)..(212): Xaa can be any naturally occurring amino acid
LSFYRSQYKYKNFVFRFTTDTKMRYCHLLLATLCVVVVTLTTATPTSFNTRGTIENAIPTDETCCSISHCKEVPLNTEGHSVFQCYKTKVCGEECLHKQNKNIPPLPTXXXXXXXVRKMCRGYDCYDYAYDCRKCPDPSKPSFSPYTIDADCINCYXXXXXXXXXXXXXLIFLDKFVSFFLSFFLSSLPFTLTGCRIWSSYFTCQLSIFLVXMPLVLLKTSFLLLLLVSSILFLYNIFYNIPTTDR

SEQ ID NO: 29371 - protein, 102 aa, Diabrotica virgifera
  misc_feature: Coding regions on vcDNA: vcDNA=SeqID_9068; Strand=-; Position=229-537
  misc_feature (9)..(25): Xaa can be any naturally occurring amino acid
DSINSDPTXXXXXXXXXXXXXXXXXLLIQSFHTSSCGRKRFFLRCPLYSAPLRRHTLPIFEEHLLSLFFLILLTRDAYRPRPLVVPLDLTSESRSPLLVGST

SEQ ID NO: 29372 - protein, 209 aa, Diabrotica virgifera
  misc_feature: Coding regions on vcDNA: vcDNA=SeqID_9069; Strand=+; Position=151-780
  misc_feature: Homolog annotation: Hit_ID=EAL33006.1; Match level="QueryCoverage =99%, HitCoverage=70%, E-value=2e-65, Identity=52%"; Hit description =GA17686-PA [Drosophila pseudoobscura]
  misc_feature: Gene Ontology Annotation: Biological process=positive regulation of growth rate
LDKGVAALLPEPYKNFYKEWRFAQPTAVHYVPESGNWKRNDVTGEVFPVQNIPIPVHFPKESSSHIWGGEGVVQGFEERNKFKRRVPHFWDPHLKRSVVYSEVLNKHISVIITDRAISLINAHYGFDHYLLKSPACDLQSLLSLSIKRKILQELENGCPTYANRPEKQKEILEQYEKYLSAYTSEEIEWYGYSLTEACKRLQRQMEAEE

SEQ ID NO: 29373 - protein, 171 aa, Diabrotica virgifera; identical to SEQ ID NO: 27583
  misc_feature: Coding regions on vcDNA: vcDNA=SeqID_9070; Strand=-; Position=3-518
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(166): Xaa can be any naturally occurring amino acid

SEQ ID NO: 29374 - protein, 156 aa, Diabrotica virgifera
  misc_feature: Coding regions on vcDNA: vcDNA=SeqID_9071; Strand=+; Position=248-719
  misc_feature: Homolog annotation: Hit_ID=XP_307419.1; Match level="QueryCoverage =99%, HitCoverage=20%, E-value=5e-48, Identity=57%"; Hit description =ENSANGP00000012923 [Anopheles gambiae]
  misc_feature: Gene Ontology Annotation: Molecular function=DNA binding; Cellular component=nucleus; Biological process=establishment and/or maintenance of chromatin architecture
  misc_feature (146)..(146): Xaa can be any naturally occurring amino acid
MAKAKVNVDWKRRVKQEYMRLRQIKRYKRADDVKLAWNQNRSKMSEILIEEQKRWTDGKAFWGNTPELPAHSTCMKKAEVIGNEGDIQVTTIKIMNAVTPIPTMYTWAPIQQNFMVEDETVLHNIPYMGDEILDEDGTFKEELIKXYDEEAHGERI

SEQ ID NO: 29375 - protein, 361 aa, Diabrotica virgifera
  misc_feature: Coding regions on vcDNA: vcDNA=SeqID_9072; Strand=+; Position=3-1088
  misc_feature (9)..(15): Xaa can be any naturally occurring amino acid
  misc_feature (19)..(66): Xaa can be any naturally occurring amino acid
  misc_feature (68)..(89): Xaa can be any naturally occurring amino acid
  misc_feature (96)..(279): Xaa can be any naturally occurring amino acid
  misc_feature (284)..(308): Xaa can be any naturally occurring amino acid
  misc_feature (310)..(337): Xaa can be any naturally occurring amino acid
  misc_feature (343)..(349): Xaa can be any naturally occurring amino acid
LPAPCIFFXXXXXXXVTLXXXXXXXXXXXXXXXXXXXXXXXXXXXXXXXXXXXXXXXXXXXXXXXXLXXXXXXXXXXXXXXXXXXXXXXFLDISNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRERXXXXXXXXXXXXXXXXXXXXXXXXXGXXXXXXXXXXXXXXXXXXXXXXXXXXXXTLRITXXXXXXXSMDNKIGTPGWD

SEQ ID NO: 29376 - protein, 74 aa, Diabrotica virgifera
  misc_feature: Coding regions on vcDNA: vcDNA=SeqID_9073; Strand=-; Position=338-562
RGGSPFPPHPPNFWEGERGGPLFPFPPPAKGGGGQGGQFWVIPRFSKWGIFKKGPKGVNFGLKGPPKKFNKNNM

SEQ ID NO: 29377 - protein, 24 aa, Diabrotica virgifera
  misc_feature: Coding regions on vcDNA: vcDNA=SeqID_9074; Strand=-; Position=0-71
  misc_feature (7)..(23): Xaa can be any naturally occurring amino acid
KKMDQKXXXXXXXXXXXXXXXXXR

SEQ ID NO: 29378 - protein, 241 aa, Diabrotica virgifera
  misc_feature: Coding regions on vcDNA: vcDNA=SeqID_9075; Strand=+; Position=1-723
  misc_feature (1)..(220): Xaa can be any naturally occurring amino acid
  misc_feature (226)..(235): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNSVILXXXXXXXXXXRPPCWI

SEQ ID NO: 29379 - protein, 188 aa, Diabrotica virgifera
  misc_feature: Coding regions on vcDNA: vcDNA=SeqID_9076; Strand=-; Position=0-563
  misc_feature (6)..(14): Xaa can be any naturally occurring amino acid
  misc_feature (26)..(33): Xaa can be any naturally occurring amino acid
  misc_feature (36)..(49): Xaa can be any naturally occurring amino acid
  misc_feature (55)..(68): Xaa can be any naturally occurring amino acid
  misc_feature (75)..(183): Xaa can be any naturally occurring amino acid
IFGPFXXXXXXXXXIETNLAHTGLNXXXXXXXXSNXXXXXXXXXXXXXXPTSRSXXXXXXXXXXXXXXVIPKVIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAGMKG

SEQ ID NO: 29380 - protein, 140 aa, Diabrotica virgifera
  misc_feature: Coding regions on vcDNA: vcDNA=SeqID_9077; Strand=-; Position=228-650
  misc_feature (87)..(93): Xaa can be any naturally occurring amino acid
  misc_feature (100)..(106): Xaa can be any naturally occurring amino acid
EKKKQFDWYTRYTTKIYLSSNNIITAISLKNKVLKKLLKTDNRFRRYKTSKMTHFLGCPFFVPVSVYTVPLFRFKLFLNFLVVVAMXXXXXXXSPLMQVXXXXXXXQKYLHLKFMLLCLKEVYLIPCKVQNKSQKERYWL

SEQ ID NO: 29381 - protein, 60 aa, Diabrotica virgifera
  misc_feature: Coding regions on vcDNA: vcDNA=SeqID_9078; Strand=-; Position=1-180
  misc_feature (1)..(17): Xaa can be any naturally occurring amino acid
  misc_feature (20)..(59): Xaa can be any naturally occurring amino acid
XXXXXXXXXXXXXXXXXSPXXXXXXXXXXXXXXXXXXXXXXXXXXXXXXXXXXXXXXXXL

SEQ ID NO: 29382 - protein, 77 aa, Diabrotica virgifera
  misc_feature: Coding regions on vcDNA: vcDNA=SeqID_9079; Strand=+; Position=3-236
  misc_feature (40)..(47): Xaa can be any naturally occurring amino acid
DARRHLRIIRYFSGIAPTTLISWFTQNCARISSLYIRTIXXXXXXXXALLVSNHIFILLECKRPKQSHLVLYSTYLR

SEQ ID NO: 29383 - protein, 38 aa, Diabrotica virgifera
  misc_feature: Coding regions on vcDNA: vcDNA=SeqID_9080; Strand=-; Position=177-293
  misc_feature (4)..(18): Xaa can be any naturally occurring amino acid
GVPXXXXXXXXXXXXXXXPPPLPPPPGLNSQIVEQDLK

SEQ ID NO: 29384 - protein, 285 aa, Diabrotica virgifera
  misc_feature: Coding regions on vcDNA: vcDNA=SeqID_9081; Strand=-; Position=1-855
  misc_feature (3)..(10): Xaa can be any naturally occurring amino acid
  misc_feature (28)..(28): Xaa can be any naturally occurring amino acid
  misc_feature (37)..(282): Xaa can be any naturally occurring amino acid
SNXXXXXXXXPIINLIQHRGRNLYYRLXLSNKITLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKKL

SEQ ID NO: 29385 - protein, 70 aa, Diabrotica virgifera
  misc_feature: Coding regions on vcDNA: vcDNA=SeqID_9082; Strand=+; Position=68-277
ILLQLYRMYQETTRRDFPDFFTEKGPLQLNVTPINFGNSTYWMSSLACKQNEGFAPAPLRPYERHDTGLL

SEQ ID NO: 29386 - protein, 52 aa, Diabrotica virgifera
  misc_feature: Coding regions on vcDNA: vcDNA=SeqID_9083; Strand=-; Position=0-155
  misc_feature (3)..(51): Xaa can be any naturally occurring amino acid
RYXXXXXXXXXXXXXXXXXXXXXXXXXXXXXXXXXXXXXXXXXXXXXXXXXV

SEQ ID NO: 29387 - protein, 59 aa, Diabrotica virgifera
  misc_feature: Coding regions on vcDNA: vcDNA=SeqID_9084; Strand=-; Position=58-237
  misc_feature (28)..(35): Xaa can be any naturally occurring amino acid
VSQVEQLQELQAPLEVLDQPLKKSIKLXXXXXXXXLTVVQYYLQTKLFKITFFTQFFNC

SEQ ID NO: 29388 - protein, 239 aa, Diabrotica virgifera
  misc_feature: Coding regions on vcDNA: vcDNA=SeqID_9085; Strand=+; Position=2-721
  misc_feature: Homolog annotation: Hit_ID=XP_397399.1; Match level="QueryCoverage =100%, HitCoverage=90%, E-value=1e-112, Identity=80%"; Hit description=similar to CG2925-PA [Apis mellifera]
  misc_feature: Gene Ontology Annotation: Molecular function=pre-mRNA splicing factor activity; Cellular component=spliceosome complex; Biological process =fertilization
RLKSALMALGLKCGGTLEERAQRLFSTKGKGSLDPSLMTKNNKGKANKEKELLRQRELATLEAQVYRLAEWVSPQRAATKENVQRKQARTDGERDDSENEESEDDSPDEGDDDVPYNPKNLPLGWDGKPIPYWLYKLHGLNISYNCEICGNYVYKGPKAFQRHFAEWRHAHGMRCLGIPNTAHFANVTQIEDALALWEKLKVQKQSERWQPETEEEYEDSQGNVVNRKTYEDLKRQGLL

SEQ ID NO: 29389 - protein, 268 aa, Diabrotica virgifera
  misc_feature: Coding regions on vcDNA: vcDNA=SeqID_9086; Strand=+; Position=3-809
  misc_feature: Homolog annotation: Hit_ID=XP_314167.1; Match level="QueryCoverage =89%, HitCoverage=52%, E-value=3e-28, Identity=33%"; Hit description =ENSANGP00000015749 [Anopheles gambiae]
  misc_feature: Gene Ontology Annotation: Molecular function=death receptor adaptor protein activity; Cellular component=cytoplasm; Biological process =transmembrane receptor protein serine/threonine kinase signaling pathway
  misc_feature: Pfam annotation: Pfam_ID=TIR; Match level="Score=-5.6, E-value =0.00025, Copies=1"; Pfam description=TIR domain
LPPQTYDAFVMFSDDDINFAIEIINKLEVQYKMKLCVTYRDVIGGENSHDAVIRLISTRCNRVVVVVSPSFLECPTHKYFYTLARMESIETRRRKIIPCIYKKCFDLPIEFRAYHLLDYTRMESTFGNFWDHLYKSLKVVIPPSTPSDVTSSTQRDVTSSTQRVPPIPQAAIAPRKSIESTKSTNHVKFEFLDQPTEVPKVENKTPPVEIPVETPAAPQPTPSTDELTHTFIRKFMKIVQKHDDKSVKEVPQINGVAPKKKRFWPVAN

SEQ ID NO: 29390 - protein, 169 aa, Diabrotica virgifera
  misc_feature: Coding regions on vcDNA: vcDNA=SeqID_9087; Strand=+; Position=194-701
  misc_feature: Homolog annotation: Hit_ID=XP_392857.1; Match level="QueryCoverage =89%, HitCoverage=45%, E-value=2e-50, Identity=59%"; Hit description =similar to aspartic protease [Apis mellifera]
  misc_feature: Gene Ontology Annotation: Molecular function=aspartic-type endopeptidase activity; Cellular component=lysosome; Biological process=induction of non-apoptotic programmed cell death
  misc_feature: Pfam annotation: Pfam_ID=Asp; Match level="Score=-27.3, E-value=2.6e -11, Copies=1"; Pfam description=Eukaryotic aspartyl protease
  misc_feature (47)..(52): Xaa can be any naturally occurring amino acid
  misc_feature (126)..(126): Xaa can be any naturally occurring amino acid
  misc_feature (148)..(148): Xaa can be any naturally occurring amino acid
SFPESVNSFPPKTKLISQDVVDFGGLQAKDQLFAEATQEPGLAFLVXXXXXXLGMGYPEISVNGITPVFNSLVEQGAVQEPVFSFYLNRDPDGEVGGELLLGGSDPNYYKGDFTYVDVSAKGYWQXYMDSLNVGSSLKLCSNGCHIVXDTGTSLIAGPIDEVEKLDKEK

SEQ ID NO: 29391 - protein, 56 aa, Diabrotica virgifera
  misc_feature: Coding regions on vcDNA: vcDNA=SeqID_9088; Strand=+; Position=1-168
  misc_feature (1)..(55): Xaa can be any naturally occurring amino acid
XXXXXXXXXXXXXXXXXXXXXXXXXXXXXXXXXXXXXXXXXXXXXXXXXXXXXXXV

SEQ ID NO: 29392 - protein, 256 aa, Diabrotica virgifera
  misc_feature: Coding regions on vcDNA: vcDNA=SeqID_9089; Strand=-; Position=3-770
  misc_feature (3)..(3): Xaa can be any naturally occurring amino acid
  misc_feature (6)..(14): Xaa can be any naturally occurring amino acid
  misc_feature (25)..(38): Xaa can be any naturally occurring amino acid
  misc_feature (40)..(256): Xaa can be any naturally occurring amino acid
NLXVEXXXXXXXXXNYKLNPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29393 - protein, 26 aa, Diabrotica virgifera
  misc_feature: Coding regions on vcDNA: vcDNA=SeqID_9090; Strand=+; Position=1-78
  misc_feature (1)..(1): Xaa can be any naturally occurring amino acid
  misc_feature (5)..(5): Xaa can be any naturally occurring amino acid
  misc_feature (9)..(9): Xaa can be any naturally occurring amino acid
  misc_feature (16)..(16): Xaa can be any naturally occurring amino acid
XHTNXGKQXIITHPNXQSLQKHNVFV

SEQ ID NO: 29394 - protein, 210 aa, Diabrotica virgifera
  misc_feature: Coding regions on vcDNA: vcDNA=SeqID_9091; Strand=-; Position=1-630
  misc_feature (8)..(209): Xaa can be any naturally occurring amino acid
LKKLFNNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXT

SEQ ID NO: 29395 - protein, 132 aa, Diabrotica virgifera
  misc_feature: Coding regions on vcDNA: vcDNA=SeqID_9092; Strand=+; Position=229-628
  misc_feature: Homolog annotation: Hit_ID=XP_310186.1; Match level="QueryCoverage =100%, HitCoverage=39%, E-value=5e-24, Identity=48%"; Hit description= ENSANGP00000011006 [Anopheles gambiae]
  misc_feature: Gene Ontology Annotation: Molecular function=malic enzyme activity; Cellular component=cytosol
  misc_feature (37)..(37): Xaa can be any naturally occurring amino acid
  misc_feature (53)..(53): Xaa can be any naturally occurring amino acid
  misc_feature (62)..(62): Xaa can be any naturally occurring amino acid
YSVLYVILTADVCGRNHTLTLRLLHLPPMTSPSQGVXMGLMDCGLPLPRQLTXPLSDAAAAXKDTGMATLEETLPHKERMKRQDLLGANDKIFKVRREDTYMLARKDDRRLYAGYPANTCALSCSNTSPSIP

SEQ ID NO: 29396 - protein, 170 aa, Diabrotica virgifera
  misc_feature: Coding regions on vcDNA: vcDNA=SeqID_9093; Strand=+; Position=230-741
  misc_feature: Homolog annotation: Hit_ID=NP_777225.1; Match level="QueryCoverage =77%, HitCoverage=21%, E-value=2e-18, Identity=38%"; Hit description =p97 protein [Bos taurus] dbj|BAA20065.1| bucentaur [Bos taurus]
  misc_feature (77)..(77): Xaa can be any naturally occurring amino acid
  misc_feature (88)..(94): Xaa can be any naturally occurring amino acid
LGDRNQRGDRLIQFCQDNNMIVTNTFFELPNRRLYTWNSPRDNEHKIMRNQIDHIMIKERYRNSITAVKIQPGADIXSNHNLLVVHMXXXXXXXEKTAKEERTDISAPRNPERINERLNTVQIEGECSEENINKNWEKIKADLIEPSKKVSTQTLDDRRNTKLNEQKKSI

SEQ ID NO: 29397 - protein, 263 aa, Diabrotica virgifera
  misc_feature: Coding regions on vcDNA: vcDNA=SeqID_9094; Strand=-; Position=4-795
  misc_feature (4)..(34): Xaa can be any naturally occurring amino acid
  misc_feature (37)..(173): Xaa can be any naturally occurring amino acid
  misc_feature (177)..(209): Xaa can be any naturally occurring amino acid
  misc_feature (241)..(246): Xaa can be any naturally occurring amino acid
  misc_feature (248)..(255): Xaa can be any naturally occurring amino acid
RFFXXXXXXXXXXXXXXXXXXXXXXXXXXXXXXXSGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFRXXXXXXXXXXXXXXXXXXXXXXXXXXXXXXXXXDPLIRGGTEKIRFFLFDERVKDDFASRDTELXXXXXXEXXXXXXXXTGEKMIFD

SEQ ID NO: 29398 - protein, 175 aa, Diabrotica virgifera
  misc_feature: Coding regions on vcDNA: vcDNA=SeqID_9095; Strand=-; Position=14-541
  misc_feature (154)..(160): Xaa can be any naturally occurring amino acid
ISYNSFVLESRSPFNVGMLSMTLIELALNSSFLAINGRDPRVCLFIKCEDMLLVNEYDLEAEVVIKCGSLHISLRRCSFFSLTLVSFFLYHWSMSSRKLLIRLYLVNPNSHRFQYITSRQKHKMIPPHVLVVRMSLVSSILSFILFLDVDLELXXXXXXXQYLLVLNSKKDRRFH

SEQ ID NO: 29399 - protein, 90 aa, Diabrotica virgifera
  misc_feature: Coding regions on vcDNA: vcDNA=SeqID_9096; Strand=-; Position=3-272
  misc_feature (27)..(37): Xaa can be any naturally occurring amino acid
  misc_feature (47)..(55): Xaa can be any naturally occurring amino acid
  misc_feature (57)..(70): Xaa can be any naturally occurring amino acid
  misc_feature (77)..(89): Xaa can be any naturally occurring amino acid
IPVGFCHLTVRNIYLNMRIILYIGSFXXXXXXXXXXXNHPGSHRFKXXXXXXXXXEXXXXXXXXXXXXXXSNIEVAXXXXXXXXXXXXXC

SEQ ID NO: 29400 - protein, 224 aa, Diabrotica virgifera
  misc_feature: Coding regions on vcDNA: vcDNA=SeqID_9097; Strand=+; Position=2-673
  misc_feature (2)..(7): Xaa can be any naturally occurring amino acid
  misc_feature (9)..(19): Xaa can be any naturally occurring amino acid
  misc_feature (28)..(185): Xaa can be any naturally occurring amino acid
  misc_feature (188)..(202): Xaa can be any naturally occurring amino acid
  misc_feature (205)..(219): Xaa can be any naturally occurring amino acid
RXXXXXXHXXXXXXXXXXXKVIRFKLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWNXXXXXXXXXXXXXXXRIXXXXXXXXXXXXXXXYRVYK

SEQ ID NO: 29401 - protein, 285 aa, Diabrotica virgifera
  misc_feature: Coding regions on vcDNA: vcDNA=SeqID_9098; Strand=+; Position=1-858
  misc_feature (47)..(53): Xaa can be any naturally occurring amino acid
  misc_feature (56)..(79): Xaa can be any naturally occurring amino acid
  misc_feature (83)..(285): Xaa can be any naturally occurring amino acid
SFYVNGKEKIFLFNDKLNSVFGRDESLSPFSKVKILSFSYLRVSGIXXXXXXXYSXXXXXXXXXXXXXXXXXXXXXXXXNETXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29402 - protein, 83 aa, Diabrotica virgifera
  misc_feature: Coding regions on vcDNA: vcDNA=SeqID_9099; Strand=-; Position=335-586
  misc_feature (31)..(38): Xaa can be any naturally occurring amino acid
  misc_feature (50)..(72): Xaa can be any naturally occurring amino acid
LRAPINERELVYICDLKLELTLTLQITVFTXXXXXXXXTNNLFFLFSLPXXXXXXXXXXXXXXXXXXXXXXXKSFFWSVPHCI

SEQ ID NO: 29403 - protein, 278 aa, Diabrotica virgifera
  misc_feature: Coding regions on vcDNA: vcDNA=SeqID_9100; Strand=+; Position=60-894
  misc_feature: Homolog annotation: Hit_ID=EAL40176.1; Match level="QueryCoverage =99%, HitCoverage=82%, E-value=9e-39, Identity=34%"; Hit description =ENSANGP00000026885 [Anopheles gambiae str. PEST] ref|XP_557494.1| ENSANGP00000026885 [Anopheles gambiae st
  misc_feature: Pfam annotation: Pfam_ID=Transposase_11; Match level="Score=1.9, E -value=0.0065, Copies=1"; Pfam description=Transposase DDE domain
  misc_feature (238)..(238): Xaa can be any naturally occurring amino acid
DTVPSYSDQEFFEHFRLSRNVVNDISDRFERSTYYHNNTGPFGKIPGLHQVLIFLWYAGHQTSSFRDVGDRFDVTVSSVNRILYRLTMFLSNLSPEIIKWPTAAEKHVSQQHFANKGFPNVIGAIDGCHIKIDRPDNDPDSYINRKGFYSVQMQAVCDHKKKIIDLFLGYPGSVHDSRVFRNSPLNANLERKCQQYFLLGDSGYPLRNNLLTPYKNRGNLTRQQQNYNVKLSKNRYVXNTRFGIVKQKFRQLYHVKLRNIRFIVHFIRAACVLHNIAL

SEQ ID NO: 29404 - protein, 153 aa, Diabrotica virgifera
  misc_feature: Coding regions on vcDNA: vcDNA=SeqID_9101; Strand=-; Position=186-647
  misc_feature: Homolog annotation: Hit_ID=AAU82580.1; Match level="QueryCoverage =94%, HitCoverage=33%, E-value=4e-25, Identity=36%"; Hit description =hypothetical protein GZ18F2_10 [uncultured archaeon GZfos18F2]
WRRKATYNLHAGGKTGFIEGADLIFSSTSKNSDYRDNMNTEMFVKWLREKLLPGLSEPSVIILDNAPYHSEILNKSPTNSWNVDKIKEWLTNERISIPQHILKSELLRLAKEHAKPKIFVVDQVTESYGHQVLRLPPYHCQFNPIEYIWGIAK

SEQ ID NO: 29405 - protein, 82 aa, Diabrotica virgifera
  misc_feature: Coding regions on vcDNA: vcDNA=SeqID_9102; Strand=-; Position=304-552
NNIAQFHPPPVNSLIRTDLNNRSTYEPSQLKINRSSRGNEAEKMAKPRNFFVQHRFVQKFGIRLITPPSSFSILSRCTLLVL

SEQ ID NO: 29406 - protein, 88 aa, Diabrotica virgifera
  misc_feature: Coding regions on vcDNA: vcDNA=SeqID_9103; Strand=+; Position=111-377
  misc_feature: Homolog annotation: Hit_ID=XP_394699.1; Match level="QueryCoverage =81%, HitCoverage=26%, E-value=4e-16, Identity=54%"; Hit description =similar to CG9723-PA [Apis mellifera]
SSSSSSVILLIGYHLPQKWKTAPRTYWKRKFPPKKKLLTNDEYYHQGVEETEKALKSLRDYCSSPDCNQWKTVLKLKDVKRVASFVEV

SEQ ID NO: 29407 - protein, 83 aa, Diabrotica virgifera
  misc_feature: Coding regions on vcDNA: vcDNA=SeqID_9104; Strand=+; Position=401-649
  misc_feature (77)..(82): Xaa can be any naturally occurring amino acid
YTRLSGQIDVKISVIHFFTFKQKIVNLYKIYFIQKRYVYTLLRNFCEFILTWIQSEHHVPEFGSEKCQFCMCIVYYXXXXXXL

SEQ ID NO: 29408 - protein, 78 aa, Diabrotica virgifera
  misc_feature: Coding regions on vcDNA: vcDNA=SeqID_9105; Strand=+; Position=428-664
  misc_feature (60)..(67): Xaa can be any naturally occurring amino acid
VCICSFPQFSLYSFTQPFSPVLSVCEPLSYRFLLSIASSTSSLKDLRGLPLSFLPIIKFXXXXXXXXVTLAVPFYLIL

SEQ ID NO: 29409 - protein, 31 aa, Diabrotica virgifera
  misc_feature: Coding regions on vcDNA: vcDNA=SeqID_9106; Strand=-; Position=2-94
  misc_feature (10)..(10): Xaa can be any naturally occurring amino acid
  misc_feature (26)..(26): Xaa can be any naturally occurring amino acid
VLDEHCVKTXYLSFGVEIMLQCYPLXKLIKT

SEQ ID NO: 29410 - protein, 65 aa, Diabrotica virgifera
  misc_feature: Coding regions on vcDNA: vcDNA=SeqID_9107; Strand=-; Position=2-196
  misc_feature (2)..(12): Xaa can be any naturally occurring amino acid
  misc_feature (22)..(29): Xaa can be any naturally occurring amino acid
  misc_feature (32)..(45): Xaa can be any naturally occurring amino acid
  misc_feature (51)..(64): Xaa can be any naturally occurring amino acid
FXXXXXXXXXXXTNLAHTGLNXXXXXXXXSNXXXXXXXXXXXXXXPTSRSXXXXXXXXXXXXXXV

SEQ ID NO: 29411 - protein, 48 aa, Diabrotica virgifera
  misc_feature: Coding regions on vcDNA: vcDNA=SeqID_9108; Strand=-; Position=2-145
LLKKMYNIILYFTLRTERLAYTDQCCQNYQARVGTRLSINYSFSRRGG

SEQ ID NO: 29412 - protein, 49 aa, Diabrotica virgifera
  misc_feature: Coding regions on vcDNA: vcDNA=SeqID_9109; Strand=-; Position=37-186
VHFVARHIWKMRLSHNPRFCSALHIIVYVINICRDRPKLQFRLQCRLQM

SEQ ID NO: 29413 - protein, 172 aa, Diabrotica virgifera
  misc_feature: Coding regions on vcDNA: vcDNA=SeqID_9110; Strand=-; Position=4-522
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(167): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRAKVA

SEQ ID NO: 29414 - protein, 66 aa, Diabrotica virgifera; identical to SEQ ID NO: 26808
  misc_feature: Coding regions on vcDNA: vcDNA=SeqID_9111; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 29415 - protein, 258 aa, Diabrotica virgifera
  misc_feature: Coding regions on vcDNA: vcDNA=SeqID_9112; Strand=-; Position=1-774
  misc_feature (1)..(241): Xaa can be any naturally occurring amino acid
  misc_feature (244)..(258): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 29416 - protein, 387 aa, Diabrotica virgifera
  misc_feature: Coding regions on vcDNA: vcDNA=SeqID_9113; Strand=-; Position=1-1161
  misc_feature (3)..(25): Xaa can be any naturally occurring amino acid
  misc_feature (38)..(44): Xaa can be any naturally occurring amino acid
  misc_feature (71)..(71): Xaa can be any naturally occurring amino acid
  misc_feature (78)..(86): Xaa can be any naturally occurring amino acid
  misc_feature (91)..(190): Xaa can be any naturally occurring amino acid
  misc_feature (193)..(370): Xaa can be any naturally occurring amino acid
  misc_feature (373)..(387): Xaa can be any naturally occurring amino acid
GAXXXXXXXXXXXXXXXXXXXXXXXFKPQNQKKFKKWXXXXXXXRHTHLKTFTHTWEVPNLYYRLNLPQIXYGVTPKXXXXXXXXXWNQKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRYXXXXXXXXXXXXXXX

SEQ ID NO: 29417 - protein, 109 aa, Diabrotica virgifera
  misc_feature: Coding regions on vcDNA: vcDNA=SeqID_9114; Strand=-; Position=1-327
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(109): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXX

SEQ ID NO: 29418 - protein, 86 aa, Diabrotica virgifera
  misc_feature: Coding regions on vcDNA: vcDNA=SeqID_9115; Strand=+; Position=652-909
IFIYFSFSFWHCYFFISYNTFQLFRVFLSKSFEPRPILSHMYLRVFRQGALVFILVHLRVASRSHQHSVLPSIKSCRKSYLSFLST

SEQ ID NO: 29419 - protein, 64 aa, Diabrotica virgifera
  misc_feature: Coding regions on vcDNA: vcDNA=SeqID_9116; Strand=+; Position=3-194
  misc_feature (1)..(13): Xaa can be any naturally occurring amino acid
  misc_feature (15)..(29): Xaa can be any naturally occurring amino acid
  misc_feature (35)..(47): Xaa can be any naturally occurring amino acid
  misc_feature (55)..(61): Xaa can be any naturally occurring amino acid
XXXXXXXXXXXXXSXXXXXXXXXXXXXXXLIHKGXXXXXXXXXXXXXLTILINYXXXXXXXTFT

SEQ ID NO: 29420 - protein, 92 aa, Diabrotica virgifera
  misc_feature: Coding regions on vcDNA: vcDNA=SeqID_9117; Strand=+; Position=3-278
  misc_feature (1)..(10): Xaa can be any naturally occurring amino acid
  misc_feature (51)..(58): Xaa can be any naturally occurring amino acid
  misc_feature (74)..(87): Xaa can be any naturally occurring amino acid
XXXXXXXXXXLRNTANFFWRIQINNKDCRPRWWNKSFLFGGKAKFIKVWFXXXXXXXXNLRFKTRGGAPGVGFXXXXXXXXXXXXXXAKGTP

SEQ ID NO: 29421 - protein, 309 aa, Diabrotica virgifera
  misc_feature: Coding regions on vcDNA: vcDNA=SeqID_9118; Strand=+; Position=21-950
  misc_feature (21)..(28): Xaa can be any naturally occurring amino acid
  misc_feature (34)..(306): Xaa can be any naturally occurring amino acid
FQINHKLIFFLNLEPQGILNXXXXXXXXIFKTSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKG

SEQ ID NO: 29422 - protein, 248 aa, Diabrotica virgifera
  misc_feature: Coding regions on vcDNA: vcDNA=SeqID_9119; Strand=+; Position=1-744
  misc_feature: Homolog annotation: Hit_ID=XP_395948.1; Match level="QueryCoverage =79%, HitCoverage=61%, E-value=6e-17, Identity=29%"; Hit description =similar to RAB, member of RAS oncogene family-like 5 [Apis mellifera]
  misc_feature: Pfam annotation: Pfam_ID=dsrm; Match level="Score=27.5, E-value=3.9e -05, Copies=1"; Pfam description=Double-stranded RNA binding motif
  misc_feature (129)..(138): Xaa can be any naturally occurring amino acid
GIEHVGYGRSKINAKNTAAEAALKHYVKTNKLTEVKVTKRERVRRRNVRLSKILQPKNAVMILNELVRNTSYTVDELSQKYDGNQFKATVLYEGIEHVGYGRSKINAKNTAAEAALKHYVKTNKLTEVXXXXXXXXXXDVSEDDATQAPLPWQHVASFALYKLFSSWGEDLNVNQNQSIPRGEKLHENKPAKKMPENPDTINPLMLANQMLPQAQFEEIGKTGNPPNVLFSSKCIVDGESCIGTGSTE

SEQ ID NO: 29423 - protein, 57 aa, Diabrotica virgifera
  misc_feature: Coding regions on vcDNA: vcDNA=SeqID_9120; Strand=-; Position=0-170
  misc_feature (1)..(40): Xaa can be any naturally occurring amino acid
  misc_feature (43)..(56): Xaa can be any naturally occurring amino acid
XXXXXXXXXXXXXXXXXXXXXXXXXXXXXXXXXXXXXXXXRYXXXXXXXXXXXXXXG

SEQ ID NO: 29424 - protein, 272 aa, Diabrotica virgifera
  misc_feature: Coding regions on vcDNA: vcDNA=SeqID_9121; Strand=+; Position=26-839
  misc_feature: Homolog annotation: Hit_ID=NP_149017.2; Match level="QueryCoverage =90%, HitCoverage=46%, E-value=1e-42, Identity=38%"; Hit description =Bardet-Biedl syndrome 4 [Homo sapiens]
  misc_feature: Pfam annotation: Pfam_ID=TPR_2; Match level="Score=79.7, E-value=7.9e- 21, Copies=3"; Pfam description=Tetratricopeptide repeat
  misc_feature (180)..(186): Xaa can be any naturally occurring amino acid
  misc_feature (208)..(208): Xaa can be any naturally occurring amino acid
  misc_feature (243)..(243): Xaa can be any naturally occurring amino acid
AFSLKLNFKFNHCLVLGLFSKYAHTSERKCPDEEFYSLDKFNWLIHLQHVTGGIQACKSLIIKEIERSKGKNEFALYKQGEIYREEEKFQEALESFQTCLRLNPENPEYLKEVAKCLFEMKRYKLAMEAYLEAERLSTNADCQIYYYLGQCLLKLGDINKAQEYAQKAVEAGSHEFCFEXXXXXXXLQKEVKAAVAVSNAAVEFSDLXPDSVNMLTESGLLFLKIGQSEYAFERLSSALALEXAHTKALLAIGCIIQKHEDYDVALSKYKMA

SEQ ID NO: 29425 - protein, 286 aa, Diabrotica virgifera
  misc_feature: Coding regions on vcDNA: vcDNA=SeqID_9122; Strand=-; Position=0-857
  misc_feature (1)..(242): Xaa can be any naturally occurring amino acid
  misc_feature (245)..(256): Xaa can be any naturally occurring amino acid
  misc_feature (261)..(274): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXDSLHXXXXXXXXXXXXXXIYEKDILLFYRT

SEQ ID NO: 29426 - protein, 17 aa, Diabrotica virgifera
  misc_feature: Coding regions on vcDNA: vcDNA=SeqID_9123; Strand=-; Position=1-51
  misc_feature (3)..(17): Xaa can be any naturally occurring amino acid
EVXXXXXXXXXXXXXXX

SEQ ID NO: 29427 - protein, 27 aa, Diabrotica virgifera
  misc_feature: Coding regions on vcDNA: vcDNA=SeqID_9124; Strand=+; Position=1-81
IRSYTRLYFRKTQYIYRKQAVYSPPFR

SEQ ID NO: 29428 - protein, 274 aa, Diabrotica virgifera
  misc_feature: Coding regions on vcDNA: vcDNA=SeqID_9125; Strand=+; Position=1-822
  misc_feature (3)..(9): Xaa can be any naturally occurring amino acid
  misc_feature (12)..(32): Xaa can be any naturally occurring amino acid
  misc_feature (35)..(266): Xaa can be any naturally occurring amino acid
LFXXXXXXXHLXXXXXXXXXXXXXXXXXXXXXYLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDERPYRVY

SEQ ID NO: 29429 - protein, 65 aa, Diabrotica virgifera
  misc_feature: Coding regions on vcDNA: vcDNA=SeqID_9126; Strand=+; Position=1-195
AVRRERRRVSLHSQNQSIITLPRYNGQKTKNPYTSIDQLNLSNSERNIFHLFIKEKFNLFVPRVS

SEQ ID NO: 29430 - protein, 66 aa, Diabrotica virgifera
  misc_feature: Coding regions on vcDNA: vcDNA=SeqID_9127; Strand=+; Position=63-263
  misc_feature (3)..(17): Xaa can be any naturally occurring amino acid
  misc_feature (38)..(46): Xaa can be any naturally occurring amino acid
DWXXXXXXXXXXXXXXXPGYLVVLVNNYIVIRFRIRKXXXXXXXXXLIYMLDNFFRIDTLFVVAHI

SEQ ID NO: 29431 - protein, 28 aa, Diabrotica virgifera
  misc_feature: Coding regions on vcDNA: vcDNA=SeqID_9128; Strand=+; Position=55-141
IHNTCYLVYMFTNIFEMNYVSIRYVSFC

SEQ ID NO: 29432 - protein, 65 aa, Diabrotica virgifera
  misc_feature: Coding regions on vcDNA: vcDNA=SeqID_9129; Strand=-; Position=115-312
SCKMFDQFNGRIKVILTVNVVGKVPRGIISRLGSVAKFTLGYLRVSFNISLIYFTGYILHIDRVG

SEQ ID NO: 29433 - protein, 268 aa, Diabrotica virgifera
  misc_feature: Coding regions on vcDNA: vcDNA=SeqID_9130; Strand=+; Position=12-815
  misc_feature (11)..(18): Xaa can be any naturally occurring amino acid
  misc_feature (23)..(59): Xaa can be any naturally occurring amino acid
  misc_feature (63)..(268): Xaa can be any naturally occurring amino acid
LISTVRESLYXXXXXXXXFPTSXXXXXXXXXXXXXXXXXXXXXXXXXXXXXXXXXXXXXNETXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29434 - protein, 66 aa, Diabrotica virgifera
  misc_feature: Coding regions on vcDNA: vcDNA=SeqID_9131; Strand=-; Position=2-199
  misc_feature (3)..(10): Xaa can be any naturally occurring amino acid
  misc_feature (22)..(30): Xaa can be any naturally occurring amino acid
  misc_feature (33)..(46): Xaa can be any naturally occurring amino acid
  misc_feature (52)..(65): Xaa can be any naturally occurring amino acid
PFXXXXXXXXKIETNLAHTGLXXXXXXXXXSNXXXXXXXXXXXXXXPTSRSXXXXXXXXXXXXXXV

SEQ ID NO: 29435 - protein, 49 aa, Diabrotica virgifera
  misc_feature: Coding regions on vcDNA: vcDNA=SeqID_9132; Strand=-; Position=233-382
  misc_feature (6)..(12): Xaa can be any naturally occurring amino acid
  misc_feature (14)..(20): Xaa can be any naturally occurring amino acid
SDVVNXXXXXXXVXXXXXXXGFLLHYINIFTFGVKACSYKEEIYYLFFT

SEQ ID NO: 29436 - protein, 82 aa, Diabrotica virgifera
  misc_feature: Coding regions on vcDNA: vcDNA=SeqID_9133; Strand=-; Position=430-678
PPPPPPLKARYRGGPHSPSRGPSLVEGGGGGPLFLFPPREKGGSSQRDKMGVTPGFSPPPVLKKPPRKKILGYKLPTWLTPV

SEQ ID NO: 29437 - protein, 67 aa, Diabrotica virgifera
  misc_feature: Coding regions on vcDNA: vcDNA=SeqID_9134; Strand=+; Position=148-351
  misc_feature (12)..(20): Xaa can be any naturally occurring amino acid
GSNIVILKKYAXXXXXXXXXHLYCKNDKFKFAHNIVHLFLFPFIYSKYFMTESVKYTFSPSCPLAKG

SEQ ID NO: 29438 - protein, 66 aa, Diabrotica virgifera
  misc_feature: Coding regions on vcDNA: vcDNA=SeqID_9135; Strand=+; Position=3-200
  misc_feature (2)..(14): Xaa can be any naturally occurring amino acid
  misc_feature (21)..(34): Xaa can be any naturally occurring amino acid
  misc_feature (38)..(38): Xaa can be any naturally occurring amino acid
  misc_feature (44)..(45): Xaa can be any naturally occurring amino acid
  misc_feature (52)..(52): Xaa can be any naturally occurring amino acid
  misc_feature (60)..(60): Xaa can be any naturally occurring amino acid
TXXXXXXXXXXXXXCDLDVGXXXXXXXXXXXXXXFDFXILHDLXXNRCEPRXVSIFKLLXYFSTKG

SEQ ID NO: 29439 - protein, 23 aa, Diabrotica virgifera
  misc_feature: Coding regions on vcDNA: vcDNA=SeqID_9136; Strand=-; Position=1-69
  misc_feature (3)..(23): Xaa can be any naturally occurring amino acid
EVXXXXXXXXXXXXXXXXXXXXX

SEQ ID NO: 29440 - protein, 77 aa, Diabrotica virgifera
  misc_feature: Coding regions on vcDNA: vcDNA=SeqID_9137; Strand=+; Position=3-233
  misc_feature (2)..(14): Xaa can be any naturally occurring amino acid
  misc_feature (22)..(22): Xaa can be any naturally occurring amino acid
  misc_feature (26)..(34): Xaa can be any naturally occurring amino acid
  misc_feature (38)..(38): Xaa can be any naturally occurring amino acid
  misc_feature (44)..(44): Xaa can be any naturally occurring amino acid
  misc_feature (53)..(63): Xaa can be any naturally occurring amino acid
  misc_feature (66)..(76): Xaa can be any naturally occurring amino acid
TXXXXXXXXXXXXXCDLDVGLXFIIXXXXXXXXXFDFXILHDLXLTGVSPGGXXXXXXXXXXXERXXXXXXXXXXXY

SEQ ID NO: 29441 - protein, 99 aa, Diabrotica virgifera
  misc_feature: Coding regions on vcDNA: vcDNA=SeqID_9138; Strand=-; Position=34-333
  misc_feature (1)..(41): Xaa can be any naturally occurring amino acid
  misc_feature (45)..(54): Xaa can be any naturally occurring amino acid
  misc_feature (65)..(72): Xaa can be any naturally occurring amino acid
XXXXXXXXXXXXXXXXXXXXXXXXXXXXXXXXXXXXXXXXXVLWXXXXXXXXXXNQPWFPPGLNXXXXXXXXWTRFNNIAVTPIYNFYSNMEVASLLLI

SEQ ID NO: 29442 - protein, 67 aa, Diabrotica virgifera
  misc_feature: Coding regions on vcDNA: vcDNA=SeqID_9139; Strand=-; Position=143-346
  misc_feature (1)..(5): Xaa can be any naturally occurring amino acid
  misc_feature (10)..(17): Xaa can be any naturally occurring amino acid
  misc_feature (20)..(26): Xaa can be any naturally occurring amino acid
  misc_feature (60)..(60): Xaa can be any naturally occurring amino acid
XXXXXLNPPXXXXXXXXGEXXXXXXXRATPILKTLIPNPWGSPHLIIGLDLFTIKNTLLXPEGIYFL

SEQ ID NO: 29443 - protein, 72 aa, Diabrotica virgifera
  misc_feature: Coding regions on vcDNA: vcDNA=SeqID_9140; Strand=-; Position=2-217
  misc_feature (52)..(62): Xaa can be any naturally occurring amino acid
SSFSVSIMFCPRGDILHAGLLALESKFRTMNFSSSVQCISGLHHIKIIQGYXXXXXXXXXXXIHPRPPAGGG

SEQ ID NO: 29444 - protein, 16 aa, Diabrotica virgifera
  misc_feature: Coding regions on vcDNA: vcDNA=SeqID_9141; Strand=-; Position=1-48
  misc_feature (1)..(1): Xaa can be any naturally occurring amino acid
  misc_feature (3)..(4): Xaa can be any naturally occurring amino acid
  misc_feature (7)..(16): Xaa can be any naturally occurring amino acid
XQXXKLXXXXXXXXXX

SEQ ID NO: 29445 - protein, 352 aa, Diabrotica virgifera
  misc_feature: Coding regions on vcDNA: vcDNA=SeqID_9142; Strand=+; Position=2-1057
  misc_feature (3)..(289): Xaa can be any naturally occurring amino acid
  misc_feature (296)..(302): Xaa can be any naturally occurring amino acid
  misc_feature (308)..(345): Xaa can be any naturally occurring amino acid
MNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTNTPHKXXXXXXXVSFFSXXXXXXXXXXXXXXXXXXXXXXXXXXXXXXXXXXXXXXNPVFFGI

SEQ ID NO: 29446 - protein, 78 aa, Diabrotica virgifera
  misc_feature: Coding regions on vcDNA: vcDNA=SeqID_9143; Strand=+; Position=111-344
PMSRQPVHLKLAHLLVLTGRFAHRDIAIAPNPLVSSGNSGLPPASGPNSPRVLAPELLPYIYTLIIGYYPNARDLPYT

SEQ ID NO: 29447 - protein, 76 aa, Diabrotica virgifera
  misc_feature: Coding regions on vcDNA: vcDNA=SeqID_9144; Strand=-; Position=47-277
PEALARAAHRLAATSLGERKIDSICFGRPFEHFCPWKMYLPQPISAGSQNYNISFPHLLNKLSHYKLTISCFNFVG

SEQ ID NO: 29448 - protein, 63 aa, Diabrotica virgifera
  misc_feature: Coding regions on vcDNA: vcDNA=SeqID_9145; Strand=+; Position=85-273
  misc_feature (41)..(48): Xaa can be any naturally occurring amino acid
NSKQEWDRPILIKYSTSYITESLDANWLTTTYFLFWNKHEXXXXXXXXAIRLKKTGFVIETFC

SEQ ID NO: 29449 - protein, 72 aa, Diabrotica virgifera
  misc_feature: Coding regions on vcDNA: vcDNA=SeqID_9146; Strand=-; Position=2-217
  misc_feature (2)..(2): Xaa can be any naturally occurring amino acid
  misc_feature (5)..(55): Xaa can be any naturally occurring amino acid
  misc_feature (57)..(72): Xaa can be any naturally occurring amino acid
QXNNXXXXXXXXXXXXXXXXXXXXXXXXXXXXXXXXXXXXXXXXXXXXXXXXXXXSXXXXXXXXXXXXXXXX

SEQ ID NO: 29450 - protein, 74 aa, Diabrotica virgifera
  misc_feature: Coding regions on vcDNA: vcDNA=SeqID_9147; Strand=-; Position=60-284
CIEHYCKSQNINSFGKQKQYFLLNCGNLRLCYKRFNFISRSQIVASILVTTRVSIYEVYEDDSNVSASLSSVLL

SEQ ID NO: 29451 - protein, 87 aa, Diabrotica virgifera
  misc_feature: Coding regions on vcDNA: vcDNA=SeqID_9148; Strand=+; Position=576-839
  misc_feature (10)..(19): Xaa can be any naturally occurring amino acid
  misc_feature (24)..(30): Xaa can be any naturally occurring amino acid
  misc_feature (44)..(53): Xaa can be any naturally occurring amino acid
RCDAYLTFCXXXXXXXXXXIISKXXXXXXXNKLTLIIYMGNKPXXXXXXXXXXRFDAQIGCRCQNTKCHKEIASEQINISQKLFIIF

SEQ ID NO: 29452 - protein, 116 aa, Diabrotica virgifera
  misc_feature: Coding regions on vcDNA: vcDNA=SeqID_9149; Strand=-; Position=0-347
  misc_feature (7)..(15): Xaa can be any naturally occurring amino acid
  misc_feature (27)..(62): Xaa can be any naturally occurring amino acid
  misc_feature (69)..(81): Xaa can be any naturally occurring amino acid
  misc_feature (86)..(86): Xaa can be any naturally occurring amino acid
  misc_feature (91)..(98): Xaa can be any naturally occurring amino acid
INYHISXXXXXXXXXKNLDIYIKEKQXXXXXXXXXXXXXXXXXXXXXXXXXXXXXXXXXXXXLIRKVQXXXXXXXXXXXXXPILLXSLSIXXXXXXXXLKVLFFKFLPRVRGREGA

SEQ ID NO: 29453 - protein, 262 aa, Diabrotica virgifera
  misc_feature: Coding regions on vcDNA: vcDNA=SeqID_9150; Strand=+; Position=1-786
  misc_feature (1)..(16): Xaa can be any naturally occurring amino acid
  misc_feature (18)..(55): Xaa can be any naturally occurring amino acid
  misc_feature (59)..(261): Xaa can be any naturally occurring amino acid
XXXXXXXXXXXXXXXXPXXXXXXXXXXXXXXXXXXXXXXXXXXXXXXXXXXXXXXSKSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXL

SEQ ID NO: 29454 - protein, 34 aa, Diabrotica virgifera
  misc_feature: Coding regions on vcDNA: vcDNA=SeqID_9151; Strand=-; Position=3-104
  misc_feature (20)..(20): Xaa can be any naturally occurring amino acid
VFGYSYLVISYLSKRLLLMXLFLIKFDCIFRFSL

SEQ ID NO: 29455 - protein, 277 aa, Diabrotica virgifera
  misc_feature: Coding regions on vcDNA: vcDNA=SeqID_9152; Strand=+; Position=3-836
  misc_feature: Homolog annotation: Hit_ID=AAC48665.1; Match level="QueryCoverage =86%, HitCoverage=26%, E-value=1e-39, Identity=38%"; Hit description =beta-mannosidase sp|Q95327|MANB_CAPHI Beta-mannosidase precursor (Mannanase) (Mannase)
  misc_feature: Gene Ontology Annotation: Molecular function=beta-mannosidase activity; Biological process=protein modification
  misc_feature (30)..(35): Xaa can be any naturally occurring amino acid
RRNWTYYRNFDVTEDILNNDNVNLVFEGLXXXXXXVVNDVIVGSSRNMFVRYIFDVKKALKVGQNKIEVSFLSPIEVAANLAAEQAKAYVVPPTCPPNEYRGECNVNMIRKMQASYSWDWGPAFASVGIWKDAYIESYAESVIRYVAVDIEDDDQNWILKVDTYLGDNAKHHVQGKLTLQQKTEDQTLEQSVDIDIVPNDHSELLHSRVISVSKNAVTPWWPNGYGGQQLYDLTVTFDSKSGDESNSKVTRIASKFGFFYLPSTSKFILCRWLLLLG

SEQ ID NO: 29456 - protein, 213 aa, Diabrotica virgifera
  misc_feature: Coding regions on vcDNA: vcDNA=SeqID_9153; Strand=+; Position=110-748
  misc_feature: Homolog annotation: Hit_ID=XP_309110.1; Match level="QueryCoverage =91%, HitCoverage=63%, E-value=1e-26, Identity=34%"; Hit description =ENSANGP00000020505 [Anopheles gambiae]
  misc_feature: Pfam annotation: Pfam_ID=Pex2_Pex12; Match level="Score=10.0, E-value= 2.2e-06, Copies=1"; Pfam description=Pex2 / Pex12 amino terminal region
  misc_feature (136)..(142): Xaa can be any naturally occurring amino acid
MKFYKAKVADVLRLHQRDELFIMDAEQKMHLFLKLMGSGNYHRLNSSISTIARVWYYFMTSMEKLQTLGEEYTGTIRSNTSHQIPSKSLSLLWLILHVGGEPMFDRILNYSKKKILASQDLRSDVKSLLLKCIAIXXXXXXXLKRIHNALFYMDGRYYNISNRVTGIQYVLLRQWLEDDTFTGSFSILGNLSLFYVLLSFVMKMFTPSSSYHT

SEQ ID NO: 29457 - protein, 90 aa, Diabrotica virgifera
  misc_feature: Coding regions on vcDNA: vcDNA=SeqID_9154; Strand=-; Position=6-278
  misc_feature (6)..(14): Xaa can be any naturally occurring amino acid
  misc_feature (16)..(25): Xaa can be any naturally occurring amino acid
  misc_feature (31)..(31): Xaa can be any naturally occurring amino acid
  misc_feature (33)..(50): Xaa can be any naturally occurring amino acid
  misc_feature (56)..(73): Xaa can be any naturally occurring amino acid
  misc_feature (76)..(84): Xaa can be any naturally occurring amino acid
PNNKLXXXXXXXXXLXXXXXXXXXXSSLKKXSXXXXXXXXXXXXXXXXXXLIPASXXXXXXXXXXXXXXXXXXLIXXXXXXXXXYQKDMF

SEQ ID NO: 29458 - protein, 66 aa, Diabrotica virgifera
  misc_feature: Coding regions on vcDNA: vcDNA=SeqID_9155; Strand=-; Position=379-579
NKLSYIHIIYSMLQNSRKVVVYQYQEIFIILYLCLYKHGYISTKLVFIMCITKIVSREQFFYHLTK

SEQ ID NO: 29459 - protein, 17 aa, Diabrotica virgifera
  misc_feature: Coding regions on vcDNA: vcDNA=SeqID_9156; Strand=-; Position=1-51
  misc_feature (1)..(17): Xaa can be any naturally occurring amino acid
XXXXXXXXXXXXXXXXX

SEQ ID NO: 29460 - protein, 36 aa, Diabrotica virgifera
  misc_feature: Coding regions on vcDNA: vcDNA=SeqID_9157; Strand=-; Position=1-108
  misc_feature (23)..(23): Xaa can be any naturally occurring amino acid
NPLQSCPKTAASTMVAFLRILRXRTFDSKGTHFTKV

SEQ ID NO: 29461 - protein, 257 aa, Diabrotica virgifera
  misc_feature: Coding regions on vcDNA: vcDNA=SeqID_9158; Strand=+; Position=104-877
  misc_feature: Homolog annotation: Hit_ID=XP_392926.1; Match level="QueryCoverage =95%, HitCoverage=94%, E-value=3e-77, Identity=56%"; Hit description =similar to ENSANGP00000017454 [Apis mellifera]
  misc_feature: Pfam annotation: Pfam_ID=DedA; Match level="Score=-16.6, E-value =0.01, Copies=1"; Pfam description=DedA family
  misc_feature (189)..(189): Xaa can be any naturally occurring amino acid
MASRVTGNQVQEKLSTRVATVSVIVIFLTSLLALSLVYKTCPNVTEAERQHIKIPWNIEDAKQLGIVLNKYKIDNYYQVMTGVCVTYVFLQTFAIPGSLFLSILSGFLFPFFTALTLVCTCSMVGASLCFMLSQILGRKLVLHYFPEKARKWAVQVEKHRSNMLNYIIFLRITPFFPNWFINLTAPVIXVPLYPFAFGTFIGVAPPSFIAIKGGQTLHDMTASDTAFNMTSFVWLIVVWSMSLIPILLKNRLREKME

SEQ ID NO: 29462 - protein, 277 aa, Diabrotica virgifera
  misc_feature: Coding regions on vcDNA: vcDNA=SeqID_9159; Strand=-; Position=3-833
  misc_feature (1)..(8): Xaa can be any naturally occurring amino acid
  misc_feature (11)..(23): Xaa can be any naturally occurring amino acid
  misc_feature (36)..(37): Xaa can be any naturally occurring amino acid
  misc_feature (45)..(276): Xaa can be any naturally occurring amino acid
XXXXXXXXRTXXXXXXXXXXXXXIQHRGRNLIYRLXXSNKITLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXM

SEQ ID NO: 29463 - protein, 66 aa, Diabrotica virgifera; identical to SEQ ID NO: 26808
  misc_feature: Coding regions on vcDNA: vcDNA=SeqID_9160; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 29464 - protein, 47 aa, Diabrotica virgifera; identical to SEQ ID NO: 26759
  misc_feature: Coding regions on vcDNA: vcDNA=SeqID_9161; Strand=+; Position=1-144
  misc_feature (1)..(15): Xaa can be any naturally occurring amino acid
  misc_feature (17)..(24): Xaa can be any naturally occurring amino acid

SEQ ID NO: 29465 - protein, 135 aa, Diabrotica virgifera
  misc_feature: Coding regions on vcDNA: vcDNA=SeqID_9162; Strand=-; Position=2-406
  misc_feature (60)..(60): Xaa can be any naturally occurring amino acid
ASHYLATEGSETEVEDQVNRANRVAGCLNDTIWRNKNIGKELKGRIYKTVIRPIMTYAAXTRPDTERTKILLETAEMKTLRKIDGKTLWDRAISADIRRRCKVDNINNWVRNRRKEWNDHISRMTTNIVVRTARD

SEQ ID NO: 29466 - protein, 287 aa, Diabrotica virgifera
  misc_feature: Coding regions on vcDNA: vcDNA=SeqID_9163; Strand=-; Position=6-869
  misc_feature (1)..(222): Xaa can be any naturally occurring amino acid
  misc_feature (225)..(263): Xaa can be any naturally occurring amino acid
  misc_feature (265)..(279): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDFXXXXXXXXXXXXXXXXXXXXXXXXXXXXXXXXXXXXXXXGXXXXXXXXXXXXXXXGYDLMIVN

SEQ ID NO: 29467 - protein, 30 aa, Diabrotica virgifera
  misc_feature: Coding regions on vcDNA: vcDNA=SeqID_9164; Strand=+; Position=3-95
AILLTLIQHRGRNLYYRFELSNKITLLSLR

SEQ ID NO: 29468 - protein, 73 aa, Diabrotica virgifera
  misc_feature: Coding regions on vcDNA: vcDNA=SeqID_9165; Strand=-; Position=13-234
FFLFLTSQLLIPKLRHSYKQIIRSIEQNFTLNIASYDIIFLLFNLLMYIILPNHFRKNKNNRFIFILYTFILF

SEQ ID NO: 29469 - protein, 285 aa, Diabrotica virgifera
  misc_feature: Coding regions on vcDNA: vcDNA=SeqID_9166; Strand=-; Position=0-854
  misc_feature (2)..(9): Xaa can be any naturally occurring amino acid
  misc_feature (13)..(31): Xaa can be any naturally occurring amino acid
  misc_feature (34)..(46): Xaa can be any naturally occurring amino acid
  misc_feature (50)..(269): Xaa can be any naturally occurring amino acid
  misc_feature (271)..(281): Xaa can be any naturally occurring amino acid
FXXXXXXXXGVYXXXXXXXXXXXXXXXXXXXQSXXXXXXXXXXXXXSLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMXXXXXXXXXXXARGG

SEQ ID NO: 29470 - protein, 97 aa, Diabrotica virgifera
  misc_feature: Coding regions on vcDNA: vcDNA=SeqID_9167; Strand=+; Position=521-814
  misc_feature (9)..(14): Xaa can be any naturally occurring amino acid
  misc_feature (47)..(61): Xaa can be any naturally occurring amino acid
  misc_feature (63)..(69): Xaa can be any naturally occurring amino acid
  misc_feature (75)..(75): Xaa can be any naturally occurring amino acid
NTGIWKTMXXXXXXRVTLEKNGIGLFCSKLCILSIPWRNALFSGTPXXXXXXXXXXXXXXXYXXXXXXXINLMLXTCSGAHSMGISKCFDKCFISFL

SEQ ID NO: 29471 - protein, 276 aa, Diabrotica virgifera
  misc_feature: Coding regions on vcDNA: vcDNA=SeqID_9168; Strand=+; Position=50-875
  misc_feature: Homolog annotation: Hit_ID=XP_391843.1; Match level="QueryCoverage =97%, HitCoverage=66%, E-value=6e-90, Identity=62%"; Hit description =similar to ENSANGP00000013285 [Apis mellifera]
  misc_feature: Gene Ontology Annotation: Molecular function=3-oxoacyl-[acyl-carrier protein] reductase activity; Cellular component=mitochondrion; Biological process=lipid metabolism
  misc_feature: Pfam annotation: Pfam_ID=Thiolase_N; Match level="Score=327.4, E -value=2.2e-95, Copies=1"; Pfam description=Thiolase, N-terminal domain
  misc_feature (216)..(222): Xaa can be any naturally occurring amino acid
  misc_feature (260)..(260): Xaa can be any naturally occurring amino acid
MTSLTKGIFIVGAKRTPFGTFGGKLAKSHITDLQVIASKGALAAANVKPELVDTVVIGNVIPSVAADGGFLARHVLLKSGIPLEKPAFSVNRLCGSGFQSLINGLQDISTGVAEVALTGGVENMSSCPYIVRNIRFGNVPLGTSPVLEDTLWLSVLDTYCNLPMALTAEKLGEKFKLTKDEIDEFAFNSQQRWKAAQDAGKFKDEIVPVPIKEKKXXXXXXXDEHPRPWTTLDMLKKLPTIFKKDGLVTAGTASGISDGXAGAVVVASEAASSKHN

SEQ ID NO: 29472 - protein, 217 aa, Diabrotica virgifera
  misc_feature: Coding regions on vcDNA: vcDNA=SeqID_9169; Strand=+; Position=161-811
  misc_feature: Homolog annotation: Hit_ID=XP_313002.1; Match level="QueryCoverage =86%, HitCoverage=56%, E-value=2e-57, Identity=57%"; Hit description =ENSANGP00000020344 [Anopheles gambiae]
  misc_feature: Pfam annotation: Pfam_ID=DUF1676; Match level="Score=82.2, E-value =1.4e-21, Copies=1"; Pfam description=Protein of unknown function (DUF1676)
  misc_feature (202)..(202): Xaa can be any naturally occurring amino acid
  misc_feature (211)..(211): Xaa can be any naturally occurring amino acid
MFGVSKWVFLLSYMSLVALQSIGQDGNFRSQEVIDNNGPQGRNLLDWIGFGTGPETDPYLARTNGACLNGDLAECFKSRALASFEDFFTKPEYYLSENARIRRMPETQLRQLSQEPYEYSESPRADEPEWDQLLKFGKRKLEKFLKSTVFELDFDEEVTERGRYSPRFIDEIAGEIDIIEDKKDTLFKRKQLKKLFIPLLLXLKLFNLKLXLFLPLI

SEQ ID NO: 29473 - protein, 299 aa, Diabrotica virgifera
  misc_feature: Coding regions on vcDNA: vcDNA=SeqID_9170; Strand=+; Position=93-987
  misc_feature: Homolog annotation: Hit_ID=XP_392713.1; Match level="QueryCoverage =97%, HitCoverage=88%, E-value=8e-95, Identity=55%"; Hit description =similar to ENSANGP00000014774 [Apis mellifera]
  misc_feature: Pfam annotation: Pfam_ID=UPF0005; Match level="Score=-46.6, E-value =0.0016, Copies=1"; Pfam description=Uncharacterised protein family UPF000
  misc_feature (65)..(65): Xaa can be any naturally occurring amino acid
  misc_feature (254)..(254): Xaa can be any naturally occurring amino acid
MALMLASRVCRASTLSKTTVFVKQPNTITVYRAFSEGKDAAARTARRQVGIKEKLMQPAGDTAFXMGRGALAGASALGIGALAFYGLGLSSEASALEKQHLWPQYVKDRIKTTYMYFGSSIAITAASALAAVRSPAIMRLVMANGFMGFAISLAAIMGTGILCQSIPYSEGFGSKQLAWMLHAGTMGAMIAPLCFLGGPLLIRAAWYTAGVVGGLSTIAVCAPSEKFLYMGGPLAMGLGVVFVSSIGSVFLPPXTALGAGFVLIQLYGGLILFSAFLLYDTQRIIAQAERYPAHPDALG

SEQ ID NO: 29474 - protein, 247 aa, Diabrotica virgifera
  misc_feature: Coding regions on vcDNA: vcDNA=SeqID_9171; Strand=-; Position=1-741
  misc_feature (2)..(247): Xaa can be any naturally occurring amino acid
KXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29475 - protein, 65 aa, Diabrotica virgifera
  misc_feature: Coding regions on vcDNA: vcDNA=SeqID_9172; Strand=+; Position=66-263
  misc_feature (26)..(32): Xaa can be any naturally occurring amino acid
TNRYLIYRTSKVTSRIEYCHSSTLVXXXXXXXLHGCFPIPIIRVIREEERYLSNEQSICITKIAL

SEQ ID NO: 29476 - protein, 20 aa, Diabrotica virgifera
  misc_feature: Coding regions on vcDNA: vcDNA=SeqID_9173; Strand=-; Position=2-61
  misc_feature (1)..(12): Xaa can be any naturally occurring amino acid
  misc_feature (15)..(16): Xaa can be any naturally occurring amino acid
XXXXXXXXXXXXLFXXKINS

SEQ ID NO: 29477 - protein, 213 aa, Diabrotica virgifera
  misc_feature: Coding regions on vcDNA: vcDNA=SeqID_9174; Strand=+; Position=1-639
  misc_feature: Homolog annotation: Hit_ID=XP_312588.1; Match level="QueryCoverage =91%, HitCoverage=85%, E-value=1e-46, Identity=44%"; Hit description =ENSANGP00000014942 [Anopheles gambiae]
  misc_feature: Gene Ontology Annotation: Molecular function=molecular_function unknown; Cellular component=nucleus; Biological process=locomotory behavior
RQFTKREAPLNGGGYPSGGPSPPSSSYGAPIGGGGGGFGGGGGFGGGGNGNGNGNGFGGISSSYGAPPSSSYGAPPSSSYGAPPSSSYGAPPSSSYGAPPSGSFGPPPSNSYGAPPSSSYGAPPSNSYGAPPSSSYGAPPSNSYRAPPSRPSSSYGAPKRPSRPSSSYGAPPRRPSSSYGAPPSSSYGAPPSSSYGAPPSYVLWITSLLVHME

SEQ ID NO: 29478 - protein, 51 aa, Diabrotica virgifera
  misc_feature: Coding regions on vcDNA: vcDNA=SeqID_9175; Strand=-; Position=1-153
  misc_feature (1)..(36): Xaa can be any naturally occurring amino acid
  misc_feature (38)..(50): Xaa can be any naturally occurring amino acid
XXXXXXXXXXXXXXXXXXXXXXXXXXXXXXXXXXXXIXXXXXXXXXXXXXA

SEQ ID NO: 29479 - protein, 168 aa, Diabrotica virgifera
  misc_feature: Coding regions on vcDNA: vcDNA=SeqID_9176; Strand=-; Position=1-504
  misc_feature (2)..(13): Xaa can be any naturally occurring amino acid
  misc_feature (16)..(26): Xaa can be any naturally occurring amino acid
  misc_feature (36)..(43): Xaa can be any naturally occurring amino acid
  misc_feature (46)..(59): Xaa can be any naturally occurring amino acid
  misc_feature (65)..(78): Xaa can be any naturally occurring amino acid
  misc_feature (80)..(168): Xaa can be any naturally occurring amino acid
IXXXXXXXXXXXXPFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29480 - protein, 67 aa, Diabrotica virgifera
  misc_feature: Coding regions on vcDNA: vcDNA=SeqID_9177; Strand=-; Position=153-356
SLFGLPLKVVSIASFNLPEYNILITSSLSVCNIQCMLWSQSQPEDHGIIIEWLHSINAPIIVSVLMK

SEQ ID NO: 29481 - protein, 108 aa, Diabrotica virgifera; identical to SEQ ID NO: 27732
  misc_feature: Coding regions on vcDNA: vcDNA=SeqID_9178; Strand=+; Position=231-557
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 29482 - protein, 294 aa, Diabrotica virgifera
  misc_feature: Coding regions on vcDNA: vcDNA=SeqID_9179; Strand=+; Position=68-950
  misc_feature: Homolog annotation: Hit_ID=XP_394517.1; Match level="QueryCoverage =100%, HitCoverage=93%, E-value=2e-82, Identity=54%"; Hit description= similar to ENSANGP00000009731 [Apis mellifera]
  misc_feature: Gene Ontology Annotation: Molecular function=chromatin binding; Cellular component=chromosome; Biological process=signal transduction
  misc_feature: Pfam annotation: Pfam_ID=PHD; Match level="Score=49.9, E-value=7.4e -12, Copies=1"; Pfam description=PHD-finger
  misc_feature (199)..(199): Xaa can be any naturally occurring amino acid
  misc_feature (276)..(276): Xaa can be any naturally occurring amino acid
MLNQVSVEAVYSATYVENYLDCVENLPDEVQRLISRMRELDVIYLARLREVAIQTENMGNDNHAKKAKSFLRMQQSLIAAQELGDEKMSLLQAILDKIEIKTRLLDQDLKNLDFGKEEQTQIEIKEQQSPLVNTPINNNNGNNTSTNNNNSNSVNNDRPAKRARRTRHDTYTGAESNDAIPVEHVLRSQVPATTPTNTXSRKTSTSKKKKRKSRQNTQIQKEETPPRDEEPLIDPDEPTYCLCDQISYGEMIMCDNDLCPIEWVHFSCVNVSTKPXGQWYCPKCRGDRPHVMKP

SEQ ID NO: 29483 - protein, 81 aa, Diabrotica virgifera
  misc_feature: Coding regions on vcDNA: vcDNA=SeqID_9180; Strand=+; Position=98-340
SSNILPFIADCMAKEITDLTASNLIPMIIDSPYSTIGHGDMGYSACLDYFLPDAVYSADSTWNFSYTQFLPILFTRILCQT

SEQ ID NO: 29484 - protein, 19 aa, Diabrotica virgifera
  misc_feature: Coding regions on vcDNA: vcDNA=SeqID_9181; Strand=+; Position=3-62
KTTTSPSWCYHNAEGILSI

SEQ ID NO: 29485 - protein, 139 aa, Diabrotica virgifera
  misc_feature: Coding regions on vcDNA: vcDNA=SeqID_9182; Strand=+; Position=234-650
NIGVDFLMGDLALPYAFKVLHQKTIAYTARLLKIYRPHIIKQIPQSSSGRIGLTQEPTSKALQNLAITDLICFYMKMYSCQSISRVLYIRVYMSLGHPVAPGCCAILDWIIGLKWIKENIRNVVGDPDQIIAWGQSAGN

SEQ ID NO: 29486 - protein, 223 aa, Diabrotica virgifera
  misc_feature: Coding regions on vcDNA: vcDNA=SeqID_9183; Strand=-; Position=61-732
  misc_feature: Homolog annotation: Hit_ID=AAS38911.1; Match level="QueryCoverage =97%, HitCoverage=87%, E-value=7e-22, Identity=42%"; Hit description =similar to Leishmania major. Ppg3 [Dictyostelium discoideum]
  misc_feature: Gene Ontology Annotation: Molecular function=molecular_function unknown; Cellular component=integral to plasma membrane; Biological process=cell wall organization and biogenesis
  misc_feature (14)..(24): Xaa can be any naturally occurring amino acid
  misc_feature (74)..(74): Xaa can be any naturally occurring amino acid
  misc_feature (207)..(207): Xaa can be any naturally occurring amino acid
RAPKRSSSSSSSSXXXXXXXXXXXSCPSSRSSPSSSSDTSSSSCSSSSSSYSISLLVLSCSLLTGRMYAVASSXYLALAVLGSTVSSPSSLSSSSSEKSSSTCSISGSTSLKAGGTIIVFLLSCIFGGAFSAGRISSSVPELSTVPSLSFSSPSASGSCFCSAFFGFFTSLVVSAALTLSSVPSSSSCSVSFASSVSAVSSFSLLAXSSSSCSSSSPSLSSRS

SEQ ID NO: 29487 - protein, 20 aa, Diabrotica virgifera
  misc_feature: Coding regions on vcDNA: vcDNA=SeqID_9184; Strand=-; Position=1-60
  misc_feature (5)..(20): Xaa can be any naturally occurring amino acid
KELLXXXXXXXXXXXXXXXX

SEQ ID NO: 29488 - protein, 48 aa, Diabrotica virgifera
  misc_feature: Coding regions on vcDNA: vcDNA=SeqID_9185; Strand=-; Position=0-143
ERSCSVNKILILTYIFSSSPRKAVAAVDYGEQDGKKNDSSHDAGRKGA

SEQ ID NO: 29489 - protein, 100 aa, Diabrotica virgifera
  misc_feature: Coding regions on vcDNA: vcDNA=SeqID_9186; Strand=-; Position=238-540
  misc_feature (2)..(16): Xaa can be any naturally occurring amino acid
  misc_feature (26)..(34): Xaa can be any naturally occurring amino acid
  misc_feature (43)..(79): Xaa can be any naturally occurring amino acid
  misc_feature (84)..(91): Xaa can be any naturally occurring amino acid
LXXXXXXXXXXXXXXXGAPPNKKEPXXXXXXXXXPQNPRTPSXXXXXXXXXXXXXXXXXXXXXXXXXXXXXXXXXXXXXPFVLXXXXXXXXETQPGSPRF

SEQ ID NO: 29490 - protein, 92 aa, Diabrotica virgifera
  misc_feature: Coding regions on vcDNA: vcDNA=SeqID_9187; Strand=-; Position=1-276
  misc_feature (2)..(9): Xaa can be any naturally occurring amino acid
  misc_feature (14)..(92): Xaa can be any naturally occurring amino acid
IXXXXXXXXVRKIXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29491 - protein, 229 aa, Diabrotica virgifera
  misc_feature: Coding regions on vcDNA: vcDNA=SeqID_9188; Strand=-; Position=3-689
  misc_feature (10)..(23): Xaa can be any naturally occurring amino acid
  misc_feature (26)..(36): Xaa can be any naturally occurring amino acid
  misc_feature (46)..(53): Xaa can be any naturally occurring amino acid
  misc_feature (56)..(69): Xaa can be any naturally occurring amino acid
  misc_feature (75)..(88): Xaa can be any naturally occurring amino acid
  misc_feature (90)..(229): Xaa can be any naturally occurring amino acid
PYQFFQFDDXXXXXXXXXXXXXXPFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29492 - protein, 108 aa, Diabrotica virgifera
  misc_feature: Coding regions on vcDNA: vcDNA=SeqID_9189; Strand=+; Position=3-331
  misc_feature: Homolog annotation: Hit_ID=AAF72513.1; Match level="QueryCoverage =87%, HitCoverage=46%, E-value=2e-13, Identity=48%"; Hit description =cytochrome oxidase I [Holopedium acidophilum]
  misc_feature (72)..(72): Xaa can be any naturally occurring amino acid
  misc_feature (80)..(80): Xaa can be any naturally occurring amino acid
  misc_feature (97)..(97): Xaa can be any naturally occurring amino acid
SRGREFPGRLSRPGIVGIRTGWVLTSLRSLVRAELRWTRSLNGNVQIVNVIVTGRALIIGFYRGIPILLVGXINRVVPLXIDAPVITFDLINNIVNXLLPPTLLLVLL

SEQ ID NO: 29493 - protein, 199 aa, Diabrotica virgifera
  misc_feature: Coding regions on vcDNA: vcDNA=SeqID_9190; Strand=+; Position=157-753
  misc_feature: Homolog annotation: Hit_ID=XP_318647.1; Match level="QueryCoverage =85%, HitCoverage=31%, E-value=1e-30, Identity=44%"; Hit description =ENSANGP00000020940 [Anopheles gambiae]
  misc_feature (183)..(183): Xaa can be any naturally occurring amino acid
MSSVESIKDIKEHKKHSHRNRGFCSYVRTMLLKVFLFTRYYIDILIDVIFGYFNDSKRVPIKKCTNPIILESATSLAQKIRKRELTSEEIVQAFVDRIKEVNPVLNALVDSRYEAALEDARKIDRDIANGTILDVDFQEKPFLGVPFTTKESTAVEGMSFTLGIVKRRGRRAVFDAEYITLIXNAGAICLGVTNIPQLN

SEQ ID NO: 29494 - protein, 79 aa, Diabrotica virgifera
  misc_feature: Coding regions on vcDNA: vcDNA=SeqID_9191; Strand=-; Position=264-503
  misc_feature (15)..(22): Xaa can be any naturally occurring amino acid
  misc_feature (62)..(76): Xaa can be any naturally occurring amino acid
IQKCIDVFISSSLSXXXXXXXXTKGLFSKFNEQTIVYCMILYSAIKKLYNYTLNIKTPYPNXXXXXXXXXXXXXXXYVV

SEQ ID NO: 29495 - protein, 37 aa, Diabrotica virgifera
  misc_feature: Coding regions on vcDNA: vcDNA=SeqID_9192; Strand=-; Position=1-111
  misc_feature (1)..(35): Xaa can be any naturally occurring amino acid
XXXXXXXXXXXXXXXXXXXXXXXXXXXXXXXXXXXSF

SEQ ID NO: 29496 - protein, 61 aa, Diabrotica virgifera
  misc_feature: Coding regions on vcDNA: vcDNA=SeqID_9193; Strand=-; Position=0-182
YIYNDFLILHESRAYLPLSEGLRNIVLYRNMNYMPSYRWFYLFQQRTFYFFTLTVGGRIGG

SEQ ID NO: 29497 - protein, 64 aa, Diabrotica virgifera
  misc_feature: Coding regions on vcDNA: vcDNA=SeqID_9194; Strand=+; Position=270-464
FVSVDLQVIFWFTIINQHHHSAYTYPLLDVGLPQFTSQIPVLSRFISVVDQLPNYTYLCMRDCY

SEQ ID NO: 29498 - protein, 36 aa, Diabrotica virgifera
  misc_feature: Coding regions on vcDNA: vcDNA=SeqID_9195; Strand=-; Position=0-107
  misc_feature (1)..(18): Xaa can be any naturally occurring amino acid
XXXXXXXXXXXXXXXXXXFSFNKKLMICYLARSNTR

SEQ ID NO: 29499 - protein, 93 aa, Diabrotica virgifera
  misc_feature: Coding regions on vcDNA: vcDNA=SeqID_9196; Strand=-; Position=3-281
RLTFLRRSLVNTIVNPFNCFSFCGTVLGSLLGSTFSDFLSNLLRASPRMALKTRLESIASVISPRTLYRKSTRYKNRVPRAGKDPREIRARSL

SEQ ID NO: 29500 - protein, 19 aa, Diabrotica virgifera
  misc_feature: Coding regions on vcDNA: vcDNA=SeqID_9197; Strand=-; Position=1-57
  misc_feature (4)..(19): Xaa can be any naturally occurring amino acid
IKKXXXXXXXXXXXXXXXX

SEQ ID NO: 29501 - protein, 249 aa, Diabrotica virgifera
  misc_feature: Coding regions on vcDNA: vcDNA=SeqID_9198; Strand=+; Position=128-877
  misc_feature: Homolog annotation: Hit_ID=XP_397074.1; Match level="QueryCoverage =82%, HitCoverage=88%, E-value=7e-34, Identity=38%"; Hit description =similar to ENSANGP00000017031 [Apis mellifera]
  misc_feature: Pfam annotation: Pfam_ID=rve; Match level="Score=61.5, E-value=2.3e -15, Copies=1"; Pfam description=Integrase core domain
  misc_feature (163)..(169): Xaa can be any naturally occurring amino acid
MLSKLHIAHLGMEKTKSRARKIFYWLGMTSDIENYISKCNTCLKFSRKPTKEPLIPHDKPNIPFYKVGCDILTFGGIDYLVLVDYYTNWIELKKLESKTSGDVINKLKQIFSTFGIPMMLIADNMPFNSAECHSFAKDWEFKIQTSSPLYPESNGLAERAVGXXXXXXXKSLEANTDVFKALLEYRNTPLAGCNISPAELIFKKQLRSVLPLTGKHLEPSFDNESQKLTEKRTGIRFITIIRKVGQSLR

SEQ ID NO: 29502 - protein, 257 aa, Diabrotica virgifera
  misc_feature: Coding regions on vcDNA: vcDNA=SeqID_9199; Strand=+; Position=2-771
  misc_feature: Homolog annotation: Hit_ID=NP_788865.1; Match level="QueryCoverage =91%, HitCoverage=82%, E-value=1e-54, Identity=43%"; Hit description =CG3960-PD, isoform D [Drosophila melanogaster] gb|AAO41633.1| CG3960- PD, isoform D [Drosophila
  misc_feature: Gene Ontology Annotation: Molecular function=structural constituent of muscle; Cellular component=actin filament; Biological process =muscle contraction
  misc_feature: Pfam annotation: Pfam_ID=CH; Match level="Score=90.8, E-value=3.5e -24, Copies=1"; Pfam description=Calponin homology (CH) domain
  misc_feature (167)..(167): Xaa can be any naturally occurring amino acid
  misc_feature (215)..(215): Xaa can be any naturally occurring amino acid
ENRGTAITTTKSKISASELVPTTTSKKTIKLTTTVTEGGKTKTKTLVFQSPITEEELENIWDEKILRLLLEQSTEYEERRIIRNRLRSVMAEQEACADLVQKASQEQASGKIEESVTVEKSSSETPTTTTTTKVTKISTQQQVTKKPLSPFAKFQQLDKQNSTTTPXRNVQLDNFSTSWADGLAFCALIHHFLPDAFDYHALTPKERRHNFELAXQVASDKADIFPLLDVDDMMATRRPDWKCVFTYVQSIYRRFYY

SEQ ID NO: 29503 - protein, 21 aa, Diabrotica virgifera
  misc_feature: Coding regions on vcDNA: vcDNA=SeqID_9200; Strand=-; Position=1-63
  misc_feature (1)..(19): Xaa can be any naturally occurring amino acid
XXXXXXXXXXXXXXXXXXXNL

SEQ ID NO: 29504 - protein, 129 aa, Diabrotica virgifera
  misc_feature: Coding regions on vcDNA: vcDNA=SeqID_9201; Strand=+; Position=102-492
  misc_feature: Homolog annotation: Hit_ID=AAM44044.1; Match level="QueryCoverage =75%, HitCoverage=42%, E-value=3e-13, Identity=41%"; Hit description =ferritin 2 [Apriona germari]
  misc_feature (30)..(30): Xaa can be any naturally occurring amino acid
  misc_feature (81)..(81): Xaa can be any naturally occurring amino acid
ASLNSCYNDVYTACDPAAETIVVKLDSNCXATFPGIDSSHSRLQIFLIHMVIITLVYLLLTTNFDNYQRYPIGFEKLLRRXSDIKWNDDKEFDKYLTVRGGDAEQPVLFDSDELDRSFSRFALEKEVCT

SEQ ID NO: 29505 - protein, 131 aa, Diabrotica virgifera
  misc_feature: Coding regions on vcDNA: vcDNA=SeqID_9202; Strand=+; Position=644-1036
  misc_feature (30)..(67): Xaa can be any naturally occurring amino acid
  misc_feature (69)..(131): Xaa can be any naturally occurring amino acid
LHFRKYIDTVLASNLPAKFQNFRIKFRVIXXXXXXXXXXXXXXXXXXXXXXXXXXXXXXXXXXXXXXKXXXXXXXXXXXXXXXXXXXXXXXXXXXXXXXXXXXXXXXXXXXXXXXXXXXXXXXXXXXXXXX

SEQ ID NO: 29506 - protein, 73 aa, Diabrotica virgifera
  misc_feature: Coding regions on vcDNA: vcDNA=SeqID_9203; Strand=-; Position=1-219
  misc_feature (21)..(27): Xaa can be any naturally occurring amino acid
DLLMSFHIPQIKNFQLVTLGXXXXXXXVCGVNVDSAHYLKIETLNRSLRQNHELSMSFRSDIVPIIESIPLTP

SEQ ID NO: 29507 - protein, 36 aa, Diabrotica virgifera
  misc_feature: Coding regions on vcDNA: vcDNA=SeqID_9204; Strand=-; Position=0-107
  misc_feature (1)..(33): Xaa can be any naturally occurring amino acid
XXXXXXXXXXXXXXXXXXXXXXXXXXXXXXXXXSST

SEQ ID NO: 29508 - protein, 106 aa, Diabrotica virgifera
  misc_feature: Coding regions on vcDNA: vcDNA=SeqID_9205; Strand=-; Position=17-337
  misc_feature (5)..(12): Xaa can be any naturally occurring amino acid
  misc_feature (15)..(32): Xaa can be any naturally occurring amino acid
  misc_feature (42)..(77): Xaa can be any naturally occurring amino acid
IYKRXXXXXXXXYNXXXXXXXXXXXXXXXXXXYYLYNLNLSXXXXXXXXXXXXXXXXXXXXXXXXXXXXXXXXXXXXLLIFISMIFINLYSRYSSRSGPEPKHCLV

SEQ ID NO: 29509 - protein, 262 aa, Diabrotica virgifera
  misc_feature: Coding regions on vcDNA: vcDNA=SeqID_9206; Strand=+; Position=103-891
  misc_feature: Homolog annotation: Hit_ID=XP_392109.1; Match level="QueryCoverage =75%, HitCoverage=27%, E-value=5e-35, Identity=37%"; Hit description =similar to cathepsin B mRNA 3-untranslated-region-binding protein CBBP [Apis mellifera]
  misc_feature: Gene Ontology Annotation: Molecular function=zinc ion binding; Cellular component=nucleus; Biological process=regulation of cell cycle
  misc_feature (66)..(74): Xaa can be any naturally occurring amino acid
FIVFVLIKNRQGGGFNRDRKRSQNQKDQKKDKEDGTDGEDGETKRDWKDEKSNSETPETEEEAKAXXXXXXXXXPYYDIPIKLLSCFVCNKEMWDGESMRKHVKGRAHRQMLDSLEESIHITVNILRENMRLLEEKKLIELNRVQRVTKRFNKPEPESHCNMCDLKFLGKIIAHRKTEGHQRLKHYLHPNCRLCSKEFPSRMEWIEHRLTPEHLRKLSKTLADKVGGADGNDIVESEEETNDLALEPILDEPLEMEAENPIL

SEQ ID NO: 29510 - protein, 26 aa, Diabrotica virgifera
  misc_feature: Coding regions on vcDNA: vcDNA=SeqID_9207; Strand=+; Position=1-78
  misc_feature (21)..(21): Xaa can be any naturally occurring amino acid
LAPGVTSQVVFLLFSSYFRQXHLLYF

SEQ ID NO: 29511 - protein, 40 aa, Diabrotica virgifera
  misc_feature: Coding regions on vcDNA: vcDNA=SeqID_9208; Strand=+; Position=227-346
  misc_feature (21)..(27): Xaa can be any naturally occurring amino acid
MFILGPGSLQVLYTCSLFHYXXXXXXXMSIMSLKVVYIVI

SEQ ID NO: 29512 - protein, 60 aa, Diabrotica virgifera
  misc_feature: Coding regions on vcDNA: vcDNA=SeqID_9209; Strand=-; Position=146-328
MSLFLSLEKNQLLRLFKFRLYYKINNILLAPIWMNCEIKENDAPRALEVGRNQPLLHIGK

SEQ ID NO: 29513 - protein, 108 aa, Diabrotica virgifera; identical to SEQ ID NO: 27732
  misc_feature: Coding regions on vcDNA: vcDNA=SeqID_9210; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 29514 - protein, 268 aa, Diabrotica virgifera
  misc_feature: Coding regions on vcDNA: vcDNA=SeqID_9211; Strand=-; Position=1-804
  misc_feature (1)..(1): Xaa can be any naturally occurring amino acid
  misc_feature (4)..(268): Xaa can be any naturally occurring amino acid
XNNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29515 - protein, 64 aa, Diabrotica virgifera
  misc_feature: Coding regions on vcDNA: vcDNA=SeqID_9212; Strand=+; Position=12-203
  misc_feature (17)..(17): Xaa can be any naturally occurring amino acid
  misc_feature (32)..(39): Xaa can be any naturally occurring amino acid
  misc_feature (50)..(59): Xaa can be any naturally occurring amino acid
FYLESQSIIRLRPRCWXKVYIGCSSIFISLVXXXXXXXXSLKRGGAQVGXXXXXXXXXXVTKGP

SEQ ID NO: 29516 - protein, 265 aa, Diabrotica virgifera
  misc_feature: Coding regions on vcDNA: vcDNA=SeqID_9213; Strand=+; Position=2-796
  misc_feature: Homolog annotation: Hit_ID=EAK93415.1; Match level="QueryCoverage =98%, HitCoverage=47%, E-value=3e-11, Identity=23%"; Hit description =flocculin-like protein [Candida albicans SC5314]
  misc_feature (195)..(201): Xaa can be any naturally occurring amino acid
DSLEDSKSIIEISSSVTSIKDTTEPSLDEDRSNQAVTSSIITLDDSSDKYKSSEITSSEIIDESLKSINESIDILKDLENSSEVYKTAVESDKFNLDTTTDDSFKLNSLTVESIDDISTSETSNIDRFVSIENHSNLAETKDDSINENSDGIVEAVNDNIKEKKSQEIVQAINTEINLNEINSSNEIVETAQAIXXXXXXXEVNSSNEIVETVNYNVNNSSDALSKSSEVVENTKSKSNTLLMESYPEDLNPFDDEPPTHDSLNP

SEQ ID NO: 29517 - protein, 49 aa, Diabrotica virgifera
  misc_feature: Coding regions on vcDNA: vcDNA=SeqID_9214; Strand=-; Position=188-337
KYIFKYYLVYEIYYMSKAQHSSERIVKHAYASMRGCRVGSFMLCPHISK

SEQ ID NO: 29518 - protein, 254 aa, Diabrotica virgifera
  misc_feature: Coding regions on vcDNA: vcDNA=SeqID_9215; Strand=+; Position=1-762
  misc_feature: Homolog annotation: Hit_ID=XP_394363.1; Match level="QueryCoverage =96%, HitCoverage=12%, E-value=1e-102, Identity=75%"; Hit description= similar to CG12532-PA [Apis mellifera]
  misc_feature: Gene Ontology Annotation: Molecular function=protein tyrosine/serine/threonine phosphatase activity; Cellular component =integral to membrane; Biological process=protein amino acid dephosphorylation
  misc_feature: Pfam annotation: Pfam_ID=GRAM; Match level="Score=26.1, E-value =0.0001, Copies=1"; Pfam description=GRAM domain
  misc_feature (81)..(88): Xaa can be any naturally occurring amino acid
  misc_feature (219)..(225): Xaa can be any naturally occurring amino acid
GNSVIRSVSRFIDKVCNEGGVTREHIRNLHQMIPGVVHMHIETLEAVHRESKRLPPIQKPKILTPSMLVGEETIMEGLRVXXXXXXXXESGTGLLGGPPLLPAEGAIFLTNYRIIFKGIPCDSFACEQIVVRSFPVTSLTKEKKVAVQYLAHLDQWLQEGLQLRSCTFQLMKFAFDEEVTAENVDTLRKLIHKVRHPPDIFHHFAFTGTVVVTQTPFAXXXXXXXTLKGFAKETLLKTARKGGFKQNLHQTTHD

SEQ ID NO: 29519 - protein, 65 aa, Diabrotica virgifera
  misc_feature: Coding regions on vcDNA: vcDNA=SeqID_9216; Strand=-; Position=3-197
  misc_feature (2)..(8): Xaa can be any naturally occurring amino acid
  misc_feature (22)..(29): Xaa can be any naturally occurring amino acid
  misc_feature (32)..(45): Xaa can be any naturally occurring amino acid
FXXXXXXXLKDRNQPGSHRFKXXXXXXXXVEXXXXXXXXXXXXXXSNIEVAIFIIDLISPIKLRC

SEQ ID NO: 29520 - protein, 89 aa, Diabrotica virgifera
  misc_feature: Coding regions on vcDNA: vcDNA=SeqID_9217; Strand=-; Position=2-268
GVQQSLYWRVLTDNYGRSLSCWISFYNWGSSKDMKFVRLFQLHVIREIASESQKGMYFYLINILYSERNNISLLTKKFYTSKNKIGAGG

SEQ ID NO: 29521 - protein, 257 aa, Diabrotica virgifera
  misc_feature: Coding regions on vcDNA: vcDNA=SeqID_9218; Strand=+; Position=129-902
  misc_feature: Homolog annotation: Hit_ID=EAA08406.2; Match level="QueryCoverage =54%, HitCoverage=33%, E-value=2e-11, Identity=34%"; Hit description =ENSANGP00000014791 [Anopheles gambiae str. PEST] ref|XP_562965.1| ENSANGP00000014791 [Anopheles gambiae st
  misc_feature: Gene Ontology Annotation: Molecular function=glycoprotein 3-alpha-L -fucosyltransferase activity; Cellular component=Golgi trans cisterna; Biological process=protein amino acid glycosylation
  misc_feature (232)..(232): Xaa can be any naturally occurring amino acid
  misc_feature (245)..(245): Xaa can be any naturally occurring amino acid
MKIISYYQKQLYVLCLILAVALFSLCIQMDIVSYNTYYAEYEEYKKNIDDIEIKLVEEWKELRSKQSNLSNLGKILFLGTDEPVVNTTKSYQILVWKYGKMIENRLIKKFSKNWVDPFSNCPVKNCDVTYKDEALSTADLVLFHLHRMKSSKQLPLKRGKSSQIWAFLTEESSYHTFLNRDKGVTIKDYNGVFNWSMSYRMDSDIPVPYGRTILRKTPQPVEIKLEKQRNVXGAIMGSNCGGKNXRWDYVKGVEKHI

SEQ ID NO: 29522 - protein, 105 aa, Diabrotica virgifera
  misc_feature: Coding regions on vcDNA: vcDNA=SeqID_9219; Strand=-; Position=288-605
PLHLVCLCLFILLVLSLLIPLSSTSSSYHYPPIQVLQFFLVFSYFGFINVEAIHLFPIRQIGLLFVPYFCWSLSLSLHSLQHKFFFFLVTLRDPKAYSDVHHFTI

SEQ ID NO: 29523 - protein, 46 aa, Diabrotica virgifera
  misc_feature: Coding regions on vcDNA: vcDNA=SeqID_9220; Strand=-; Position=169-309
YETTKNNIACCILADTYIKFKIQSYLKIINIRYIRTTIKYIILSSY

SEQ ID NO: 29524 - protein, 120 aa, Diabrotica virgifera
  misc_feature: Coding regions on vcDNA: vcDNA=SeqID_9221; Strand=+; Position=223-585
  misc_feature (84)..(91): Xaa can be any naturally occurring amino acid
  misc_feature (103)..(109): Xaa can be any naturally occurring amino acid
EVGKLSFKIVCKFVFIGKRNNIRQYTAQTILVKKKGCNYCVPRTGNCESYNRKKYFILQNVKLHAPRRQRPRQKCAKSRTKSKXXXXXXXXAQIRVCTKFCFXXXXXXXVFMLILIVVFE

SEQ ID NO: 29525 - protein, 251 aa, Diabrotica virgifera
  misc_feature: Coding regions on vcDNA: vcDNA=SeqID_9222; Strand=+; Position=61-816
  misc_feature: Homolog annotation: Hit_ID=EAL39843.1; Match level="QueryCoverage =100%, HitCoverage=100%, E-value=1e-50, Identity=44%"; Hit description=ENSANGP00000025535 [Anopheles gambiae str. PEST] ref|XP _556135.1| ENSANGP00000025535 [Anopheles gambiae
  misc_feature: Pfam annotation: Pfam_ID=adh_short; Match level="Score=92.7, E-value =9.4e-25, Copies=1"; Pfam description=short chain dehydrogenase
  misc_feature (43)..(61): Xaa can be any naturally occurring amino acid
  misc_feature (106)..(111): Xaa can be any naturally occurring amino acid
  misc_feature (245)..(245): Xaa can be any naturally occurring amino acid
MKGMQGKIAIVTGASSGIGAGIVEKLVEEGLTVVGLARRVDMXXXXXXXXXXXXXXXXXXXCDLSLESNILKCFDYVSKNLGPIYVLINNAGCLTKQNLCDGTTEXXXXXXDVNLLGLCIATREAIKSMKENEIDGHIIHINSITGHWNVRIDDINVYPATKYAVTSLAQTLRRELSKSKTKIKVTSLSPGVVNTEIFAVGGLTNYADSLEQEEVPALTPRDIADAVTYILSTPPHVNISELIIXPVNEDL

SEQ ID NO: 29526 - protein, 69 aa, Diabrotica virgifera
  misc_feature: Coding regions on vcDNA: vcDNA=SeqID_9223; Strand=+; Position=501-707
CIRNLCEILFIDTAPGTVALSQVLKRDMTHFPEHERNAANMLAKKKIGLKTNPEYGNTGFGGMVAGTNT

SEQ ID NO: 29527 - protein, 262 aa, Diabrotica virgifera
  misc_feature: Coding regions on vcDNA: vcDNA=SeqID_9224; Strand=+; Position=171-955
  misc_feature: Homolog annotation: Hit_ID=XP_397436.1; Match level="QueryCoverage =99%, HitCoverage=29%, E-value=2e-74, Identity=46%"; Hit description =similar to ENSANGP00000009960 [Apis mellifera]
  misc_feature: Gene Ontology Annotation: Molecular function=RNA binding; Cellular component=nucleus; Biological process=RNA processing
  misc_feature: Pfam annotation: Pfam_ID=DSPc; Match level="Score=-30.6, E-value =0.025, Copies=1"; Pfam description=Dual specificity phosphatase, catalyti
  misc_feature (207)..(207): Xaa can be any naturally occurring amino acid
  misc_feature (213)..(213): Xaa can be any naturally occurring amino acid
  misc_feature (228)..(228): Xaa can be any naturally occurring amino acid
  misc_feature (234)..(234): Xaa can be any naturally occurring amino acid
  misc_feature (245)..(245): Xaa can be any naturally occurring amino acid
MSKPKRNPGPVPPRWLHCPRKSENLIADKFMALKTPLSSDFDDQVPPENRFHPKMVFDIAKSKKIKFGLWIDLTNTSRFYNKADIEEYGCKYVKLQCRGHGETPSPEQTSTFIKIVTQFITYQPLESIAVHCTHGFNRTGFLIVSYLIERMDCDLGRALTLFAESSNDDTSPKAKKGRFKEAVFMEGVPNVTHFVEEKATELQRMVXKMCKWXKKGFPGSQPVSMDMXNITLLXAHPYRVSWKAXRMRYMMLIKREDESYFF

SEQ ID NO: 29528 - protein, 78 aa, Diabrotica virgifera
  misc_feature: Coding regions on vcDNA: vcDNA=SeqID_9225; Strand=-; Position=2-235
  misc_feature (1)..(12): Xaa can be any naturally occurring amino acid
  misc_feature (15)..(25): Xaa can be any naturally occurring amino acid
  misc_feature (35)..(42): Xaa can be any naturally occurring amino acid
  misc_feature (45)..(58): Xaa can be any naturally occurring amino acid
  misc_feature (64)..(77): Xaa can be any naturally occurring amino acid
XXXXXXXXXXXXPFXXXXXXXXXXXTNLAHTGLNXXXXXXXXSNXXXXXXXXXXXXXXPTSRSXXXXXXXXXXXXXXV

SEQ ID NO: 29529 - protein, 73 aa, Diabrotica virgifera
  misc_feature: Coding regions on vcDNA: vcDNA=SeqID_9226; Strand=-; Position=114-335
SRRSSNYYLRFVSNEQYITNHQPILFLFHCLQLLEVLIKLLHPVLMDSAQRIYICIQAQEFRQSRCRTCHGYF

SEQ ID NO: 29530 - protein, 64 aa, Diabrotica virgifera
  misc_feature: Coding regions on vcDNA: vcDNA=SeqID_9227; Strand=+; Position=2-193
  misc_feature (1)..(9): Xaa can be any naturally occurring amino acid
  misc_feature (11)..(60): Xaa can be any naturally occurring amino acid
XXXXXXXXXYXXXXXXXXXXXXXXXXXXXXXXXXXXXXXXXXXXXXXXXXXXXXXXXXXXINYL

SEQ ID NO: 29531 - protein, 104 aa, Diabrotica virgifera
  misc_feature: Coding regions on vcDNA: vcDNA=SeqID_9228; Strand=-; Position=94-408
  misc_feature (33)..(58): Xaa can be any naturally occurring amino acid
  misc_feature (67)..(79): Xaa can be any naturally occurring amino acid
  misc_feature (87)..(104): Xaa can be any naturally occurring amino acid
YAGDKNVADILYLTNLFFLNIQFINTNIIFITXXXXXXXXXXXXXXXXXXXXXXXXXXNIFYHMKFXXXXXXXXXXXXXNLINKLIXXXXXXXXXXXXXXXXXX

SEQ ID NO: 29532 - protein, 24 aa, Diabrotica virgifera
  misc_feature: Coding regions on vcDNA: vcDNA=SeqID_9229; Strand=-; Position=0-71
  misc_feature (7)..(16): Xaa can be any naturally occurring amino acid
FETLLLXXXXXXXXXXNLQIHKQL

SEQ ID NO: 29533 - protein, 24 aa, Diabrotica virgifera
  misc_feature: Coding regions on vcDNA: vcDNA=SeqID_9230; Strand=+; Position=1-75
  misc_feature (12)..(12): Xaa can be any naturally occurring amino acid
  misc_feature (16)..(16): Xaa can be any naturally occurring amino acid
  misc_feature (22)..(22): Xaa can be any naturally occurring amino acid
HNARFDSHVIIXIKLXWKLMRXHS

SEQ ID NO: 29534 - protein, 195 aa, Diabrotica virgifera
  misc_feature: Coding regions on vcDNA: vcDNA=SeqID_9231; Strand=-; Position=181-768
  misc_feature (1)..(13): Xaa can be any naturally occurring amino acid
  misc_feature (19)..(33): Xaa can be any naturally occurring amino acid
  misc_feature (35)..(53): Xaa can be any naturally occurring amino acid
  misc_feature (63)..(92): Xaa can be any naturally occurring amino acid
  misc_feature (95)..(165): Xaa can be any naturally occurring amino acid
XXXXXXXXXXXXXYLVYQXXXXXXXXXXXXXXXRXXXXXXXXXXXXXXXXXXXEMLFVFKYIXXXXXXXXXXXXXXXXXXXXXXXXXXXXXXDEXXXXXXXXXXXXXXXXXXXXXXXXXXXXXXXXXXXXXXXXXXXXXXXXXXXXXXXXXXXXXXXXXXXXXXXLIKEFGNIFFTCLLKTCLFVLNIKSRLPTD

SEQ ID NO: 29535 - protein, 77 aa, Diabrotica virgifera
  misc_feature: Coding regions on vcDNA: vcDNA=SeqID_9232; Strand=+; Position=462-695
FIRGKLCTLKTRSNRLGRSNVRVLIFNQDNAYSPSSSIAITIIIQVGFELVEHPPFSPYLAPIGKRLFLKPANCILK

SEQ ID NO: 29536 - protein, 45 aa, Diabrotica virgifera
  misc_feature: Coding regions on vcDNA: vcDNA=SeqID_9233; Strand=+; Position=110-247
IINKNLQLPQKHTLKILITPYMLLYFKVCHGILKFSITHTSLEQV

SEQ ID NO: 29537 - protein, 26 aa, Diabrotica virgifera
  misc_feature: Coding regions on vcDNA: vcDNA=SeqID_9234; Strand=-; Position=0-77
  misc_feature (2)..(12): Xaa can be any naturally occurring amino acid
  misc_feature (16)..(25): Xaa can be any naturally occurring amino acid
PXXXXXXXXXXXKKLXXXXXXXXXXR

SEQ ID NO: 29538 - protein, 51 aa, Diabrotica virgifera
  misc_feature: Coding regions on vcDNA: vcDNA=SeqID_9235; Strand=-; Position=82-237
  misc_feature (3)..(16): Xaa can be any naturally occurring amino acid
GPXXXXXXXXXXXXXXKTTPGPPPGLTPNQCKILKVETDLNNIAATTNIKL

SEQ ID NO: 29539 - protein, 84 aa, Diabrotica virgifera
  misc_feature: Coding regions on vcDNA: vcDNA=SeqID_9236; Strand=+; Position=3-257
PVGESITQSESNLEKLTMETQGEPVLLDMATSSDTGNRSSTDTVYRSDNEQNIIVDYPSDNMSQTGRSRRVTNMPKKYNDFILE

SEQ ID NO: 29540 - protein, 23 aa, Diabrotica virgifera
  misc_feature: Coding regions on vcDNA: vcDNA=SeqID_9237; Strand=-; Position=1-69
  misc_feature (1)..(22): Xaa can be any naturally occurring amino acid
XXXXXXXXXXXXXXXXXXXXXXL

SEQ ID NO: 29541 - protein, 188 aa, Diabrotica virgifera
  misc_feature: Coding regions on vcDNA: vcDNA=SeqID_9238; Strand=-; Position=194-760
  misc_feature (13)..(22): Xaa can be any naturally occurring amino acid
  misc_feature (30)..(46): Xaa can be any naturally occurring amino acid
  misc_feature (56)..(85): Xaa can be any naturally occurring amino acid
  misc_feature (88)..(103): Xaa can be any naturally occurring amino acid
  misc_feature (107)..(158): Xaa can be any naturally occurring amino acid
KKILFSEPCVSGXXXXXXXXXXLEFKRAKXXXXXXXXXXXXXXXXXEMLFAFKYIXXXXXXXXXXXXXXXXXXXXXXXXXXXXXXDEXXXXXXXXXXXXXXXXIKNXXXXXXXXXXXXXXXXXXXXXXXXXXXXXXXXXXXXXXXXXXXXXXXXXXXXLIKEFGNIFFTCLLKTCLFVLNIKSRLPTD

SEQ ID NO: 29542 - protein, 61 aa, Diabrotica virgifera
  misc_feature: Coding regions on vcDNA: vcDNA=SeqID_9239; Strand=-; Position=2-184
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(61): Xaa can be any naturally occurring amino acid
PFXXXXXXXXXXXTNLAHTGLNXXXXXXXXSNXXXXXXXXXXXXXXPTSRSXXXXXXXXXX

SEQ ID NO: 29543 - protein, 41 aa, Diabrotica virgifera
  misc_feature: Coding regions on vcDNA: vcDNA=SeqID_9240; Strand=-; Position=2-124
  misc_feature (26)..(41): Xaa can be any naturally occurring amino acid
FEYYGSSGVIKQLNNRIFLQLFSLNXXXXXXXXXXXXXXXX

SEQ ID NO: 29544 - protein, 200 aa, Diabrotica virgifera
  misc_feature: Coding regions on vcDNA: vcDNA=SeqID_9241; Strand=+; Position=182-784
  misc_feature: Homolog annotation: Hit_ID=S08404; Match level="QueryCoverage=55%, HitCoverage=42%, E-value=4e-09, Identity=28%"; Hit description =hypothetical protein 1 - silkworm transposon mag
MESGNVYENWQFFIQRFKNYLQATELTKKPEITQCAQLLQLIGDEGFKIYNTFKFSTEEKDKLELAHFKPKSNVSNARYCLFTRKQEEGESVDKFITDIINKAKNCELENLEDSLIKTCITCGVADETMRQRLLEDEMSLEKAINLCKSIESSKIQSEKMKSEEVHYVKKRNFNKKYENREQWEDRRVKSTHSKPDGQFN

SEQ ID NO: 29545 - protein, 44 aa, Diabrotica virgifera
  misc_feature: Coding regions on vcDNA: vcDNA=SeqID_9242; Strand=+; Position=3-137
  misc_feature (2)..(2): Xaa can be any naturally occurring amino acid
  misc_feature (5)..(5): Xaa can be any naturally occurring amino acid
  misc_feature (11)..(11): Xaa can be any naturally occurring amino acid
  misc_feature (13)..(13): Xaa can be any naturally occurring amino acid
  misc_feature (17)..(18): Xaa can be any naturally occurring amino acid
  misc_feature (20)..(33): Xaa can be any naturally occurring amino acid
NXLIXFFLIIXNXFTLXXTXXXXXXXXXXXXXXRPRWWDKVYNW

SEQ ID NO: 29546 - protein, 290 aa, Diabrotica virgifera
  misc_feature: Coding regions on vcDNA: vcDNA=SeqID_9243; Strand=+; Position=24-894
  misc_feature: Homolog annotation: Hit_ID=XP_317154.1; Match level="QueryCoverage =81%, HitCoverage=64%, E-value=2e-87, Identity=66%"; Hit description =ENSANGP00000018258 [Anopheles gambiae]
  misc_feature: Gene Ontology Annotation: Molecular function=Rab GTPase activator activity; Cellular component=endoplasmic reticulum; Biological process=signal transduction
  misc_feature: Pfam annotation: Pfam_ID=TBC; Match level="Score=-55.3, E-value =0.001, Copies=1"; Pfam description=TBC domain
  misc_feature (264)..(264): Xaa can be any naturally occurring amino acid
MEHFEDEISSVDDETTSLFNNESSFEKKSDEYNNHDLDDDMEDTRSELKFDRALETEEETEKRLLIEEALNNEYTTINTWKKFALTEYGLVADDLRCKVWPLLLEVDPTSNEKIPSLEELSSHSEYQQVVLDVNRSLKRFPPGIPYKQRLALQDQLTVLILRVIIKYPHLRYYQGYHDVAITFLLVVGEVVAFRIMENLSTTHLRDCMEPTMEKTSYRLNYIYALLSKVDHDLYNFLDSASVGTMFALPWYLTWFGHSLNQYKXVVRLYDFFLASPQDMSLYVSASLVIH

SEQ ID NO: 29547 - protein, 279 aa, Diabrotica virgifera
  misc_feature: Coding regions on vcDNA: vcDNA=SeqID_9244; Strand=+; Position=81-921
  misc_feature: Homolog annotation: Hit_ID=EAA01689.3; Match level="QueryCoverage =91%, HitCoverage=83%, E-value=2e-46, Identity=37%"; Hit description =ENSANGP00000013952 [Anopheles gambiae str. PEST] ref|XP_551574.1| ENSANGP00000013952 [Anopheles gambiae st
  misc_feature: Pfam annotation: Pfam_ID=zf-HIT; Match level="Score=36.3, E-value=9e -08, Copies=1"; Pfam description=HIT zinc finger
  misc_feature (237)..(237): Xaa can be any naturally occurring amino acid
MSSSKIIELDETNTCKICDNALAKYSCPKCKLLYCSLNCYQANSHLECSESFYKDNVFEELNLDKESPKSKEKMLEILKRFHERNLLPSSDVDESFRGYSGFSIEDILNFDPGESDGGKLDSDDEMLDIGERLQGVNLDDAEKVWDKLTDSEKQDFLAFLKSEDVSNLIPSWQPWWMFYNPTMVEEVEKMDDYKKDCPEICTIEDFTTLTSKAPAECVKFNLINILTAYAFTTRYFXGNIFEFPHQAVSCIVTISVTIKMGQVFEDFQNCCEIWKNRSV

SEQ ID NO: 29548 - protein, 69 aa, Diabrotica virgifera
  misc_feature: Coding regions on vcDNA: vcDNA=SeqID_9245; Strand=-; Position=33-242
  misc_feature (18)..(26): Xaa can be any naturally occurring amino acid
KSSIKVYLSKYKSQLLKXXXXXXXXXFHHLQLSTLDFLSASKDFSARIRASVCILRLPPRHPSCTMESC

SEQ ID NO: 29549 - protein, 17 aa, Diabrotica virgifera
  misc_feature: Coding regions on vcDNA: vcDNA=SeqID_9246; Strand=-; Position=1-51
  misc_feature (3)..(17): Xaa can be any naturally occurring amino acid
EVXXXXXXXXXXXXXXX

SEQ ID NO: 29550 - protein, 28 aa, Diabrotica virgifera
  misc_feature: Coding regions on vcDNA: vcDNA=SeqID_9247; Strand=+; Position=1-84
  misc_feature (3)..(27): Xaa can be any naturally occurring amino acid
KIXXXXXXXXXXXXXXXXXXXXXXXXXP

SEQ ID NO: 29551 - protein, 142 aa, Diabrotica virgifera
  misc_feature: Coding regions on vcDNA: vcDNA=SeqID_9248; Strand=+; Position=47-475
  misc_feature: Homolog annotation: Hit_ID=EAL32818.1; Match level="QueryCoverage =91%, HitCoverage=7%, E-value=1e-22, Identity=46%"; Hit description =GA15316-PA [Drosophila pseudoobscura]
  misc_feature: Gene Ontology Annotation: Molecular function=ATP binding; Biological process=protein biosynthesis
  misc_feature (79)..(79): Xaa can be any naturally occurring amino acid
  misc_feature (87)..(87): Xaa can be any naturally occurring amino acid
  misc_feature (119)..(119): Xaa can be any naturally occurring amino acid
MVIFGCVPGKLKVDEMREMMEKKRTLCNMFVIVNVEYGKFRLKYYIVLKDGIIVVDKVGEKRFIDIRKDEEECCISMKXVIYVCFVXVDDKDFVLIMMVVFFYKYVEGFLVRDIDSPGXVAFQSEVTNDRPYSDGGLEVRDC

SEQ ID NO: 29552 - protein, 79 aa, Diabrotica virgifera
  misc_feature: Coding regions on vcDNA: vcDNA=SeqID_9249; Strand=+; Position=203-439
  misc_feature (6)..(30): Xaa can be any naturally occurring amino acid
  misc_feature (32)..(43): Xaa can be any naturally occurring amino acid
  misc_feature (47)..(54): Xaa can be any naturally occurring amino acid
GNLFLXXXXXXXXXXXXXXXXXXXXXXXXXPXXXXXXXXXXXXLRKXXXXXXXXYRFLSPIITFYSIVFSNIYTLFALY

SEQ ID NO: 29553 - protein, 148 aa, Diabrotica virgifera
  misc_feature: Coding regions on vcDNA: vcDNA=SeqID_9250; Strand=-; Position=65-511
  misc_feature (74)..(80): Xaa can be any naturally occurring amino acid
SMDSQRHCIHSLYQSPTTTIFNHLKDPVANFYYLKRFEVSRSEELKTLLEPSSAKKPEFLLSKTELGSGRSLQXXXXXXXFFHFFKSKMSFSIICEFVMLITSQMVRKLYFTDKFRPIIRFNCFKDPDVLTSKNELPSDGGSVFTKYG

SEQ ID NO: 29554 - protein, 103 aa, Diabrotica virgifera
  misc_feature: Coding regions on vcDNA: vcDNA=SeqID_9251; Strand=-; Position=225-536
  misc_feature (6)..(12): Xaa can be any naturally occurring amino acid
FLTHKXXXXXXXRNRPFSTLNRTSNRKPQCCQGRQIFFKHRLTKSRRAFLQCNSENPFGFQLLIKRARHCSISEDVCACINSSSRERANLKRIPQTGPLLFLN

SEQ ID NO: 29555 - protein, 120 aa, Diabrotica virgifera
  misc_feature: Coding regions on vcDNA: vcDNA=SeqID_9252; Strand=+; Position=3-365
  misc_feature (1)..(84): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXPLGITAKFYWRGQIDNKDWDLDGGIKVIIGGSRLYN

SEQ ID NO: 29556 - protein, 54 aa, Diabrotica virgifera
  misc_feature: Coding regions on vcDNA: vcDNA=SeqID_9253; Strand=-; Position=1-165
  misc_feature (4)..(27): Xaa can be any naturally occurring amino acid
  misc_feature (30)..(53): Xaa can be any naturally occurring amino acid
KNWXXXXXXXXXXXXXXXXXXXXXXXXPNXXXXXXXXXXXXXXXXXXXXXXXXL

SEQ ID NO: 29557 - protein, 215 aa, Diabrotica virgifera
  misc_feature: Coding regions on vcDNA: vcDNA=SeqID_9254; Strand=+; Position=145-790
  misc_feature: Homolog annotation: Hit_ID=XP_311708.1; Match level="QueryCoverage =88%, HitCoverage=46%, E-value=4e-34, Identity=40%"; Hit description =ENSANGP00000013637 [Anopheles gambiae]
  misc_feature: Gene Ontology Annotation: Cellular component=membrane; Biological process=proteolysis and peptidolysis
  misc_feature (146)..(152): Xaa can be any naturally occurring amino acid
  misc_feature (209)..(209): Xaa can be any naturally occurring amino acid
MRKRVDLPNNWNDDSPNYSEKIRNNIHSLPFYFGIVTVIYLLLLTGAVYYIDKNLPTALNVQDEKTHPDSFIAERAINDLEVLTNIGPRVVGSYENEVLATDFLKREIEQIKLNANANQKLELDIQLASGSYYVNLLKTDNINIYXXXXXXXVKIHGVNETDTAVLINSHFDSVPTSPGGSDDGINVVAMLEVLRELSKSPQRPLHNIXFLFNGA

SEQ ID NO: 29558 - protein, 108 aa, Diabrotica virgifera; identical to SEQ ID NO: 27732
  misc_feature: Coding regions on vcDNA: vcDNA=SeqID_9255; Strand=+; Position=188-514
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 29559 - protein, 242 aa, Diabrotica virgifera
  misc_feature: Coding regions on vcDNA: vcDNA=SeqID_9256; Strand=-; Position=0-725
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(235): Xaa can be any naturally occurring amino acid
  misc_feature (237)..(241): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXV

SEQ ID NO: 29560 - protein, 56 aa, Diabrotica virgifera
  misc_feature: Coding regions on vcDNA: vcDNA=SeqID_9257; Strand=-; Position=1-168
  misc_feature (4)..(56): Xaa can be any naturally occurring amino acid
HPTXXXXXXXXXXXXXXXXXXXXXXXXXXXXXXXXXXXXXXXXXXXXXXXXXXXXX

SEQ ID NO: 29561 - protein, 97 aa, Diabrotica virgifera
  misc_feature: Coding regions on vcDNA: vcDNA=SeqID_9258; Strand=-; Position=46-339
  misc_feature (12)..(33): Xaa can be any naturally occurring amino acid
  misc_feature (36)..(47): Xaa can be any naturally occurring amino acid
  misc_feature (59)..(66): Xaa can be any naturally occurring amino acid
  misc_feature (71)..(76): Xaa can be any naturally occurring amino acid
  misc_feature (96)..(96): Xaa can be any naturally occurring amino acid
YKLFVLFLGAAXXXXXXXXXXXXXXXXXXXXXXSFXXXXXXXXXXXXTTTPAPPPVITXXXXXXXXRTDLXXXXXXPFINLIQHRGRNLYYRFELXQ

SEQ ID NO: 29562 - protein, 66 aa, Diabrotica virgifera
  misc_feature: Coding regions on vcDNA: vcDNA=SeqID_9259; Strand=+; Position=41-241
  misc_feature (15)..(29): Xaa can be any naturally occurring amino acid
  misc_feature (34)..(40): Xaa can be any naturally occurring amino acid
  misc_feature (44)..(66): Xaa can be any naturally occurring amino acid
WFYYPGTSIIFKPPXXXXXXXXXXXXXXXKINSXXXXXXXISYXXXXXXXXXXXXXXXXXXXXXXX

SEQ ID NO: 29563 - protein, 172 aa, Diabrotica virgifera
  misc_feature: Coding regions on vcDNA: vcDNA=SeqID_9260; Strand=-; Position=1-516
  misc_feature (3)..(172): Xaa can be any naturally occurring amino acid
NNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29564 - protein, 49 aa, Diabrotica virgifera
  misc_feature: Coding regions on vcDNA: vcDNA=SeqID_9261; Strand=+; Position=11-160
  misc_feature (39)..(47): Xaa can be any naturally occurring amino acid
SHLRFYWFYQILIIFTYVVSTYILQYYLKSKYIFINFSXXXXXXXXXLN

SEQ ID NO: 29565 - protein, 150 aa, Diabrotica virgifera
  misc_feature: Coding regions on vcDNA: vcDNA=SeqID_9262; Strand=+; Position=113-565
  misc_feature (108)..(115): Xaa can be any naturally occurring amino acid
NIQRFVNLFTCREVLHLSNALCRVEIGLFRQPQRCFRVINGFLGCKQISAVARRGCYGLLYLDGLTQVFLCILTRRTRIFWVTVDPDVDKIVINKELEVLHKIDFSQXXXXXXXXWVILSKKCSYKFFRRMHSFRDKRGGTFKKSRNCNF

SEQ ID NO: 29566 - protein, 161 aa, Diabrotica virgifera
  misc_feature: Coding regions on vcDNA: vcDNA=SeqID_9263; Strand=-; Position=404-889
  misc_feature: Homolog annotation: Hit_ID=CAA10770.1; Match level="QueryCoverage =98%, HitCoverage=47%, E-value=4e-24, Identity=33%"; Hit description =reverse transcriptase-like [Bos taurus]
  misc_feature (8)..(8): Xaa can be any naturally occurring amino acid
  misc_feature (32)..(32): Xaa can be any naturally occurring amino acid
VDKYAYLXTMINSTGDYLQEIKIRIEKARANXNKMSKVLCTRDLKLELRVRLARCYVFSTLFYGMEAWTLNAASMKKLESFELWVYRRILKISWTEHVTNKEVLRRMNKEMEILNTIKTRKLEYLGHISRGESYSLLQLIMQGKIQGKRSIGRRRISWLRN

SEQ ID NO: 29567 - protein, 64 aa, Diabrotica virgifera
  misc_feature: Coding regions on vcDNA: vcDNA=SeqID_9264; Strand=-; Position=164-358
  misc_feature (14)..(21): Xaa can be any naturally occurring amino acid
MDDVTSMIEYAKKXXXXXXXXPVSRFFVKSPTYEITNLFPSFAPYLGLFQPDTKPLLNGHEHAQ

SEQ ID NO: 29568 - protein, 44 aa, Diabrotica virgifera
  misc_feature: Coding regions on vcDNA: vcDNA=SeqID_9265; Strand=-; Position=1-132
  misc_feature (9)..(16): Xaa can be any naturally occurring amino acid
  misc_feature (21)..(42): Xaa can be any naturally occurring amino acid
KNSGGFPLXXXXXXXXEKMGXXXXXXXXXXXXXXXXXXXXXXPN

SEQ ID NO: 29569 - protein, 126 aa, Diabrotica virgifera
  misc_feature: Coding regions on vcDNA: vcDNA=SeqID_9266; Strand=-; Position=377-757
PFSYRCNTMPKPSYISVLLVSATSTLTEQFQNSLVFHQRMHMLLSPNHVAVTYVHPLGSCSSVLLWAYSAKNRIAADFTITGHTHTMCICYVIRTGYHPTQPLSRLALAFWKCFTFPTIIWKSGNH

SEQ ID NO: 29570 - protein, 97 aa, Diabrotica virgifera
  misc_feature: Coding regions on vcDNA: vcDNA=SeqID_9267; Strand=+; Position=271-564
  misc_feature (55)..(65): Xaa can be any naturally occurring amino acid
LIKNTFSTGKSVKEWLIICFYLLIGKNQRNDCKFLIMQLLGFSLVWKAFRYRYAXXXXXXXXXXXFIIDLGDCKLVEDPVNLFAWNLIDLNYNNFVP

SEQ ID NO: 29571 - protein, 67 aa, Diabrotica virgifera; identical to SEQ ID NO: 28735
  misc_feature: Coding regions on vcDNA: vcDNA=SeqID_9268; Strand=-; Position=2-202
  misc_feature (4)..(14): Xaa can be any naturally occurring amino acid
  misc_feature (24)..(31): Xaa can be any naturally occurring amino acid
  misc_feature (34)..(47): Xaa can be any naturally occurring amino acid
  misc_feature (53)..(66): Xaa can be any naturally occurring amino acid

SEQ ID NO: 29572 - protein, 38 aa, Diabrotica virgifera
  misc_feature: Coding regions on vcDNA: vcDNA=SeqID_9269; Strand=-; Position=1-114
HHNYLIKYRALTKNRIKERDYDNILITSIIYFISTDAK

SEQ ID NO: 29573 - protein, 83 aa, Diabrotica virgifera
  misc_feature: Coding regions on vcDNA: vcDNA=SeqID_9270; Strand=+; Position=22-273
  misc_feature (35)..(45): Xaa can be any naturally occurring amino acid
  misc_feature (47)..(62): Xaa can be any naturally occurring amino acid
VRAACRRGGIPGGPFLARDEIVFSKSKELYYLVTXXXXXXXXXXXLXXXXXXXXXXXXXXXXINNYIIIIFVFKKAKKIRCLL

SEQ ID NO: 29574 - protein, 61 aa, Diabrotica virgifera
  misc_feature: Coding regions on vcDNA: vcDNA=SeqID_9271; Strand=+; Position=1-186
  misc_feature (1)..(2): Xaa can be any naturally occurring amino acid
  misc_feature (4)..(33): Xaa can be any naturally occurring amino acid
XXLXXXXXXXXXXXXXXXXXXXXXXXXXXXXXXNKLPLGDNSRIFMGEVQSIIRWRPPMVG

SEQ ID NO: 29575 - protein, 244 aa, Diabrotica virgifera
  misc_feature: Coding regions on vcDNA: vcDNA=SeqID_9272; Strand=-; Position=1-732
  misc_feature (3)..(227): Xaa can be any naturally occurring amino acid
  misc_feature (230)..(244): Xaa can be any naturally occurring amino acid
LLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 29576 - protein, 326 aa, Diabrotica virgifera
  misc_feature: Coding regions on vcDNA: vcDNA=SeqID_9273; Strand=+; Position=2-982
  misc_feature: Homolog annotation: Hit_ID=AAH76959.1; Match level="QueryCoverage =68%, HitCoverage=41%, E-value=2e-33, Identity=37%"; Hit description =MGC89384 protein [Xenopus tropicalis] ref|NP_001005064.1| MGC89384 protein [Xenopus tropicalis]
  misc_feature: Gene Ontology Annotation: Molecular function=pre-mRNA splicing factor activity; Cellular component=nucleus; Biological process=mRNA splicing
  misc_feature (39)..(43): Xaa can be any naturally occurring amino acid
  misc_feature (280)..(280): Xaa can be any naturally occurring amino acid
  misc_feature (285)..(285): Xaa can be any naturally occurring amino acid
KSRRMRIEVASNMDNDRRRGRMDMNRDRQPDRSDSFGDXXXXXRASSDSMDNRRTGFNRDRDGGGGGGGFTREGMRDRDDKSFTREGMRDRDYGRDRDNRDFGRDRDSNRDFNRDRDSNRDRKDIDDRPGGWRDGDRQNKDGDRDRDRGFNRDRGNFRDSDRGNRYDDDRRGGGFGGRRFDDRRDDKDRDRRDGFSRRDDRDTESSEPRERPKLMLAPRTKPVEVVPVNTTESVPSASIFGSAKPVDTAQREREIEEKIAREADKPRESSKDRDENRKHXNSERXNVDRIERSRPPPRRIDDSPTRDKDHRDGPKRTMMTENTSLK

SEQ ID NO: 29577 - protein, 235 aa, Diabrotica virgifera
  misc_feature: Coding regions on vcDNA: vcDNA=SeqID_9274; Strand=-; Position=2-705
  misc_feature: Homolog annotation: Hit_ID=XP_533970.1; Match level="QueryCoverage =98%, HitCoverage=44%, E-value=6e-40, Identity=35%"; Hit description =PREDICTED: similar to jerky homolog-like [Canis familiaris]
  misc_feature: Gene Ontology Annotation: Molecular function=molecular_function unknown; Cellular component=cellular_component unknown; Biological process=biological_process unknown
  misc_feature: Pfam annotation: Pfam_ID=CENP-B_N; Match level="Score=41.7, E-value =2.1e-09, Copies=1"; Pfam description=CENP-B N-terminal DNA-binding domain
  misc_feature (136)..(136): Xaa can be any naturally occurring amino acid
HTFPMSAKRKRIVVSMETRLKVLKRIDNGESVAKICAEFNVGKSTVNDWRRDRRSIEEFCSKMESDKNLGSRCTRKKSICEVVDEALWIWFLQERRRGTLIGGPILKEKALAIHQKINNGGEFVACDGWLNRWKKXHGIHFAHVSGEKLSDDSSGATEFKIKFGEMIETEKLSPEPVYNMDETGLNIKMLPETTFLGSHEQSASGFTKNKERTTVAVCSNATGTHKIPLFVIGKS

SEQ ID NO: 29578 - protein, 254 aa, Diabrotica virgifera
  misc_feature: Coding regions on vcDNA: vcDNA=SeqID_9275; Strand=-; Position=2-763
  misc_feature (192)..(202): Xaa can be any naturally occurring amino acid
RVSISKSTFWSLTRKFYMFSIGQLILCRSQSQATRIIEALLLISTSETAGTGSPSLTAAVNSMKNIITEVTPEIEEIVEQSLLNNNDENFHSEIEIEDADENENENTLKKWISSMEKKVVSILEKETGDDINPRYSPTFSKRLVKQLPTIPLWSSICRDQFGYGRVPASSAPVELQFKTLKNQILMNEKRVXXXXXXXXXXXNGKLKIINCADKQKEPSGRREKEQTSQQHESTVPDADTDLSDMDGCCLEDGN

SEQ ID NO: 29579 - protein, 293 aa, Diabrotica virgifera
  misc_feature: Coding regions on vcDNA: vcDNA=SeqID_9276; Strand=+; Position=3-886
  misc_feature: Homolog annotation: Hit_ID=EAL28259.1; Match level="QueryCoverage =99%, HitCoverage=20%, E-value=5e-74, Identity=48%"; Hit description =GA19130-PA [Drosophila pseudoobscura]
  misc_feature: Gene Ontology Annotation: Molecular function=15-hydroxyprostaglandin dehydrogenase (NAD+) activity; Cellular component=cellular_component unknown; Biological process=biological_process unknown
  misc_feature: Pfam annotation: Pfam_ID=MMR_HSR1; Match level="Score=-12.9, E-value =0.0075, Copies=1"; Pfam description=GTPase of unknown function
  misc_feature (256)..(256): Xaa can be any naturally occurring amino acid
  misc_feature (273)..(274): Xaa can be any naturally occurring amino acid
LFFLKTTQDVKRLEGVSRAPVYSHVIATLDGMTTIRASKCEDMVIQEFDGLMDNSSGAWYLYIASCEVFGFYLDCISTVFIAIVTYQFLIFDNPDPSSAGNAGLVLSQCLILTGMLQMGVRQTAEVANNMTSVERVLEYTTLEKETEGKKQLSVNNLIPRYKSLDKDWPQAGEVEFKDVFLRYTLESAPVLKNLNLVFRAGEKIGVVGRTGAGKSSLVSALFRLSPLEGSVKVDGVDTVNIELSKLRSTISIIPQXPVLFSATVRYNLDPFNXXSDEQIWDALEKGRVETFDY

SEQ ID NO: 29580 - protein, 106 aa, Diabrotica virgifera
  misc_feature: Coding regions on vcDNA: vcDNA=SeqID_9277; Strand=-; Position=159-479
  misc_feature (7)..(25): Xaa can be any naturally occurring amino acid
  misc_feature (28)..(34): Xaa can be any naturally occurring amino acid
  misc_feature (40)..(61): Xaa can be any naturally occurring amino acid
  misc_feature (63)..(87): Xaa can be any naturally occurring amino acid
ESWNEGXXXXXXXXXXXXXXXXXXXKKXXXXXXXRRPYRXXXXXXXXXXXXXXXXXXXXXXGXXXXXXXXXXXXXXXXXXXXXXXXXIRINYLRDNSVILLESSNR

SEQ ID NO: 29581 - protein, 164 aa, Diabrotica virgifera
  misc_feature: Coding regions on vcDNA: vcDNA=SeqID_9278; Strand=+; Position=66-560
  misc_feature: Homolog annotation: Hit_ID=XP_312059.1; Match level="QueryCoverage =95%, HitCoverage=62%, E-value=2e-26, Identity=42%"; Hit description =ENSANGP00000023094 [Anopheles gambiae]
  misc_feature: Pfam annotation: Pfam_ID=E1_DerP2_DerF2; Match level="Score=79.7, E -value=7.7e-21, Copies=1"; Pfam description=ML domain
MKYVLIVVLCTVAVAYVAATAVKECPNNKNGLSYPDLADRVSLHNCTKAPCRARKDSFQKVEYKFTPDKDYKNLHTRVTAEILGTALPFPGVDGQSACPNLYEEDKTTKVKDCEVKAGKNYYYKNGFEVLRIYPRIKTNAHWELYEPKTSRNIMCFEFLVRITN

SEQ ID NO: 29582 - protein, 112 aa, Diabrotica virgifera
  misc_feature: Coding regions on vcDNA: vcDNA=SeqID_9279; Strand=+; Position=296-634
  misc_feature (13)..(26): Xaa can be any naturally occurring amino acid
  misc_feature (48)..(57): Xaa can be any naturally occurring amino acid
MCSSARHLSLDIXXXXXXXXXXXXXXIQQFIKIHLSNTSQDHEFSYFXXXXXXXXXXLSFIAYTSFITSSIDTLRIYAMKTVSLSGHRIFRIKYLGHLRCLAYILFTCLLGA

SEQ ID NO: 29583 - protein, 124 aa, Diabrotica virgifera
  misc_feature: Coding regions on vcDNA: vcDNA=SeqID_9280; Strand=-; Position=1-372
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(121): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXPYR

SEQ ID NO: 29584 - protein, 23 aa, Diabrotica virgifera
  misc_feature: Coding regions on vcDNA: vcDNA=SeqID_9281; Strand=+; Position=1-69
  misc_feature (2)..(17): Xaa can be any naturally occurring amino acid
KXXXXXXXXXXXXXXXXLLNKFL

SEQ ID NO: 29585 - protein, 73 aa, Diabrotica virgifera
  misc_feature: Coding regions on vcDNA: vcDNA=SeqID_9282; Strand=+; Position=120-341
  misc_feature (45)..(51): Xaa can be any naturally occurring amino acid
DTKCRATIPLFFFPAYIFVPCGSSGDGATLVSLVFEDATVSPVDXXXXXXXVIVLLVEMHCQHPCASLISGGA

SEQ ID NO: 29586 - protein, 309 aa, Diabrotica virgifera
  misc_feature: Coding regions on vcDNA: vcDNA=SeqID_9283; Strand=+; Position=1-926
  misc_feature: Homolog annotation: Hit_ID=XP_392311.1; Match level="QueryCoverage =99%, HitCoverage=35%, E-value=1e-132, Identity=28%"; Hit description= similar to Short stop/Kakapo long isoform [Apis mellifera]
  misc_feature: Gene Ontology Annotation: Molecular function=structural constituent of cytoskeleton; Cellular component=cytoskeleton; Biological process= microtubule-based process
  misc_feature: Pfam annotation: Pfam_ID=Spectrin; Match level="Score=112.2, E-value =1.3e-30, Copies=3"; Pfam description=Spectrin repeat
  misc_feature (284)..(284): Xaa can be any naturally occurring amino acid
HALNELLVWISKTDATLDELKPVAGDPQVLEIELAKLKVLVNDIQAHQTSVDTLNDAGRQIIESGESDEASVTQEKLNTLNTQWRSLMQKAADRQRELEDALTDAQRFNAEIQDLLSWLGDVDGIITASKPVGGLPETASEQLERFMEIYNEIEDNRPKVETVLAQGQEYLKKATSPASNLQQNLRTLKQRWDNVTARANDKKIKLEIALKEATEFHESLQAFVDWLTNAEKHLQNVKPVSRVLETIQNQIEEHKVFQKDVSAHREIMLALDKKGTHLKYFSQXQDVILIKNLLISVQHRWGESRSQIT

SEQ ID NO: 29587 - protein, 31 aa, Diabrotica virgifera
  misc_feature: Coding regions on vcDNA: vcDNA=SeqID_9284; Strand=+; Position=32-124
  misc_feature (4)..(10): Xaa can be any naturally occurring amino acid
  misc_feature (19)..(26): Xaa can be any naturally occurring amino acid
ILTXXXXXXXFTFVLLFLXXXXXXXXLYFYL

SEQ ID NO: 29588 - protein, 301 aa, Diabrotica virgifera
  misc_feature: Coding regions on vcDNA: vcDNA=SeqID_9285; Strand=-; Position=1-903
  misc_feature (3)..(20): Xaa can be any naturally occurring amino acid
  misc_feature (22)..(45): Xaa can be any naturally occurring amino acid
  misc_feature (48)..(48): Xaa can be any naturally occurring amino acid
  misc_feature (50)..(50): Xaa can be any naturally occurring amino acid
  misc_feature (53)..(294): Xaa can be any naturally occurring amino acid
  misc_feature (296)..(301): Xaa can be any naturally occurring amino acid
KWXXXXXXXXXXXXXXXXXXPXXXXXXXXXXXXXXXXXXXXXXXXSSXKXLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTXXXXXX

SEQ ID NO: 29589 - protein, 158 aa, Diabrotica virgifera
  misc_feature: Coding regions on vcDNA: vcDNA=SeqID_9286; Strand=+; Position=75-548
  misc_feature: Homolog annotation: Hit_ID=AAV68692.1; Match level="QueryCoverage =88%, HitCoverage=31%, E-value=2e-20, Identity=35%"; Hit description =putative IDGF [Diaprepes abbreviatus]
  misc_feature: Gene Ontology Annotation: Cellular component=extracellular
  misc_feature (58)..(58): Xaa can be any naturally occurring amino acid
  misc_feature (73)..(73): Xaa can be any naturally occurring amino acid
  misc_feature (103)..(103): Xaa can be any naturally occurring amino acid
  misc_feature (117)..(117): Xaa can be any naturally occurring amino acid
  misc_feature (138)..(138): Xaa can be any naturally occurring amino acid
LIYFDTCVIQTVYTVVVCYYVKKGNSQQGRLMFQEDYLEPNLLIGAHSIYGYYRRRPXTYKMEIMNEQVGLNXHILRQDTDVKMKFPGINAVLSVTADINVWXEYTAKNIVDMNVLXALDRRITYIFSTRDRNTTYGXDGIDIQWERPRTRPEKIFWT

SEQ ID NO: 29590 - protein, 118 aa, Diabrotica virgifera
  misc_feature: Coding regions on vcDNA: vcDNA=SeqID_9287; Strand=-; Position=1-354
  misc_feature (7)..(40): Xaa can be any naturally occurring amino acid
  misc_feature (42)..(51): Xaa can be any naturally occurring amino acid
  misc_feature (57)..(63): Xaa can be any naturally occurring amino acid
TWVPLSXXXXXXXXXXXXXXXXXXXXXXXXXXXXXXXXXXSXXXXXXXXXXQSNHVXXXXXXXIIFMVLPKHTSNTNRFSPSIIICSSTYLLSVFPTPLLPENKCLGILLPMNLSASP

SEQ ID NO: 29591 - protein, 384 aa, Diabrotica virgifera
  misc_feature: Coding regions on vcDNA: vcDNA=SeqID_9288; Strand=+; Position=1-1155
  misc_feature (5)..(16): Xaa can be any naturally occurring amino acid
  misc_feature (21)..(41): Xaa can be any naturally occurring amino acid
  misc_feature (44)..(249): Xaa can be any naturally occurring amino acid
  misc_feature (251)..(302): Xaa can be any naturally occurring amino acid
  misc_feature (306)..(338): Xaa can be any naturally occurring amino acid
SHTPXXXXXXXXXXXXPTTLXXXXXXXXXXXXXXXXXXXXXYLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXXXXXXXXXXXXXXXXXXXXXXXXXXXXXXXXXXXXXXLFNXXXXXXXXXXXXXXXXXXXXXXXXXXXXXXXXXLRDNRRNFYLEKVKSNKKDWDPQGGIKGYKWGENVILLKRVRFLNF

SEQ ID NO: 29592 - protein, 214 aa, Diabrotica virgifera
  misc_feature: Coding regions on vcDNA: vcDNA=SeqID_9289; Strand=-; Position=0-641
  misc_feature (1)..(211): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFR

SEQ ID NO: 29593 - protein, 257 aa, Diabrotica virgifera
  misc_feature: Coding regions on vcDNA: vcDNA=SeqID_9290; Strand=+; Position=2-772
  misc_feature (1)..(251): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDPYRVL

SEQ ID NO: 29594 - protein, 210 aa, Diabrotica virgifera
  misc_feature: Coding regions on vcDNA: vcDNA=SeqID_9291; Strand=+; Position=2-628
  misc_feature: Homolog annotation: Hit_ID=XP_466849.1; Match level="QueryCoverage =100%, HitCoverage=29%, E-value=1e-98, Identity=90%"; Hit description= putative phenylalanine ammonia-lyase [Oryza sativa (japonica cultivar- group)]
  misc_feature (28)..(28): Xaa can be any naturally occurring amino acid
  misc_feature (181)..(181): Xaa can be any naturally occurring amino acid
YGFKGAEIATASYRSELQFLGNPVTNHXVQSAEQHNQDVNSLGLISSRKTAEAIEILKLMTSTFLIALCQAVDLRHIEENVKSAVKGCVMTVAKKTLSTNSAGGLHVARFCEKDLLQEIEREAVFAYADDPCSANYPLMKKLRNVLVERALANGTAEFNAETSVLAKVAQFEEELRAALPXGLWEAARAAVENGTAAIPNRITECRSYPL

SEQ ID NO: 29595 - protein, 32 aa, Diabrotica virgifera
  misc_feature: Coding regions on vcDNA: vcDNA=SeqID_9292; Strand=-; Position=0-95
  misc_feature (2)..(30): Xaa can be any naturally occurring amino acid
RXXXXXXXXXXXXXXXXXXXXXXXXXXXXXIT

SEQ ID NO: 29596 - protein, 69 aa, Diabrotica virgifera
  misc_feature: Coding regions on vcDNA: vcDNA=SeqID_9293; Strand=-; Position=0-206
SYKSIALSAIIMKVDCFRLCVTVVPLLPPLGRYAHTRTTDKDSWTTVLDIDVTQRRKPSIYLYWRLAFS

SEQ ID NO: 29597 - protein, 100 aa, Diabrotica virgifera
  misc_feature: Coding regions on vcDNA: vcDNA=SeqID_9294; Strand=-; Position=2-301
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(100): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXX

SEQ ID NO: 29598 - protein, 213 aa, Diabrotica virgifera
  misc_feature: Coding regions on vcDNA: vcDNA=SeqID_9295; Strand=+; Position=104-742
  misc_feature (37)..(45): Xaa can be any naturally occurring amino acid
  misc_feature (51)..(58): Xaa can be any naturally occurring amino acid
  misc_feature (61)..(78): Xaa can be any naturally occurring amino acid
  misc_feature (80)..(131): Xaa can be any naturally occurring amino acid
  misc_feature (133)..(186): Xaa can be any naturally occurring amino acid
  misc_feature (193)..(213): Xaa can be any naturally occurring amino acid
ISFSFLKRKNLHFLVPSGIQGSHHSSSLSLHLFRIFXXXXXXXXXSCKINXXXXXXXXRNXXXXXXXXXXXXXXXXXXYXXXXXXXXXXXXXXXXXXXXXXXXXXXXXXXXXXXXXXXXXXXXXXXXXXXXHXXXXXXXXXXXXXXXXXXXXXXXXXXXXXXXXXXXXXXXXXXXXXXXXXXXXXXKNMVFLXXXXXXXXXXXXXXXXXXXXX

SEQ ID NO: 29599 - protein, 107 aa, Diabrotica virgifera
  misc_feature: Coding regions on vcDNA: vcDNA=SeqID_9296; Strand=+; Position=423-746
  misc_feature (34)..(54): Xaa can be any naturally occurring amino acid
FLLKKSNRRRNIMVFRTDSLIKWIAIFLTSLVSXXXXXXXXXXXXXXXXXXXXXIFILIVIISIVHYGLKTNYSSVSSSTHWRLALTYSNLKHLLLNTFCMFVNVYC

SEQ ID NO: 29600 - protein, 66 aa, Diabrotica virgifera
  misc_feature: Coding regions on vcDNA: vcDNA=SeqID_9297; Strand=-; Position=3-200
  misc_feature (6)..(6): Xaa can be any naturally occurring amino acid
  misc_feature (9)..(9): Xaa can be any naturally occurring amino acid
  misc_feature (23)..(31): Xaa can be any naturally occurring amino acid
  misc_feature (33)..(46): Xaa can be any naturally occurring amino acid
  misc_feature (58)..(58): Xaa can be any naturally occurring amino acid
PFRTKXYYXIKDRNHLGSHRFKXXXXXXXXXEXXXXXXXXXXXXXXSNIEVAIFIIDXNSPIKLRC

SEQ ID NO: 29601 - protein, 251 aa, Diabrotica virgifera
  misc_feature: Coding regions on vcDNA: vcDNA=SeqID_9298; Strand=-; Position=1-753
  misc_feature (1)..(234): Xaa can be any naturally occurring amino acid
  misc_feature (237)..(251): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 29602 - protein, 67 aa, Diabrotica virgifera
  misc_feature: Coding regions on vcDNA: vcDNA=SeqID_9299; Strand=-; Position=155-358
LDQFGGDIDNYTVSPYITFIYWALTHKFLLHMSHLVVFKGGPIANSAGGPRQILLRHCRELIFLHEL

SEQ ID NO: 29603 - protein, 146 aa, Diabrotica virgifera
  misc_feature: Coding regions on vcDNA: vcDNA=SeqID_9300; Strand=+; Position=377-814
  misc_feature (52)..(59): Xaa can be any naturally occurring amino acid
AHFMMEEVMRLSIVEYMVYLKGSEHYSEYVVEGEELLNAGHLILAGITDQHXXXXXXXXLCDESSTINHNPHEIKGELMIIKDNALKINAMHCSCTAGNSGRCKHISALLIKCIRADNIESLEEISQTDINSVWSNEHKDTNDNYK

SEQ ID NO: 29604 - protein, 25 aa, Diabrotica virgifera
  misc_feature: Coding regions on vcDNA: vcDNA=SeqID_9301; Strand=-; Position=0-74
  misc_feature (1)..(22): Xaa can be any naturally occurring amino acid
XXXXXXXXXXXXXXXXXXXXXXLLT

SEQ ID NO: 29605 - protein, 239 aa, Diabrotica virgifera
  misc_feature: Coding regions on vcDNA: vcDNA=SeqID_9302; Strand=+; Position=1-717
  misc_feature (1)..(30): Xaa can be any naturally occurring amino acid
  misc_feature (33)..(238): Xaa can be any naturally occurring amino acid
XXXXXXXXXXXXXXXXXXXXXXXXXXXXXXYLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 29606 - protein, 67 aa, Diabrotica virgifera
  misc_feature: Coding regions on vcDNA: vcDNA=SeqID_9303; Strand=+; Position=2-202
  misc_feature (2)..(15): Xaa can be any naturally occurring amino acid
  misc_feature (21)..(33): Xaa can be any naturally occurring amino acid
  misc_feature (37)..(44): Xaa can be any naturally occurring amino acid
  misc_feature (57)..(63): Xaa can be any naturally occurring amino acid
NXXXXXXXXXXXXXXRPRCWXXXXXXXXXXXXXVCSXXXXXXXXSLNGVSQGCFYLXXXXXXXDERN

SEQ ID NO: 29607 - protein, 32 aa, Diabrotica virgifera
  misc_feature: Coding regions on vcDNA: vcDNA=SeqID_9304; Strand=-; Position=3-98
  misc_feature (16)..(22): Xaa can be any naturally occurring amino acid
RCCYYHQPQNNRFHLXXXXXXXTNISIIYLRR

SEQ ID NO: 29608 - protein, 176 aa, Diabrotica virgifera
  misc_feature: Coding regions on vcDNA: vcDNA=SeqID_9305; Strand=+; Position=365-892
  misc_feature: Homolog annotation: Hit_ID=XP_523909.1; Match level="QueryCoverage =97%, HitCoverage=74%, E-value=1e-22, Identity=36%"; Hit description =PREDICTED: similar to Zinc finger protein 35 (Zfp-35) [Pan troglodytes]
  misc_feature: Gene Ontology Annotation: Molecular function=zinc ion binding; Cellular component=nucleus; Biological process=regulation of transcription, DNA-dependent
  misc_feature (41)..(47): Xaa can be any naturally occurring amino acid
  misc_feature (67)..(76): Xaa can be any naturally occurring amino acid
  misc_feature (95)..(104): Xaa can be any naturally occurring amino acid
  misc_feature (123)..(132): Xaa can be any naturally occurring amino acid
  misc_feature (152)..(158): Xaa can be any naturally occurring amino acid
  misc_feature (168)..(168): Xaa can be any naturally occurring amino acid
MEIMEKPIEDSSYEGNDMSLNTEEKTLIKNMEVVTGKRPYXXXXXXXQCKTASDLTRHLRVHTDEKXXXXXXXXXXFSEAGYLKKHLRLHTGEKXXXXXXXXXXFSQAGTLKNHLRVHTGEKXXXXXXXXXXFSEAGNLKVHLRVHTGEKPXXXXXXXKQFITRSDLXIHLRVHTG

SEQ ID NO: 29609 - protein, 249 aa, Diabrotica virgifera
  misc_feature: Coding regions on vcDNA: vcDNA=SeqID_9306; Strand=-; Position=0-746
  misc_feature (6)..(6): Xaa can be any naturally occurring amino acid
  misc_feature (8)..(24): Xaa can be any naturally occurring amino acid
  misc_feature (30)..(232): Xaa can be any naturally occurring amino acid
  misc_feature (235)..(247): Xaa can be any naturally occurring amino acid
SSLKNXSXXXXXXXXXXXXXXXXXIQPSIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRYXXXXXXXXXXXXXSR

SEQ ID NO: 29610 - protein, 287 aa, Diabrotica virgifera
  misc_feature: Coding regions on vcDNA: vcDNA=SeqID_9307; Strand=-; Position=1-861
  misc_feature (2)..(287): Xaa can be any naturally occurring amino acid
PXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29611 - protein, 66 aa, Diabrotica virgifera; identical to SEQ ID NO: 26808
  misc_feature: Coding regions on vcDNA: vcDNA=SeqID_9308; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 29612 - protein, 78 aa, Diabrotica virgifera
  misc_feature: Coding regions on vcDNA: vcDNA=SeqID_9309; Strand=+; Position=230-466
  misc_feature: Pfam annotation: Pfam_ID=Ldl_recept_a; Match level="Score=57.5, E -value=3.7e-14, Copies=1"; Pfam description=Low-density lipoprotein receptor domai
LHVACHTNKTDKCTGDQFRCGDGKCIPRNKVCNRKYDCDDLSDERNCRKCFHLQCLEFLDFLLHFYNICRISFHFVVT

SEQ ID NO: 29613 - protein, 118 aa, Diabrotica virgifera
  misc_feature: Coding regions on vcDNA: vcDNA=SeqID_9310; Strand=+; Position=456-812
  misc_feature (78)..(78): Xaa can be any naturally occurring amino acid
  misc_feature (110)..(110): Xaa can be any naturally occurring amino acid
SSVISDRATHILNTSKLLHISLFNVHTIKIPRERELWLLKKLLIRLKVEAVSMRLLSPGCCHLLWCLGSFSASLFLLXVWLTSCYRFLVIIKKLCVLYIHIESILTVVPXILFIKMFP

SEQ ID NO: 29614 - protein, 41 aa, Diabrotica virgifera
  misc_feature: Coding regions on vcDNA: vcDNA=SeqID_9311; Strand=+; Position=293-418
IYPNSLTDRLHLFVITIAIINNYAIININYAYGRSFPIKYY

SEQ ID NO: 29615 - protein, 53 aa, Diabrotica virgifera
  misc_feature: Coding regions on vcDNA: vcDNA=SeqID_9312; Strand=-; Position=243-404
DYTYSSKSIIGRRAIVIAVESVFSNIPNIYADIRIVILFNVMYDNSYSMTRVR

SEQ ID NO: 29616 - protein, 259 aa, Diabrotica virgifera
  misc_feature: Coding regions on vcDNA: vcDNA=SeqID_9313; Strand=-; Position=2-778
  misc_feature (11)..(11): Xaa can be any naturally occurring amino acid
  misc_feature (13)..(52): Xaa can be any naturally occurring amino acid
  misc_feature (54)..(59): Xaa can be any naturally occurring amino acid
  misc_feature (75)..(89): Xaa can be any naturally occurring amino acid
  misc_feature (97)..(146): Xaa can be any naturally occurring amino acid
  misc_feature (148)..(242): Xaa can be any naturally occurring amino acid
  misc_feature (245)..(259): Xaa can be any naturally occurring amino acid
NLKKLLIFINXYXXXXXXXXXXXXXXXXXXXXXXXXXXXXXXXXXXXXXXXXAXXXXXXPRPSNYQWQARLILIXXXXXXXXXXXXXXXPVLTLYIXXXXXXXXXXXXXXXXXXXXXXXXXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 29617 - protein, 104 aa, Diabrotica virgifera
  misc_feature: Coding regions on vcDNA: vcDNA=SeqID_9314; Strand=-; Position=2-313
LIFSLSVTADKKSEFFICPELYNHIIYITSELRRLLTRYQHTITAPVLPPTHIIYNNNIYFLPSITHIGIFIIFYHSFFLTNNSNLSLSYSLYFLPQQINHQHH

SEQ ID NO: 29618 - protein, 52 aa, Diabrotica virgifera
  misc_feature: Coding regions on vcDNA: vcDNA=SeqID_9315; Strand=+; Position=99-257
YINSEDGEIIFNARKINNIRYADDTVIMASSAEQQFCEKYMSKPTLLSCHAI

SEQ ID NO: 29619 - protein, 66 aa, Diabrotica virgifera; identical to SEQ ID NO: 26808
  misc_feature: Coding regions on vcDNA: vcDNA=SeqID_9316; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 29620 - protein, 276 aa, Diabrotica virgifera
  misc_feature: Coding regions on vcDNA: vcDNA=SeqID_9317; Strand=-; Position=0-827
  misc_feature (8)..(20): Xaa can be any naturally occurring amino acid
  misc_feature (30)..(48): Xaa can be any naturally occurring amino acid
  misc_feature (51)..(69): Xaa can be any naturally occurring amino acid
  misc_feature (71)..(82): Xaa can be any naturally occurring amino acid
  misc_feature (88)..(101): Xaa can be any naturally occurring amino acid
  misc_feature (104)..(130): Xaa can be any naturally occurring amino acid
  misc_feature (135)..(144): Xaa can be any naturally occurring amino acid
  misc_feature (159)..(191): Xaa can be any naturally occurring amino acid
  misc_feature (201)..(219): Xaa can be any naturally occurring amino acid
  misc_feature (224)..(242): Xaa can be any naturally occurring amino acid
  misc_feature (244)..(258): Xaa can be any naturally occurring amino acid
  misc_feature (266)..(272): Xaa can be any naturally occurring amino acid
GGVGGGAXXXXXXXXXXXXXPARAPHRLSXXXXXXXXXXXXXXXXXXXLPXXXXXXXXXXXXXXXXXXXPXXXXXXXXXXXXPPPTNXXXXXXXXXXXXXXSPXXXXXXXXXXXXXXXXXXXXXXXXXXXGGGLXXXXXXXXXXQPPPAGGTHPRGNVXXXXXXXXXXXXXXXXXXXXXXXXXXXXXXXXXTNTTEKREGXXXXXXXXXXXXXXXXXXXGAPPXXXXXXXXXXXXXXXXXXXPXXXXXXXXXXXXXXXGGGSPGGXXXXXXXERAP

SEQ ID NO: 29621 - protein, 263 aa, Diabrotica virgifera
  misc_feature: Coding regions on vcDNA: vcDNA=SeqID_9318; Strand=+; Position=68-855
  misc_feature: Homolog annotation: Hit_ID=NP_796326.1; Match level="QueryCoverage =97%, HitCoverage=49%, E-value=1e-64, Identity=44%"; Hit description =RIKEN cDNA C330018K18 gene [Mus musculus] dbj|BAC33651.1| unnamed protein product [Mus musculus]
  misc_feature: Gene Ontology Annotation: Molecular function=glycerol kinase activity; Cellular component=mitochondrial outer membrane; Biological process=glycerol metabolism
  misc_feature: Pfam annotation: Pfam_ID=FGGY_N; Match level="Score=80.9, E-value =3.4e-21, Copies=1"; Pfam description=FGGY family of carbohydrate kinases,
  misc_feature (244)..(244): Xaa can be any naturally occurring amino acid
MSGDSKGFIAALDIGTTTIKCHIINSSARSIGFASHLVKLHYPHPGWVEIVPDEFFQNIVQVVHQAIKNANVSMHQIKSLGISTQRCSFVTWSKDTGEYFHNFITWMDLRASQLIHKMNSSMFFMSIRWAAFLIYLGTCNKKYGMASKFRVRNNHVTGRLLWVLKNLKPVQQALRNKNLMFGTVDTWLIYKLTGGLSYVTDVTNASSTGFYDPFTLDWGIVAKSLGIPTHFLPKVVANDYDFGXTDESIFGVPIKIKCVMADQ

SEQ ID NO: 29622 - protein, 88 aa, Diabrotica virgifera
  misc_feature: Coding regions on vcDNA: vcDNA=SeqID_9319; Strand=-; Position=9-275
RCQRSHTRTAGSSTAVTRFEALIPARKSTFQVNTCYYGIVLFDKVNNLFWAQWCLFFLGVSAESDCQNQKCNREFHFSNYSYFRLVKS

SEQ ID NO: 29623 - protein, 66 aa, Diabrotica virgifera; identical to SEQ ID NO: 28562
  misc_feature: Coding regions on vcDNA: vcDNA=SeqID_9320; Strand=-; Position=2-199
  misc_feature (2)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 29624 - protein, 197 aa, Diabrotica virgifera
  misc_feature: Coding regions on vcDNA: vcDNA=SeqID_9321; Strand=-; Position=0-590
  misc_feature (3)..(179): Xaa can be any naturally occurring amino acid
  misc_feature (182)..(196): Xaa can be any naturally occurring amino acid
VGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXXG

SEQ ID NO: 29625 - protein, 52 aa, Diabrotica virgifera
  misc_feature: Coding regions on vcDNA: vcDNA=SeqID_9322; Strand=-; Position=4-162
  misc_feature (41)..(47): Xaa can be any naturally occurring amino acid
RSLLSLALLSPVGILIISFYNIPTMQQPDTHKICLLRIKHXXXXXXXATISR

SEQ ID NO: 29626 - protein, 249 aa, Diabrotica virgifera
  misc_feature: Coding regions on vcDNA: vcDNA=SeqID_9323; Strand=+; Position=147-896
  misc_feature: Homolog annotation: Hit_ID=NP_477077.1; Match level="QueryCoverage =98%, HitCoverage=39%, E-value=2e-75, Identity=63%"; Hit description =CG18000-PB, isoform B [Drosophila melanogaster] gb|AAN09557.1| CG18000-PB, isoform B [Drosophila
  misc_feature: Gene Ontology Annotation: Molecular function=protein binding; Cellular component=dynein complex; Biological process=microtubule -based movement
  misc_feature (236)..(236): Xaa can be any naturally occurring amino acid
MADRKAELERKKAKLQALREEKDRRRREKELKEVEEAANRTLLGGGGDRKELDDLLREVGVAPVSEVFSSISSANSLTPEPSRNHTPDTSLQPHILTNNVTAVKKKLPQLTVVPVQTTNIPPKEVVVYTKQTQTTTTGHDVRDAHATDYYGEDEEGSLPPHLGGYGGSKLPPGILPHGLPQVKEVQPAVTALEQEQKKEEVKEIRELSEEEKQMIILSEEFQHFIDRAGRVMERAXMRSVDIYMDYTGS

SEQ ID NO: 29627 - protein, 42 aa, Diabrotica virgifera
  misc_feature: Coding regions on vcDNA: vcDNA=SeqID_9324; Strand=-; Position=1-129
  misc_feature (1)..(29): Xaa can be any naturally occurring amino acid
  misc_feature (31)..(39): Xaa can be any naturally occurring amino acid
XXXXXXXXXXXXXXXXXXXXXXXXXXXXXYXXXXXXXXXAFY

SEQ ID NO: 29628 - protein, 53 aa, Diabrotica virgifera
  misc_feature: Coding regions on vcDNA: vcDNA=SeqID_9325; Strand=+; Position=242-403
  misc_feature: Homolog annotation: Hit_ID=AAR10211.1; Match level="QueryCoverage =86%, HitCoverage=39%, E-value=9e-20, Identity=100%"; Hit description= similar to Drosophila melanogaster elongin-C [Drosophila yakuba] ref|NP_725894.1| CG9291-PA, isoform A [D
HHLAVERSHVLQKVCMYFTYKVRYTNSSTEIPEFPIAPEIALELLMAANFLDC

SEQ ID NO: 29629 - protein, 154 aa, Diabrotica virgifera
  misc_feature: Coding regions on vcDNA: vcDNA=SeqID_9326; Strand=+; Position=452-916
  misc_feature (32)..(41): Xaa can be any naturally occurring amino acid
  misc_feature (141)..(148): Xaa can be any naturally occurring amino acid
  misc_feature (150)..(150): Xaa can be any naturally occurring amino acid
SVILTPHPKRMHFISWYYSSTKPIMVDFFRFXXXXXXXXXXNDGKLDLEIADGTTKDMRIYYAINNTILGKREISQETKIHVFIQSQYQLFYNMQARHELPINKRYESAINAAEIKQLRKIAGQGKERKHQKRAKTGKHRXXXXXXXXEXVLYI

SEQ ID NO: 29630 - protein, 88 aa, Diabrotica virgifera
  misc_feature: Coding regions on vcDNA: vcDNA=SeqID_9327; Strand=-; Position=2-265
  misc_feature (1)..(22): Xaa can be any naturally occurring amino acid
  misc_feature (25)..(35): Xaa can be any naturally occurring amino acid
  misc_feature (45)..(52): Xaa can be any naturally occurring amino acid
  misc_feature (55)..(68): Xaa can be any naturally occurring amino acid
  misc_feature (74)..(87): Xaa can be any naturally occurring amino acid
XXXXXXXXXXXXXXXXXXXXXXPFXXXXXXXXXXXTNLAHTGLNXXXXXXXXSNXXXXXXXXXXXXXXPTSRSXXXXXXXXXXXXXXV

SEQ ID NO: 29631 - protein, 157 aa, Diabrotica virgifera
  misc_feature: Coding regions on vcDNA: vcDNA=SeqID_9328; Strand=+; Position=334-804
  misc_feature: Homolog annotation: Hit_ID=NP_726504.2; Match level="QueryCoverage =98%, HitCoverage=27%, E-value=1e-40, Identity=56%"; Hit description =CG2727-PB, isoform B [Drosophila melanogaster] gb|AAM70803.2| CG2727- PB, isoform B [Drosophila
  misc_feature: Gene Ontology Annotation: Molecular function=receptor activity; Cellular component=plasma membrane; Biological process=rhodopsin biosynthesis
  misc_feature (35)..(41): Xaa can be any naturally occurring amino acid
  misc_feature (133)..(133): Xaa can be any naturally occurring amino acid
  misc_feature (141)..(141): Xaa can be any naturally occurring amino acid
  misc_feature (143)..(143): Xaa can be any naturally occurring amino acid
MGCFSRKQRLGFVVAISLGCVLFGIIIAVFFSSWXXXXXXXQIKLVNGTQTFSWWAKPPVEPKIRLYIYNVTNADEFLNNGSKPIVNELGPYVYRERWERKNISIHDNGTLTFNLQKIYHFDPEASKGSPEDXVGVPNIPXWXSATSQSKHAARFLR

SEQ ID NO: 29632 - protein, 171 aa, Diabrotica virgifera; identical to SEQ ID NO: 27583
  misc_feature: Coding regions on vcDNA: vcDNA=SeqID_9329; Strand=-; Position=4-519
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(166): Xaa can be any naturally occurring amino acid

SEQ ID NO: 29633 - protein, 60 aa, Diabrotica virgifera
  misc_feature: Coding regions on vcDNA: vcDNA=SeqID_9330; Strand=-; Position=422-604
ERCFRYSLKAPHDALKQSNLMLVHFTFPGKLVKLNSTFASSEWRRNCFSQLRIYPVTLDS

SEQ ID NO: 29634 - protein, 142 aa, Diabrotica virgifera
  misc_feature: Coding regions on vcDNA: vcDNA=SeqID_9331; Strand=+; Position=2-427
  misc_feature: Homolog annotation: Hit_ID=AAF87760.1; Match level="QueryCoverage =100%, HitCoverage=32%, E-value=1e-44, Identity=66%"; Hit description= cytochrome oxidase subunit I [Diabrotica virgifera zeae]
  misc_feature (6)..(12): Xaa can be any naturally occurring amino acid
  misc_feature (26)..(26): Xaa can be any naturally occurring amino acid
  misc_feature (34)..(50): Xaa can be any naturally occurring amino acid
  misc_feature (80)..(80): Xaa can be any naturally occurring amino acid
  misc_feature (96)..(103): Xaa can be any naturally occurring amino acid
  misc_feature (124)..(124): Xaa can be any naturally occurring amino acid
YYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFSFQRKRLRPLRITSSIEXLQFNPPAEHRYSELPILS

SEQ ID NO: 29635 - protein, 262 aa, Diabrotica virgifera
  misc_feature: Coding regions on vcDNA: vcDNA=SeqID_9332; Strand=+; Position=84-872
  misc_feature: Homolog annotation: Hit_ID=EAA06088.2; Match level="QueryCoverage =97%, HitCoverage=94%, E-value=3e-95, Identity=65%"; Hit description =ENSANGP00000005619 [Anopheles gambiae str. PEST] ref|XP_559629.1| ENSANGP00000005619 [Anopheles gambiae st
  misc_feature: Gene Ontology Annotation: Molecular function=holocytochrome c synthase activity; Cellular component=mitochondrial intermembrane space; Biological process=cytochrome c-heme linkage
  misc_feature: Pfam annotation: Pfam_ID=Cyto_heme_lyase; Match level="Score=351.3, E- value=1.4e-102, Copies=1"; Pfam description=Cytochrome c/c1 heme lyase
  misc_feature (59)..(68): Xaa can be any naturally occurring amino acid
  misc_feature (244)..(244): Xaa can be any naturally occurring amino acid
  misc_feature (248)..(248): Xaa can be any naturally occurring amino acid
  misc_feature (256)..(256): Xaa can be any naturally occurring amino acid
MGNSVSAAEIAKVTASQLINANDPVEVEKHRQKYQDYTGEIPPECPMHQKVQQKQVESXXXXXXXXXXNPLNMMGPANQKPSPGQPFPLSTDRQVSTIPKAIIKEGEGHFWVYPSPQMFWNAMLRKGWKWRDEDIKQGDMDNIIKIHNANNEQAWQEVLKWEALHANECRDPRLKSFGGKAQDYSPRVRIRHLLGYELPFDRHDWIVDRCGKDVRYVIDYYDGGDCDDKYRFALLDVRPAMDSXDNVXDRMKVCWXAMVLQR

SEQ ID NO: 29636 - protein, 45 aa, Diabrotica virgifera
  misc_feature: Coding regions on vcDNA: vcDNA=SeqID_9333; Strand=-; Position=1-135
  misc_feature (14)..(37): Xaa can be any naturally occurring amino acid
  misc_feature (41)..(45): Xaa can be any naturally occurring amino acid
IYYMKKVDFFFIPXXXXXXXXXXXXXXXXXXXXXXXXLSSXXXXX

SEQ ID NO: 29637 - protein, 138 aa, Diabrotica virgifera
  misc_feature: Coding regions on vcDNA: vcDNA=SeqID_9334; Strand=+; Position=2-418
ETQNRGRQTERKFPFSREIFNINGDNGKMLTPNGKSHSVSVQIVENHLKKKIKITSKNQSQHSSQNLRKQEGSFFSSKVGIFKVSSTEKAYSTVGNAKASRLLRLCSLARFGSAKWPIELNRYLNSNSKDVKILMIHR

SEQ ID NO: 29638 - protein, 49 aa, Diabrotica virgifera
  misc_feature: Coding regions on vcDNA: vcDNA=SeqID_9335; Strand=-; Position=252-401
  misc_feature (2)..(9): Xaa can be any naturally occurring amino acid
KXXXXXXXXRSITRCCYLLLVAVLIKFDRSKQRQLINNNKCIALFYNFF

SEQ ID NO: 29639 - protein, 303 aa, Diabrotica virgifera
  misc_feature: Coding regions on vcDNA: vcDNA=SeqID_9336; Strand=+; Position=27-938
  misc_feature: Homolog annotation: Hit_ID=XP_392081.1; Match level="QueryCoverage =81%, HitCoverage=21%, E-value=4e-64, Identity=49%"; Hit description =similar to ENSANGP00000021966 [Apis mellifera]
  misc_feature: Pfam annotation: Pfam_ID=WD40; Match level="Score=34.9, E-value=2.4e -07, Copies=5"; Pfam description=WD domain, G-beta repeat
LFLVSHSLHGTFVSEKINKIRWRPDEFNNCHFFVTGSVDNVQNNIKLWDFCENIEEDDVYPFLVFNEPYCGDVTEIEFLNADYFVTSSSSGSAHLKKIIPSYTESTTLKNEVSWSKIHEFKNGDESPCTSLTTYENDIVTVGEDGTINLLNAKSPKVVRKIDNADSCSIHCVIFLKHNEVLTSNLRGQMKIWDLRSTDGKPNSTFMISGEQVTPTCLTFHPTQRHLVITGDDLGSLTTWDLRHNTYPVNVLNAHEGAVSEIKFNPECPDQLFTLLSSGEIWHWTTPSTAPSVDTTEANVWLAP

SEQ ID NO: 29640 - protein, 40 aa, Diabrotica virgifera
  misc_feature: Coding regions on vcDNA: vcDNA=SeqID_9337; Strand=-; Position=1-120
  misc_feature (21)..(37): Xaa can be any naturally occurring amino acid
FFITQKNMWFEKNYLINTNNXXXXXXXXXXXXXXXXXILF

SEQ ID NO: 29641 - protein, 35 aa, Diabrotica virgifera
  misc_feature: Coding regions on vcDNA: vcDNA=SeqID_9338; Strand=-; Position=1-105
  misc_feature (1)..(25): Xaa can be any naturally occurring amino acid
  misc_feature (28)..(34): Xaa can be any naturally occurring amino acid
XXXXXXXXXXXXXXXXXXXXXXXXXLSXXXXXXXL

SEQ ID NO: 29642 - protein, 118 aa, Diabrotica virgifera
  misc_feature: Coding regions on vcDNA: vcDNA=SeqID_9339; Strand=-; Position=270-626
  misc_feature (12)..(17): Xaa can be any naturally occurring amino acid
  misc_feature (40)..(47): Xaa can be any naturally occurring amino acid
  misc_feature (52)..(89): Xaa can be any naturally occurring amino acid
KSLGINKRFLLXXXXXXKKNISIIDTFNANYPFRGDQSRXXXXXXXXFCTKXXXXXXXXXXXXXXXXXXXXXXXXXXXXXXXXXXXXXXFRRCSVYRSDYLNPKNNVLLFVVLYKSAT

SEQ ID NO: 29643 - protein, 99 aa, Diabrotica virgifera
  misc_feature: Coding regions on vcDNA: vcDNA=SeqID_9340; Strand=+; Position=247-546
  misc_feature (5)..(13): Xaa can be any naturally occurring amino acid
AKDWXXXXXXXXXLCQYKIKRVPLVKVMCMSIVTVSSCITVYGHVCMCTIYGCPPYNPQGEKTGKERAHKCYKHIKAYFIARMYQPTDKVLSKSRLSDD

SEQ ID NO: 29644 - protein, 294 aa, Diabrotica virgifera
  misc_feature: Coding regions on vcDNA: vcDNA=SeqID_9341; Strand=+; Position=13-894
  misc_feature: Homolog annotation: Hit_ID=AAN76688.1; Match level="QueryCoverage =96%, HitCoverage=55%, E-value=1e-110, Identity=66%"; Hit description= catalase [Apis mellifera ligustica]
  misc_feature: Gene Ontology Annotation: Molecular function=catalase activity; Cellular component=cytoplasm; Biological process=response to hydrogen peroxide
  misc_feature: Pfam annotation: Pfam_ID=Catalase; Match level="Score=427.8, E-value =1.3e-125, Copies=1"; Pfam description=Catalase
MSHRDPSANQLLEYARKQGSKTERLTTSGGNPVAEKDASLTVGYHGPTLLQDWVLIDELSHFSRERIPERVVHAKGAGAFGYFEVTHDITKYTAAKVFSEIGKKTPIAVRFSQVAGEMGYADTVRDFRGFAVKFYTEDGIWDLVGNNFPVFFVKDAALFPSFIHVLKRNPVTHIRPDYDMFWDFITLREESMHAVLMMFADRGIPDGYRHMHGYGANTFAFVNAHGKLVYCKFHYLSNQGISNLMSDQAEKLAGSDPEYLIRDLYNAIDSGQYPSWNMYVQIMTPEQAAKSSYD

SEQ ID NO: 29645 - protein, 238 aa, Diabrotica virgifera
  misc_feature: Coding regions on vcDNA: vcDNA=SeqID_9342; Strand=+; Position=141-854
  misc_feature: Homolog annotation: Hit_ID=XP_394447.1; Match level="QueryCoverage =86%, HitCoverage=24%, E-value=2e-80, Identity=67%"; Hit description =similar to Gli-Kruppel zinc-finger protein NKL isoform a [Apis mellifera]
  misc_feature: Gene Ontology Annotation: Molecular function=protein binding; Cellular component=transcriptional repressor complex; Biological process=limb morphogenesis
  misc_feature: Pfam annotation: Pfam_ID=zf-C2H2; Match level="Score=122.5, E-value =1e-33, Copies=5"; Pfam description=Zinc finger, C2H2 type
  misc_feature (220)..(220): Xaa can be any naturally occurring amino acid
MRRFRTYTTMSELSDETLPPASPASTQSDSENSVSSVEIPHKELRLSSHIIKSSQLSTDVQCQWRSCGIMFSSLDQLASHVSKVHSASGLGGLFYCGWEGCVRNNKGFNARYKMLVHVRTHTNEKPHKCFQCDKSFSRAENLKIHSRSHSGEKPYVCPVTGCNKAYSNSSDRFKHTRTHQVDKPYQCKIPGCPKRYTDPSSLRKHVKTYKHFVNENQKTXSKKTVEQIVMKIRVELEP

SEQ ID NO: 29646 - protein, 154 aa, Diabrotica virgifera
  misc_feature: Coding regions on vcDNA: vcDNA=SeqID_9343; Strand=+; Position=479-943
FYSQINGALKFLIKLLGLLWKRIEVELSNLTLINLIAGVLESKMIIDDEISIPGTPPELVEAVNTASLELLPKKSREKYENAYRCFMDYRMSKNTSSFSENVVMAYFLDLCLKMKSSTLWANYSMLKSTLVLKHNVDISTYSNLLLYGRESSRL

SEQ ID NO: 29647 - protein, 293 aa, Diabrotica virgifera
  misc_feature: Coding regions on vcDNA: vcDNA=SeqID_9344; Strand=-; Position=1-879
  misc_feature (2)..(270): Xaa can be any naturally occurring amino acid
  misc_feature (273)..(293): Xaa can be any naturally occurring amino acid
KXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXXXXXXXX

SEQ ID NO: 29648 - protein, 189 aa, Diabrotica virgifera
  misc_feature: Coding regions on vcDNA: vcDNA=SeqID_9345; Strand=-; Position=640-1209
  misc_feature (1)..(24): Xaa can be any naturally occurring amino acid
  misc_feature (30)..(36): Xaa can be any naturally occurring amino acid
  misc_feature (47)..(62): Xaa can be any naturally occurring amino acid
  misc_feature (114)..(132): Xaa can be any naturally occurring amino acid
  misc_feature (134)..(167): Xaa can be any naturally occurring amino acid
  misc_feature (177)..(184): Xaa can be any naturally occurring amino acid
XXXXXXXXXXXXXXXXXXXXXXXXYYGAVXXXXXXXSPLLAGGPLGXXXXXXXXXXXXXXXXGEKGGGVPGGVKVGDPPVFPPPVFKNRPPNKILGPIKKDFVGPAGVVNFVLXXXXXXXXXXXXXXXXXXXSXXXXXXXXXXXXXXXXXXXXXXXXXXXXXXXXXXQINVQILRLXXXXXXXXKRIII

SEQ ID NO: 29649 - protein, 94 aa, Diabrotica virgifera
  misc_feature: Coding regions on vcDNA: vcDNA=SeqID_9346; Strand=+; Position=3-284
  misc_feature (1)..(13): Xaa can be any naturally occurring amino acid
  misc_feature (66)..(90): Xaa can be any naturally occurring amino acid
XXXXXXXXXXXXXTLRITADFYLERSNRIIRWRPPGWGKGLNWGGSYFYYNRVPLFKFFLDCGLNXXXXXXXXXXXXXXXXXXXXXXXXXGAPR

SEQ ID NO: 29650 - protein, 173 aa, Diabrotica virgifera
  misc_feature: Coding regions on vcDNA: vcDNA=SeqID_9347; Strand=-; Position=2-520
  misc_feature (4)..(21): Xaa can be any naturally occurring amino acid
  misc_feature (36)..(43): Xaa can be any naturally occurring amino acid
  misc_feature (89)..(172): Xaa can be any naturally occurring amino acid
APFXXXXXXXXXXXXXXXXXXPTLGAPPRGLKPQNXXXXXXXXEPNLIKISCSPNYKLLIQPWRVAIFIIDLNSCNKKYAGIPKGNLFXXXXXXXXXXXXXXXXXXXXXXXXXXXXXXXXXXXXXXXXXXXXXXXXXXXXXXXXXXXXXXXXXXXXXXXXXXXXXXXXXXXXL

SEQ ID NO: 29651 - protein, 108 aa, Diabrotica virgifera
  misc_feature: Coding regions on vcDNA: vcDNA=SeqID_9348; Strand=+; Position=401-724
  misc_feature (13)..(13): Xaa can be any naturally occurring amino acid
  misc_feature (16)..(22): Xaa can be any naturally occurring amino acid
  misc_feature (31)..(48): Xaa can be any naturally occurring amino acid
  misc_feature (52)..(65): Xaa can be any naturally occurring amino acid
  misc_feature (76)..(76): Xaa can be any naturally occurring amino acid
  misc_feature (86)..(95): Xaa can be any naturally occurring amino acid
  misc_feature (99)..(99): Xaa can be any naturally occurring amino acid
MQRSYSLILLRFXVCXXXXXXXGKLYKYGIXXXXXXXXXXXXXXXXXXVFSXXXXXXXXXXXXXXLVPVLLLIIGXGYQPERLEAXXXXXXXXXXISLXLSLNNISFF

SEQ ID NO: 29652 - protein, 278 aa, Diabrotica virgifera
  misc_feature: Coding regions on vcDNA: vcDNA=SeqID_9349; Strand=-; Position=2-835
  misc_feature (1)..(16): Xaa can be any naturally occurring amino acid
  misc_feature (19)..(261): Xaa can be any naturally occurring amino acid
  misc_feature (264)..(278): Xaa can be any naturally occurring amino acid
XXXXXXXXXXXXXXXXLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 29653 - protein, 74 aa, Diabrotica virgifera
  misc_feature: Coding regions on vcDNA: vcDNA=SeqID_9350; Strand=-; Position=1-222
  misc_feature (40)..(74): Xaa can be any naturally occurring amino acid
FRALMGLWGGGRGCCLPPFFIVPVSFLFPGIRNYEIFLDXXXXXXXXXXXXXXXXXXXXXXXXXXXXXXXXXXX

SEQ ID NO: 29654 - protein, 40 aa, Diabrotica virgifera
  misc_feature: Coding regions on vcDNA: vcDNA=SeqID_9351; Strand=-; Position=2-121
  misc_feature (5)..(16): Xaa can be any naturally occurring amino acid
  misc_feature (23)..(32): Xaa can be any naturally occurring amino acid
STRLXXXXXXXXXXXXSNIEVAXXXXXXXXXXKFTLLSPK

SEQ ID NO: 29655 - protein, 57 aa, Diabrotica virgifera
  misc_feature: Coding regions on vcDNA: vcDNA=SeqID_9352; Strand=-; Position=104-277
ILKIDYCLNLNIMIIKYISLYRQKFSSSRKYEHIWTKMISYDIYGTTRKLKHILLRN

SEQ ID NO: 29656 - protein, 58 aa, Diabrotica virgifera
  misc_feature: Coding regions on vcDNA: vcDNA=SeqID_9353; Strand=+; Position=2-178
  misc_feature (1)..(28): Xaa can be any naturally occurring amino acid
XXXXXXXXXXXXXXXXXXXXXXXXXXXXITLRNNRRFLFGKVQSIIRISDLEVGIKVF

SEQ ID NO: 29657 - protein, 49 aa, Diabrotica virgifera
  misc_feature: Coding regions on vcDNA: vcDNA=SeqID_9354; Strand=+; Position=1-150
  misc_feature (8)..(8): Xaa can be any naturally occurring amino acid
  misc_feature (10)..(23): Xaa can be any naturally occurring amino acid
YRINYLRXYXXXXXXXXXXXXXXATSMLGLKFIIWCSSLFILVLFDFKN

SEQ ID NO: 29658 - protein, 37 aa, Diabrotica virgifera
  misc_feature: Coding regions on vcDNA: vcDNA=SeqID_9355; Strand=-; Position=1-111
  misc_feature (2)..(36): Xaa can be any naturally occurring amino acid
TXXXXXXXXXXXXXXXXXXXXXXXXXXXXXXXXXXXF

SEQ ID NO: 29659 - protein, 271 aa, Diabrotica virgifera
  misc_feature: Coding regions on vcDNA: vcDNA=SeqID_9356; Strand=+; Position=1-846
  misc_feature: Homolog annotation: Hit_ID=XP_392960.1; Match level="QueryCoverage =100%, HitCoverage=76%, E-value=3e-74, Identity=40%"; Hit description= similar to alpha 1 type IX collagen isoform 1 precursor; collagen IX, alpha-1 polypeptide;
  misc_feature: Gene Ontology Annotation: Molecular function=extracellular matrix structural constituent; Cellular component=collagen type IX; Biological process=biological_process unknown
  misc_feature: Pfam annotation: Pfam_ID=Collagen; Match level="Score=141.8, E-value =1.6e-39, Copies=3"; Pfam description=Collagen triple helix repeat (20 copi
  misc_feature (202)..(202): Xaa can be any naturally occurring amino acid
  misc_feature (214)..(214): Xaa can be any naturally occurring amino acid
  misc_feature (231)..(231): Xaa can be any naturally occurring amino acid
  misc_feature (266)..(266): Xaa can be any naturally occurring amino acid
GNQGEPGPPGTGGSAAGVGEKGAPGPPGEPGINGEDGEKGERGFPGLPGPPGLMGPPGLQGSEGLPGKHGEQGPPGQRGEQGPTGTTGPAGSPGDKGDKGEIGTQGPIGPRGYPGNPGAAGFPGVSGPIGAPGLVGQTGPPGLPGPPGPPGEAVVGNIIDTGKSPGIHGPRGFPGPPGIPGERGAAGERGPAGPSGVPGLTXKEGPTGLPGPPXQSGQPGLPGIQGQPGRXFTEAEVRDICAAVLRRSLAELTATLVGPPGHQVNXRPGRP

SEQ ID NO: 29660 - protein, 105 aa, Diabrotica virgifera
  misc_feature: Coding regions on vcDNA: vcDNA=SeqID_9357; Strand=-; Position=1-315
  misc_feature (10)..(105): Xaa can be any naturally occurring amino acid
KFPRCFSPKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29661 - protein, 67 aa, Diabrotica virgifera
  misc_feature: Coding regions on vcDNA: vcDNA=SeqID_9358; Strand=+; Position=2-205
  misc_feature: Homolog annotation: Hit_ID=AAO16783.1; Match level="QueryCoverage =86%, HitCoverage=53%, E-value=5e-13, Identity=51%"; Hit description =CSP precursor [Locusta migratoria]
  misc_feature: Gene Ontology Annotation: Molecular function=structural molecule activity; Cellular component=extracellular; Biological process=post -mating behavior
  misc_feature: Pfam annotation: Pfam_ID=OS-D; Match level="Score=30.2, E-value=1.3e -09, Copies=1"; Pfam description=Insect pheromone-binding family, A10/O
LKKTLPDALASGCTKCNIKQKDTAEKVMKHLMSRRPKDWDRLTKKYDPQGNFKKRYEEHLQKEKKAA

SEQ ID NO: 29662 - protein, 66 aa, Diabrotica virgifera; identical to SEQ ID NO: 26808
  misc_feature: Coding regions on vcDNA: vcDNA=SeqID_9359; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 29663 - protein, 64 aa, Diabrotica virgifera
  misc_feature: Coding regions on vcDNA: vcDNA=SeqID_9360; Strand=-; Position=38-232
  misc_feature (2)..(8): Xaa can be any naturally occurring amino acid
  misc_feature (12)..(21): Xaa can be any naturally occurring amino acid
  misc_feature (24)..(30): Xaa can be any naturally occurring amino acid
  misc_feature (54)..(60): Xaa can be any naturally occurring amino acid
PXXXXXXXLKPXXXXXXXXXXGTXXXXXXXGSPQLKNFNPNHGGSPFLFIGFEXXXXXXXPVIP

SEQ ID NO: 29664 - protein, 319 aa, Diabrotica virgifera
  misc_feature: Coding regions on vcDNA: vcDNA=SeqID_9361; Strand=+; Position=1-957
  misc_feature (236)..(243): Xaa can be any naturally occurring amino acid
PTRTNIYTLPSPDRDTDCSPVASTSHGPAGKSFSNELANFAKSLVSVESNTQTKSDECPCSSKGKVDNSTKKPNSPHRLGLSVSLSSPNLLNTAVSSLMLSSSSSESDLSEPEALIEELEHREVISNDENDVDIETMSGENDVEYAEFSMAQRMLEHDNSSANSSFVGATALSPTEMGSSFEDRLKLLNFFENSPRNTAQDPANNLLDLTASNLDLALLGSLSTDNSIISAGNFTXXXXXXXXHRFRQLDMSGAEPRLIQFGVWTENGPISQITKNQLWGPLESFLRSIKCYPEHDQTRRKGSTMKEKKKHSTSHPKFP

SEQ ID NO: 29665 - protein, 23 aa, Diabrotica virgifera
  misc_feature: Coding regions on vcDNA: vcDNA=SeqID_9362; Strand=-; Position=1-69
  misc_feature (1)..(22): Xaa can be any naturally occurring amino acid
XXXXXXXXXXXXXXXXXXXXXXF

SEQ ID NO: 29666 - protein, 69 aa, Diabrotica virgifera
  misc_feature: Coding regions on vcDNA: vcDNA=SeqID_9363; Strand=-; Position=161-370
  misc_feature (6)..(30): Xaa can be any naturally occurring amino acid
  misc_feature (36)..(42): Xaa can be any naturally occurring amino acid
APPFWXXXXXXXXXXXXXXXXXXXXXXXXXLNSQSXXXXXXXEQTLKKKGFPPIKNLYPTLEVPHLIFD

SEQ ID NO: 29667 - protein, 33 aa, Diabrotica virgifera
  misc_feature: Coding regions on vcDNA: vcDNA=SeqID_9364; Strand=-; Position=1-99
  misc_feature (1)..(33): Xaa can be any naturally occurring amino acid
XXXXXXXXXXXXXXXXXXXXXXXXXXXXXXXXX

SEQ ID NO: 29668 - protein, 263 aa, Diabrotica virgifera
  misc_feature: Coding regions on vcDNA: vcDNA=SeqID_9365; Strand=+; Position=33-824
  misc_feature: Homolog annotation: Hit_ID=NP_727758.1; Match level="QueryCoverage =98%, HitCoverage=94%, E-value=6e-26, Identity=37%"; Hit description =CG32603-PA [Drosophila melanogaster] gb|AAN09580.1| CG32603-PA [Drosophila melanogaster]
  misc_feature: Gene Ontology Annotation: Molecular function=calcium ion binding; Cellular component=plasma membrane; Biological process=invasive growth
  misc_feature: Pfam annotation: Pfam_ID=Extensin_2; Match level="Score=-139.2, E -value=0.063, Copies=1"; Pfam description=Extensin-like region
MSFKVLSFAALVAFANAGLLSEAPVSGPVISAYSSSPVLAAPNVINSVAPVVSAYSSPLALPATAPVIPSYSAPVLANAVAPVAYSAPVTYSSPAPVVSAYSSPLVAKSLTPVSYASSAPVASPVAYSAPAPVVSAYSSPLVAKSLTPVSYASNAPVVSPVGYSAPVPVVSAYSSPLVAKSLTPVSYASNAPVVSPVAYSAPAPVVSAYSSPLVAKSLTPVSYASTAPVVSAYSAPVVAQGVSPLAYSAPAPVVSTYSAPSCE

SEQ ID NO: 29669 - protein, 43 aa, Diabrotica virgifera
  misc_feature: Coding regions on vcDNA: vcDNA=SeqID_9366; Strand=-; Position=1-129
  misc_feature (1)..(31): Xaa can be any naturally occurring amino acid
  misc_feature (35)..(42): Xaa can be any naturally occurring amino acid
XXXXXXXXXXXXXXXXXXXXXXXXXXXXXXXLHSXXXXXXXXL

SEQ ID NO: 29670 - protein, 84 aa, Diabrotica virgifera
  misc_feature: Coding regions on vcDNA: vcDNA=SeqID_9367; Strand=+; Position=4-258
  misc_feature (2)..(14): Xaa can be any naturally occurring amino acid
  misc_feature (21)..(33): Xaa can be any naturally occurring amino acid
  misc_feature (36)..(43): Xaa can be any naturally occurring amino acid
  misc_feature (68)..(75): Xaa can be any naturally occurring amino acid
QXXXXXXXXXXXXXATSMLDXXXXXXXXXXXXXCSXXXXXXXXILNRCEPGWFLSLIYSHIASTKCLXXXXXXXXLHKYSKLLL

SEQ ID NO: 29671 - protein, 38 aa, Diabrotica virgifera
  misc_feature: Coding regions on vcDNA: vcDNA=SeqID_9368; Strand=-; Position=19-132
  misc_feature (18)..(18): Xaa can be any naturally occurring amino acid
  misc_feature (25)..(34): Xaa can be any naturally occurring amino acid
VRGTLPRYRYDKLIYLAXKGYLPIXXXXXXXXXXLSII

SEQ ID NO: 29672 - protein, 105 aa, Diabrotica virgifera
  misc_feature: Coding regions on vcDNA: vcDNA=SeqID_9369; Strand=+; Position=627-941
  misc_feature (1)..(1): Xaa can be any naturally occurring amino acid
  misc_feature (8)..(8): Xaa can be any naturally occurring amino acid
  misc_feature (19)..(19): Xaa can be any naturally occurring amino acid
  misc_feature (51)..(51): Xaa can be any naturally occurring amino acid
XLVFVPFXNGLFFYVIASXKFSSIISSSLYFCLPVYMRNQTKYMFLAIWKXTNPHVMSYPLDYLGEAPLTYCSYRQVKLGSMVLGTSFLGDIPAPFRPAHWAYGG

SEQ ID NO: 29673 - protein, 127 aa, Diabrotica virgifera
  misc_feature: Coding regions on vcDNA: vcDNA=SeqID_9370; Strand=-; Position=1-381
  misc_feature (2)..(74): Xaa can be any naturally occurring amino acid
  misc_feature (78)..(90): Xaa can be any naturally occurring amino acid
  misc_feature (93)..(125): Xaa can be any naturally occurring amino acid
GXXXXXXXXXXXXXXXXXXXXXXXXXXXXXXXXXXXXXXXXXXXXXXXXXXXXXXXXXXXXXXXXXXXXXXXXXFNRXXXXXXXXXXXXXFLXXXXXXXXXXXXXXXXXXXXXXXXXXXXXXXXXLC

SEQ ID NO: 29674 - protein, 92 aa, Diabrotica virgifera
  misc_feature: Coding regions on vcDNA: vcDNA=SeqID_9371; Strand=-; Position=287-565
  misc_feature (8)..(29): Xaa can be any naturally occurring amino acid
  misc_feature (34)..(53): Xaa can be any naturally occurring amino acid
  misc_feature (56)..(62): Xaa can be any naturally occurring amino acid
GWGLPSPXXXXXXXXXXXXXXXXXXXXXXWPKPXXXXXXXXXXXXXXXXXXXXRYXXXXXXXNYSPGCIVTPVRQIAPTRPFCTNPLKNKSL

SEQ ID NO: 29675 - protein, 101 aa, Diabrotica virgifera
  misc_feature: Coding regions on vcDNA: vcDNA=SeqID_9372; Strand=-; Position=159-464
  misc_feature (2)..(20): Xaa can be any naturally occurring amino acid
  misc_feature (23)..(29): Xaa can be any naturally occurring amino acid
  misc_feature (35)..(56): Xaa can be any naturally occurring amino acid
  misc_feature (58)..(82): Xaa can be any naturally occurring amino acid
RXXXXXXXXXXXXXXXXXXXKKXXXXXXXRRPYRXXXXXXXXXXXXXXXXXXXXXXGXXXXXXXXXXXXXXXXXXXXXXXXXIRINYLRDNSVILLESSNR

SEQ ID NO: 29676 - protein, 51 aa, Diabrotica virgifera
  misc_feature: Coding regions on vcDNA: vcDNA=SeqID_9373; Strand=-; Position=2-154
  misc_feature (3)..(27): Xaa can be any naturally occurring amino acid
  misc_feature (31)..(51): Xaa can be any naturally occurring amino acid
KNXXXXXXXXXXXXXXXXXXXXXXXXXKIIXXXXXXXXXXXXXXXXXXXXX

SEQ ID NO: 29677 - protein, 351 aa, Diabrotica virgifera
  misc_feature: Coding regions on vcDNA: vcDNA=SeqID_9374; Strand=-; Position=3-1055
  misc_feature (3)..(16): Xaa can be any naturally occurring amino acid
  misc_feature (19)..(27): Xaa can be any naturally occurring amino acid
  misc_feature (33)..(39): Xaa can be any naturally occurring amino acid
  misc_feature (45)..(53): Xaa can be any naturally occurring amino acid
  misc_feature (60)..(89): Xaa can be any naturally occurring amino acid
  misc_feature (91)..(335): Xaa can be any naturally occurring amino acid
  misc_feature (338)..(351): Xaa can be any naturally occurring amino acid
GAXXXXXXXXXXXXXXNSXXXXXXXXXLFCVDXXXXXXXALPLRXXXXXXXXXGGPKIYXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRYXXXXXXXXXXXXXX

SEQ ID NO: 29678 - protein, 104 aa, Diabrotica virgifera
  misc_feature: Coding regions on vcDNA: vcDNA=SeqID_9375; Strand=-; Position=278-592
AVAFPAVSSLLSTSCYNSVSAVRGMIRIVIQIARFSLRSCESRKFFYFCHLTRQGRVSRRQKRIAAGVHRSCTLAARSCQDGVQYLSQGICRLVPRSFVAHPLV

SEQ ID NO: 29679 - protein, 289 aa, Diabrotica virgifera
  misc_feature: Coding regions on vcDNA: vcDNA=SeqID_9376; Strand=-; Position=3-869
  misc_feature (10)..(289): Xaa can be any naturally occurring amino acid
KKLNFIVNHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29680 - protein, 22 aa, Diabrotica virgifera
  misc_feature: Coding regions on vcDNA: vcDNA=SeqID_9377; Strand=+; Position=2-70
IKTIFNVPIFFSCYIIIVLNNK

SEQ ID NO: 29681 - protein, 34 aa, Diabrotica virgifera
  misc_feature: Coding regions on vcDNA: vcDNA=SeqID_9378; Strand=-; Position=1-102
  misc_feature (4)..(34): Xaa can be any naturally occurring amino acid
PSFXXXXXXXXXXXXXXXXXXXXXXXXXXXXXXX

SEQ ID NO: 29682 - protein, 125 aa, Diabrotica virgifera
  misc_feature: Coding regions on vcDNA: vcDNA=SeqID_9379; Strand=+; Position=496-873
  misc_feature: Homolog annotation: Hit_ID=XP_397361.1; Match level="QueryCoverage =93%, HitCoverage=30%, E-value=7e-18, Identity=38%"; Hit description =similar to Phosphatidylinositol glycan, class Q [Apis mellifera]
MKKNKDNSNEVKEEDTTNTLENPTENNTESKRAKRRKKHLELQVAKKLKATLVTQENCLNYLSKWKHSRSEWKFEKLKQIWLSNNLFDSAKVPEEFWATTLEYFTQSRGFVRKVILRDALKLIEK

SEQ ID NO: 29683 - protein, 176 aa, Diabrotica virgifera
  misc_feature: Coding regions on vcDNA: vcDNA=SeqID_9380; Strand=+; Position=2-532
  misc_feature: Homolog annotation: Hit_ID=EAL33909.1; Match level="QueryCoverage =100%, HitCoverage=20%, E-value=2e-33, Identity=42%"; Hit description= GA21714-PA [Drosophila pseudoobscura]
GQGELMGHVWSGTASDKTPAFQVQALLHDHLEYIRLGSGYIAAINFKGSTSFDLSGKIEISLWNRNAESLVQKSAGVIILGTSTIDTVFVKSKAEFTASIEYRLDLQTDIDFSSGAQLCMRLTQPDTLFRHNIHKVERIPGSKHKMRISRYQKYIIPGTTYALNNKNTEMCNAIFS

SEQ ID NO: 29684 - protein, 376 aa, Diabrotica virgifera
  misc_feature: Coding regions on vcDNA: vcDNA=SeqID_9381; Strand=+; Position=1-1128
  misc_feature (1)..(15): Xaa can be any naturally occurring amino acid
  misc_feature (18)..(250): Xaa can be any naturally occurring amino acid
  misc_feature (253)..(268): Xaa can be any naturally occurring amino acid
  misc_feature (272)..(278): Xaa can be any naturally occurring amino acid
  misc_feature (282)..(313): Xaa can be any naturally occurring amino acid
  misc_feature (319)..(326): Xaa can be any naturally occurring amino acid
  misc_feature (328)..(342): Xaa can be any naturally occurring amino acid
  misc_feature (344)..(360): Xaa can be any naturally occurring amino acid
  misc_feature (363)..(370): Xaa can be any naturally occurring amino acid
XXXXXXXXXXXXXXXYLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXREXXXXXXXXXXXXXXXXKIIXXXXXXXGGGXXXXXXXXXXXXXXXXXXXXXXXXXXXXXXXXLGVTAXXXXXXXXQXXXXXXXXXXXXXXXKXXXXXXXXXXXXXXXXXGGXXXXXXXXVGGVKT

SEQ ID NO: 29685 - protein, 92 aa, Diabrotica virgifera
  misc_feature: Coding regions on vcDNA: vcDNA=SeqID_9382; Strand=+; Position=1-279
  misc_feature (6)..(11): Xaa can be any naturally occurring amino acid
  misc_feature (25)..(74): Xaa can be any naturally occurring amino acid
IFATEXXXXXXDRNQPGSHRFKLRXXXXXXXXXXXXXXXXXXXXXXXXXXXXXXXXXXXXXXXXXXXXXXXXXXYKFTLGITADFYWRARSL

SEQ ID NO: 29686 - protein, 91 aa, Diabrotica virgifera
  misc_feature: Coding regions on vcDNA: vcDNA=SeqID_9383; Strand=-; Position=320-595
  misc_feature (34)..(41): Xaa can be any naturally occurring amino acid
  misc_feature (62)..(69): Xaa can be any naturally occurring amino acid
RFLQQAFEMVQTIYFVYLHFFDNCYSIYFQLYFXXXXXXXXYTFFKEGKQISRLKIKSTFDXXXXXXXXNCQNEFKLTLIIVWVLTIDAAT

SEQ ID NO: 29687 - protein, 68 aa, Diabrotica virgifera
  misc_feature: Coding regions on vcDNA: vcDNA=SeqID_9384; Strand=-; Position=286-492
NLYFLNSFSLTLDVVIHNQKYVTQIVSKIKKSFAYFLYMLQVDKRKKIVFDFPYLPIHNVTHWRPTWG

SEQ ID NO: 29688 - protein, 75 aa, Diabrotica virgifera
  misc_feature: Coding regions on vcDNA: vcDNA=SeqID_9385; Strand=-; Position=90-317
NDTENSCSPHFHKTHYNYVTTAASAELPSQVIQITTGLPFLKSLTEEVEEWVAVCLELVIQNYICIFQFINFHTF

SEQ ID NO: 29689 - protein, 84 aa, Diabrotica virgifera
  misc_feature: Coding regions on vcDNA: vcDNA=SeqID_9386; Strand=+; Position=137-391
SVYKSLPRNSSTYVVKRLYRVMKMYTSFSNASKNMGMRVNEEKTKIWYQHLTIEPETSVTNSWLITLLLKWWTNSHILYSRVIS

SEQ ID NO: 29690 - protein, 71 aa, Diabrotica virgifera
  misc_feature: Coding regions on vcDNA: vcDNA=SeqID_9387; Strand=-; Position=2-214
  misc_feature (4)..(12): Xaa can be any naturally occurring amino acid
  misc_feature (19)..(25): Xaa can be any naturally occurring amino acid
  misc_feature (30)..(57): Xaa can be any naturally occurring amino acid
  misc_feature (59)..(71): Xaa can be any naturally occurring amino acid
NVNXXXXXXXXXDRLMLSXXXXXXXSITNXXXXXXXXXXXXXXXXXXXXXXXXXXXXQXXXXXXXXXXXXX

SEQ ID NO: 29691 - protein, 125 aa, Diabrotica virgifera
  misc_feature: Coding regions on vcDNA: vcDNA=SeqID_9388; Strand=-; Position=214-591
  misc_feature (9)..(22): Xaa can be any naturally occurring amino acid
  misc_feature (25)..(42): Xaa can be any naturally occurring amino acid
  misc_feature (51)..(57): Xaa can be any naturally occurring amino acid
  misc_feature (70)..(85): Xaa can be any naturally occurring amino acid
  misc_feature (88)..(101): Xaa can be any naturally occurring amino acid
  misc_feature (104)..(124): Xaa can be any naturally occurring amino acid
LIIKLVLIXXXXXXXXXXXXXXKIXXXXXXXXXXXXXXXXXXKFHIYIIFXXXXXXXYKLKILVKLNYKXXXXXXXXXXXXXXXXLYXXXXXXXXXXXXXXIEXXXXXXXXXXXXXXXXXXXXXS

SEQ ID NO: 29692 - protein, 252 aa, Diabrotica virgifera
  misc_feature: Coding regions on vcDNA: vcDNA=SeqID_9389; Strand=-; Position=1-756
  misc_feature (2)..(235): Xaa can be any naturally occurring amino acid
  misc_feature (238)..(252): Xaa can be any naturally occurring amino acid
SXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 29693 - protein, 101 aa, Diabrotica virgifera
  misc_feature: Coding regions on vcDNA: vcDNA=SeqID_9390; Strand=+; Position=1-303
  misc_feature (4)..(40): Xaa can be any naturally occurring amino acid
  misc_feature (79)..(86): Xaa can be any naturally occurring amino acid
  misc_feature (89)..(96): Xaa can be any naturally occurring amino acid
FSIXXXXXXXXXXXXXXXXXXXXXXXXXXXXXXXXXXXXXIEIKYLREYSVFFIGEVQIDNKIGEPPGWDKRVLNWWRXXXXXXXXVPXXXXXXXXWWIIT

SEQ ID NO: 29694 - protein, 209 aa, Diabrotica virgifera
  misc_feature: Coding regions on vcDNA: vcDNA=SeqID_9391; Strand=+; Position=22-651
  misc_feature: Homolog annotation: Hit_ID=NP_727758.1; Match level="QueryCoverage =100%, HitCoverage=97%, E-value=4e-22, Identity=35%"; Hit description= CG32603-PA [Drosophila melanogaster] gb|AAN09580.1| CG32603-PA [Drosophila melanogaster]
MTFKVIIFASFLAFAKAGSYDSTLALPATPVISAYQSAPVLAAPAVSKSFVQTYTSHPAPVAVAAPVVTKSVAPVVSTYSAPLALPAHGPVVSAYSAPLSLPAHGPVVSAYSAPLVAKSPLSYAAHSPVVSAYSSPLLSAYSAPVVAKSVSPLAYAAPSPVLSAYSSPVVSAYSSPLLAKSLAPAPVAYAGHAAPVLSAYSAGPVVQPW

SEQ ID NO: 29695 - protein, 262 aa, Diabrotica virgifera
  misc_feature: Coding regions on vcDNA: vcDNA=SeqID_9392; Strand=+; Position=51-838
  misc_feature: Homolog annotation: Hit_ID=XP_319140.1; Match level="QueryCoverage =96%, HitCoverage=93%, E-value=3e-91, Identity=62%"; Hit description =ENSANGP00000011893 [Anopheles gambiae]
  misc_feature: Pfam annotation: Pfam_ID=Thioredoxin; Match level="Score=-15.7, E -value=0.0005, Copies=1"; Pfam description=Thioredoxin
  misc_feature (219)..(219): Xaa can be any naturally occurring amino acid
  misc_feature (231)..(231): Xaa can be any naturally occurring amino acid
  misc_feature (242)..(242): Xaa can be any naturally occurring amino acid
  misc_feature (258)..(258): Xaa can be any naturally occurring amino acid
IYQLVESFKQDLKQVLKPYYIFNILLSLSYVALKRTPGVCNYLFPTSGCEFEGRETEILFFLIIVIAIRTRKAGSVSMINYLSSSFIYTKVANLILWFSADLFMGIVFGIVFILGALLFPEPTYSGPDKVTYFRGVQGLDEELQRDKKVTWIVTFYAVWNPACVNFAPVISKLSTIYDIENLKFGKVDIGRYPDAGQKYHVSDSSMSKQLPTVILFQDXKEVIRRPMADTXGKLIKFSFTEXNIINVFGLKGLYENCXEELG

SEQ ID NO: 29696 - protein, 18 aa, Diabrotica virgifera
  misc_feature: Coding regions on vcDNA: vcDNA=SeqID_9393; Strand=+; Position=1-54
  misc_feature (2)..(15): Xaa can be any naturally occurring amino acid
KXXXXXXXXXXXXXXRET

SEQ ID NO: 29697 - protein, 34 aa, Diabrotica virgifera
  misc_feature: Coding regions on vcDNA: vcDNA=SeqID_9394; Strand=-; Position=0-101
  misc_feature (11)..(31): Xaa can be any naturally occurring amino acid
KVNYSYKSKKXXXXXXXXXXXXXXXXXXXXXITP

SEQ ID NO: 29698 - protein, 293 aa, Diabrotica virgifera
  misc_feature: Coding regions on vcDNA: vcDNA=SeqID_9395; Strand=+; Position=67-945
  misc_feature: Homolog annotation: Hit_ID=EAA04621.2; Match level="QueryCoverage =94%, HitCoverage=84%, E-value=1e-116, Identity=72%"; Hit description= ENSANGP00000009446 [Anopheles gambiae str. PEST] ref|XP_564781.1| ENSANGP00000009446 [Anopheles gambiae s
  misc_feature: Gene Ontology Annotation: Molecular function=DNA binding; Cellular component=DNA replication factor C complex; Biological process=DNA replication
  misc_feature: Pfam annotation: Pfam_ID=AAA; Match level="Score=27.9, E-value=3.2e -06, Copies=1"; Pfam description=ATPase family associated with various
  misc_feature (191)..(198): Xaa can be any naturally occurring amino acid
  misc_feature (246)..(246): Xaa can be any naturally occurring amino acid
  misc_feature (263)..(263): Xaa can be any naturally occurring amino acid
MPGPSSSTKEEQQPVKKHCNLPWIEKYRPQTFQEIVGNEDTITRLSVFSKQGNLPNIIIAGPPGVGKTTTILCLARILLGPAFKDAVLELNASNDRGIDIVRDKVKRFAQQKVTLPPGRHKIIILDEVDSMTDGAQQALRRTMELYTNTTRFALACNYSEKVIEAIQSRCAILRYSRLSDAQVLARTLQIXXXXXXXXTEDGLEAIVFTAQGDMRQALNNLQSTHNGFGEVNSQSVFKVCDEPHPXVIKDMLKNLYTGDIRKXYKVIEHLWNLGYAAEDINKNIFQVCKNMDM

SEQ ID NO: 29699 - protein, 110 aa, Diabrotica virgifera
  misc_feature: Coding regions on vcDNA: vcDNA=SeqID_9396; Strand=-; Position=563-895
  misc_feature (39)..(39): Xaa can be any naturally occurring amino acid
VRYDGHKNREMTIFSINRKIRQPQKNVYQLSIKMFHLFXSSMLIKYADTIRSYFLDDSIQMCKITIVQIICSQTNVIVMSFFFFASENCISKLCHNLFTIKKVYPCLNYN

SEQ ID NO: 29700 - protein, 278 aa, Diabrotica virgifera
  misc_feature: Coding regions on vcDNA: vcDNA=SeqID_9397; Strand=-; Position=1-834
  misc_feature (1)..(15): Xaa can be any naturally occurring amino acid
  misc_feature (17)..(261): Xaa can be any naturally occurring amino acid
  misc_feature (264)..(278): Xaa can be any naturally occurring amino acid
XXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 29701 - protein, 239 aa, Diabrotica virgifera
  misc_feature: Coding regions on vcDNA: vcDNA=SeqID_9398; Strand=+; Position=112-831
  misc_feature: Homolog annotation: Hit_ID=XP_309360.1; Match level="QueryCoverage =72%, HitCoverage=20%, E-value=2e-35, Identity=43%"; Hit description =ENSANGP00000008246 [Anopheles gambiae]
  misc_feature: Gene Ontology Annotation: Cellular component=mitochondrion
MEHLLRGQFGRIIISTYSHTPLKYGPQKSCQRGMCILWSGRTLDRSRPLLKEYGMLIARALRGVLKIRYLLLGGAVAGGGALQKKYNDWKDGLPDMKWLDEVLPDNEKFQQWRANLVDFKELDPRIKSLTENKYNEFKSWAIAAAEAQESAQPNKEGAVAKLLYRLYSEGKKEIIQKTMVYAANPFSADEKARKETQERLNNIQDEMMQTQIKYQRELEELRKQTYYKQERSHLLEVKY

SEQ ID NO: 29702 - protein, 57 aa, Diabrotica virgifera
  misc_feature: Coding regions on vcDNA: vcDNA=SeqID_9399; Strand=-; Position=467-640
PFGRNQNVNRSPFDHLGKPLQPQSSHHWEYVNLGNTLWDVPVPFSVIFPPAPTDRTG

SEQ ID NO: 29703 - protein, 54 aa, Diabrotica virgifera
  misc_feature: Coding regions on vcDNA: vcDNA=SeqID_9400; Strand=-; Position=117-281
  misc_feature (40)..(48): Xaa can be any naturally occurring amino acid
MRLTSTGTDDDIFISETFCDLIWPLEVILMKLLPVIKEFXXXXXXXXXYQTYIS

SEQ ID NO: 29704 - protein, 49 aa, Diabrotica virgifera
  misc_feature: Coding regions on vcDNA: vcDNA=SeqID_9401; Strand=-; Position=83-232
DIRNVYFSSDSVIRLQKRLVLSLYANAEHIIFVSYTKFSFVGVLVIEET

SEQ ID NO: 29705 - protein, 240 aa, Diabrotica virgifera
  misc_feature: Coding regions on vcDNA: vcDNA=SeqID_9402; Strand=+; Position=44-766
  misc_feature: Homolog annotation: Hit_ID=XP_393984.1; Match level="QueryCoverage =95%, HitCoverage=50%, E-value=9e-84, Identity=69%"; Hit description =similar to ENSANGP00000019879 [Apis mellifera]
  misc_feature: Gene Ontology Annotation: Molecular function=chromatin binding; Cellular component=nuclear body; Biological process=mitotic cell cycle
  misc_feature: Pfam annotation: Pfam_ID=zf-C3HC4; Match level="Score=47.4, E-value =4.2e-11, Copies=1"; Pfam description=Zinc finger, C3HC4 type (RING finger)
  misc_feature (231)..(231): Xaa can be any naturally occurring amino acid
KCFCNFLETMTTSEQIGLNKTWELSLYELHRTPQEAITDNTEIAVSPRSLHSELMCPICLDMLKKTMTTKECLHRFCSDCIITALRSGNKECPTCRKKLVSKRSLRPDPNFDLLISKIYPSRDEYEAHQERVLAKLNKSHSREALMQSIKEGIKIQSQNRPNRGRKTNEPVVGQENNSEENNPNAPNAADTAVPAITQPVAATPPVQPPLQTNVTTAPPTANTNAPSPSPXRQKYPFTTT

SEQ ID NO: 29706 - protein, 213 aa, Diabrotica virgifera
  misc_feature: Coding regions on vcDNA: vcDNA=SeqID_9403; Strand=+; Position=128-768
  misc_feature: Homolog annotation: Hit_ID=AAH88426.1; Match level="QueryCoverage =69%, HitCoverage=23%, E-value=4e-31, Identity=44%"; Hit description =Unknown (protein for MGC:95054) [Rattus norvegicus]
  misc_feature: Pfam annotation: Pfam_ID=DUF408; Match level="Score=84.5, E-value =2.9e-22, Copies=1"; Pfam description=Domain of Unknown Function (DUF408)
  misc_feature (99)..(99): Xaa can be any naturally occurring amino acid
MQDSLDDYVKLAKNIQSEGSSKETQKDVQIAALRKKECETRAFKIVEFSIEGKLRPEIFTRCLPYINQSHYQDIVEERAITKLCGYSVCGRKIPEMPKXKQFYISTKHNKVYDITDRKNYCSNFCYKASIHIKKQIDDSPLWLRKLDSIPEYQFLGSEGGGLPGELIDQGISKPVVEPLFTSVGSFTNVSLEDMINKEKGSNRDPNKAKQTFG

SEQ ID NO: 29707 - protein, 136 aa, Diabrotica virgifera
  misc_feature: Coding regions on vcDNA: vcDNA=SeqID_9404; Strand=+; Position=268-678
  misc_feature (113)..(113): Xaa can be any naturally occurring amino acid
MSIPSKNIDFLDIKLTLSIAKKSKTVNLVKKIYRTFFAWTECFYQLLRLRYSGKFPPLDGVATAPMVEAPFGIIWILILGLSTAYSQVFKQVGSFCKKCEVKSFGSWTIHLNXVLFLDLRALENTHSTFSLVPVSR

SEQ ID NO: 29708 - protein, 56 aa, Diabrotica virgifera
  misc_feature: Coding regions on vcDNA: vcDNA=SeqID_9405; Strand=-; Position=159-329
  misc_feature (1)..(12): Xaa can be any naturally occurring amino acid
  misc_feature (14)..(37): Xaa can be any naturally occurring amino acid
XXXXXXXXXXXXGXXXXXXXXXXXXXXXXXXXXXXXXIRINYLRDNSVILLESSNR

SEQ ID NO: 29709 - protein, 112 aa, Diabrotica virgifera
  misc_feature: Coding regions on vcDNA: vcDNA=SeqID_9406; Strand=+; Position=1-336
  misc_feature (1)..(48): Xaa can be any naturally occurring amino acid
  misc_feature (51)..(97): Xaa can be any naturally occurring amino acid
  misc_feature (103)..(109): Xaa can be any naturally occurring amino acid
XXXXXXXXXXXXXXXXXXXXXXXXXXXXXXXXXXXXXXXXXXXXXXXXFLXXXXXXXXXXXXXXXXXXXXXXXXXXXXXXXXXXXXXXXXXXXXXXXLRENTXXXXXXXVQI

SEQ ID NO: 29710 - protein, 15 aa, Diabrotica virgifera
  misc_feature: Coding regions on vcDNA: vcDNA=SeqID_9407; Strand=-; Position=34-81
AKYISLLCITIKALC

SEQ ID NO: 29711 - protein, 39 aa, Diabrotica virgifera
  misc_feature: Coding regions on vcDNA: vcDNA=SeqID_9408; Strand=-; Position=2-118
  misc_feature (2)..(2): Xaa can be any naturally occurring amino acid
  misc_feature (6)..(14): Xaa can be any naturally occurring amino acid
  misc_feature (27)..(27): Xaa can be any naturally occurring amino acid
  misc_feature (30)..(38): Xaa can be any naturally occurring amino acid
NXKVDXXXXXXXXXNYKLNPTSRSQSXLSXXXXXXXXXV

SEQ ID NO: 29712 - protein, 101 aa, Diabrotica virgifera; identical to SEQ ID NO: 29675
  misc_feature: Coding regions on vcDNA: vcDNA=SeqID_9409; Strand=-; Position=226-531
  misc_feature (2)..(20): Xaa can be any naturally occurring amino acid
  misc_feature (23)..(29): Xaa can be any naturally occurring amino acid
  misc_feature (35)..(56): Xaa can be any naturally occurring amino acid
  misc_feature (58)..(82): Xaa can be any naturally occurring amino acid

SEQ ID NO: 29713 - protein, 115 aa, Diabrotica virgifera
  misc_feature: Coding regions on vcDNA: vcDNA=SeqID_9410; Strand=-; Position=0-344
  misc_feature (2)..(30): Xaa can be any naturally occurring amino acid
  misc_feature (36)..(43): Xaa can be any naturally occurring amino acid
  misc_feature (71)..(79): Xaa can be any naturally occurring amino acid
  misc_feature (86)..(113): Xaa can be any naturally occurring amino acid
GXXXXXXXXXXXXXXXXXXXXXXXXXXXXXFNPPIXXXXXXXXTQTLIKKAATPNYKLLSHPWSSPILLSXXXXXXXXXAVIPKGXXXXXXXXXXXXXXXXXXXXXXXXXXXXIT

SEQ ID NO: 29714 - protein, 204 aa, Diabrotica virgifera
  misc_feature: Coding regions on vcDNA: vcDNA=SeqID_9411; Strand=-; Position=1-612
  misc_feature (2)..(146): Xaa can be any naturally occurring amino acid
  misc_feature (149)..(202): Xaa can be any naturally occurring amino acid
SXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFXXXXXXXXXXXXXXXXXXXXXXXXXXXXXXXXXXXXXXXXXXXXXXXXXXXXXXPI

SEQ ID NO: 29715 - protein, 34 aa, Diabrotica virgifera; identical to SEQ ID NO: 27603
  misc_feature: Coding regions on vcDNA: vcDNA=SeqID_9412; Strand=-; Position=80-184

SEQ ID NO: 29716 - protein, 293 aa, Diabrotica virgifera
  misc_feature: Coding regions on vcDNA: vcDNA=SeqID_9413; Strand=+; Position=2-883
  misc_feature (1)..(224): Xaa can be any naturally occurring amino acid
  misc_feature (227)..(227): Xaa can be any naturally occurring amino acid
  misc_feature (235)..(272): Xaa can be any naturally occurring amino acid
  misc_feature (274)..(286): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSLXFFIRRDTXXXXXXXXXXXXXXXXXXXXXXXXXXXXXXXXXXXXXXIXXXXXXXXXXXXXKINYLKG

SEQ ID NO: 29717 - protein, 108 aa, Diabrotica virgifera
  misc_feature: Coding regions on vcDNA: vcDNA=SeqID_9414; Strand=+; Position=397-722
  misc_feature: Homolog annotation: Hit_ID=AAL79617.1; Match level="QueryCoverage =99%, HitCoverage=50%, E-value=2e-39, Identity=73%"; Hit description =putative transposase [Xenorhabdus nematophila]
  misc_feature (26)..(26): Xaa can be any naturally occurring amino acid
  misc_feature (32)..(32): Xaa can be any naturally occurring amino acid
  misc_feature (83)..(83): Xaa can be any naturally occurring amino acid
MNDYIHKSPNVTVLVYPIVLPANYRXAAFDAXRADEILNTVCLEIELRYQAEFLEIGTDRDPEHFIKQSVPTYRETTIIKLVXSLAARDIFQRWPLLKEILWRGEFWN

SEQ ID NO: 29718 - protein, 127 aa, Diabrotica virgifera
  misc_feature: Coding regions on vcDNA: vcDNA=SeqID_9415; Strand=+; Position=2-385
  misc_feature (20)..(55): Xaa can be any naturally occurring amino acid
  misc_feature (58)..(79): Xaa can be any naturally occurring amino acid
  misc_feature (84)..(90): Xaa can be any naturally occurring amino acid
  misc_feature (95)..(101): Xaa can be any naturally occurring amino acid
IGKLVPLQARPGIPGSPRPXXXXXXXXXXXXXXXXXXXXXXXXXXXXXXXXXXXXRHXXXXXXXXXXXXXXXXXXXXXXLKELXXXXXXXQITIXXXXXXXQCYSFLHTSNFLRNKLYSFIQQYIYT

SEQ ID NO: 29719 - protein, 131 aa, Diabrotica virgifera
  misc_feature: Coding regions on vcDNA: vcDNA=SeqID_9416; Strand=+; Position=22-417
  misc_feature: Homolog annotation: Hit_ID=CAG12716.1; Match level="QueryCoverage =81%, HitCoverage=21%, E-value=1e-12, Identity=33%"; Hit description =unnamed protein product [Tetraodon nigroviridis]
  misc_feature: Gene Ontology Annotation: Molecular function=zinc ion binding; Cellular component=nucleus; Biological process=photoreceptor fate commitment (sensu Drosophila)
  misc_feature: Pfam annotation: Pfam_ID=zf-C2H2; Match level="Score=58.5, E-value =1.9e-14, Copies=3"; Pfam description=Zinc finger, C2H2 type
MRPLVPVKILKCQESPVTQFTTKRSVPCPLCSKVMKSTKQLLTHMNTHDEGPHNPFPCDKCKKSYKNLFSLNLHLKIHGNIRYYQCMLCYKVFTNAIYLLRHSNSYKILSPHVCNILMIRVHYSIHLKRQM

SEQ ID NO: 29720 - protein, 129 aa, Diabrotica virgifera
  misc_feature: Coding regions on vcDNA: vcDNA=SeqID_9417; Strand=-; Position=57-446
  misc_feature (6)..(23): Xaa can be any naturally occurring amino acid
  misc_feature (25)..(32): Xaa can be any naturally occurring amino acid
  misc_feature (40)..(46): Xaa can be any naturally occurring amino acid
  misc_feature (50)..(56): Xaa can be any naturally occurring amino acid
  misc_feature (81)..(87): Xaa can be any naturally occurring amino acid
  misc_feature (97)..(116): Xaa can be any naturally occurring amino acid
  misc_feature (119)..(119): Xaa can be any naturally occurring amino acid
  misc_feature (121)..(127): Xaa can be any naturally occurring amino acid
WPPPPXXXXXXXXXXXXXXXXXXPXXXXXXXXGYTPQIQXXXXXXXGPTXXXXXXXVHPTNLKLFNPPTGGGPNLIIRLTXXXXXXXCIPKVILSYXXXXXXXXXXXXXXXXXXXXLFXSXXXXXXXYK

SEQ ID NO: 29721 - protein, 153 aa, Diabrotica virgifera
  misc_feature: Coding regions on vcDNA: vcDNA=SeqID_9418; Strand=+; Position=13-474
  misc_feature: Pfam annotation: Pfam_ID=E1_DerP2_DerF2; Match level="Score=7.7, E -value=0.0034, Copies=1"; Pfam description=ML domain
SHKMRLEYALLLSVLLDMAKCAIDFTDCGTILEVTDVKFGNCIQTPCTVERYSEVSVEIELSRKTHVPPLDSVSAVAEYVHRGISWELGISPSDTCTTWTCPLQDVNTYSYQAKISFEPISYLRPGEVLIKTFNTLQPDGDPIFCASWDINFV

SEQ ID NO: 29722 - protein, 123 aa, Diabrotica virgifera; identical to SEQ ID NO: 23719
  misc_feature: Coding regions on vcDNA: vcDNA=SeqID_9419; Strand=+; Position=49-420
  misc_feature: Homolog annotation: Hit_ID=AAS89344.1; Match level="QueryCoverage =62%, HitCoverage=85%, E-value=2e-11, Identity=45%"; Hit description =similar to C9 orf16 [Ctenopharyngodon idella]
  misc_feature: Pfam annotation: Pfam_ID=UPF0184; Match level="Score=44.8, E-value =2.4e-10, Copies=1"; Pfam description=Uncharacterised protein family (UPF018

SEQ ID NO: 29723 - protein, 276 aa, Diabrotica virgifera
  misc_feature: Coding regions on vcDNA: vcDNA=SeqID_9420; Strand=+; Position=1-831
  misc_feature: Homolog annotation: Hit_ID=EAA46107.2; Match level="QueryCoverage =90%, HitCoverage=20%, E-value=3e-70, Identity=55%"; Hit description =CG40084-PD.3 [Drosophila melanogaster] gb|EAA46106.2| CG40084-PC.3 [Drosophila melanogaster]
  misc_feature: Gene Ontology Annotation: Biological process=embryogenesis and morphogenesis
  misc_feature: Pfam annotation: Pfam_ID=cNMP_binding; Match level="Score=7.1, E -value=0.014, Copies=1"; Pfam description=Cyclic nucleotide-binding domain
DVFTDNRSKRKRNAERRQDFTVFAEKRGELNKMRISPQLTLAAYQYLSTSVEPFHPNVISETILRRLLKQDIAVHIKKNKEWRTDPANIIYSQGKSVDFFVIILEGRVEVTVGKESLMFEGGPFTYFGTQALVQTVGIESPSVAASTMGSLESLNIDSLLRHTFIPDYSVRASTEVLYLKIKRSLYLAAKRASLMERSKKGEHQTQQQFDEEVDKLLHSLDEDDGISAGAQTPKRKSSRRSQEIKPENLSNLSSQTSPKTPSHYSNTSPPHRVSAP

SEQ ID NO: 29724 - protein, 60 aa, Diabrotica virgifera
  misc_feature: Coding regions on vcDNA: vcDNA=SeqID_9421; Strand=-; Position=0-179
  misc_feature (25)..(48): Xaa can be any naturally occurring amino acid
SFSNNNLVSYRSFRFENSINLEIYXXXXXXXXXXXXXXXXXXXXXXXXTILLSLNKIFLS

SEQ ID NO: 29725 - protein, 69 aa, Diabrotica virgifera
  misc_feature: Coding regions on vcDNA: vcDNA=SeqID_9422; Strand=+; Position=281-490
LHLVQTDRVYAVLININKYSMYSVLTKNSFLNCNGQILKYTFAKEVKYSNNILLHFYNVLKLQVTYYYS

SEQ ID NO: 29726 - protein, 258 aa, Diabrotica virgifera
  misc_feature: Coding regions on vcDNA: vcDNA=SeqID_9423; Strand=+; Position=1-777
  misc_feature: Homolog annotation: Hit_ID=AAD34644.1; Match level="QueryCoverage =92%, HitCoverage=16%, E-value=1e-19, Identity=28%"; Hit description =transcription co-repressor Sin3 [Xenopus laevis]
  misc_feature (20)..(30): Xaa can be any naturally occurring amino acid
TAYKRVYQEMAYQRTAEKAXXXXXXXXXXXYKEDCRMTIELLDTDSDDMKKVEDGKKWSDYKEHYANIVDEAKPRSPVYLHRNLRLYQRKVVNCSSKNRRQIKNHQSNRDDESLGENKKTDGKSFNILDAIERKLNERTVPLRDHTHHPGYEVNDETECKFNVQDSKIMFTIQKDSYLYNISAFHRARKSHPQVTRKKAGRFRSWLKEWTSEHVSDIQVKQCTDWLMGRCDGVVPNRTRVLTDNDLTRTPYVSYNVSW

SEQ ID NO: 29727 - protein, 281 aa, Diabrotica virgifera
  misc_feature: Coding regions on vcDNA: vcDNA=SeqID_9424; Strand=+; Position=6-850
  misc_feature: Homolog annotation: Hit_ID=AAF97940.2; Match level="QueryCoverage =100%, HitCoverage=63%, E-value=1e-59, Identity=39%"; Hit description= cytochrome P450 CYP6N4v1 [Aedes albopictus]
  misc_feature (201)..(201): Xaa can be any naturally occurring amino acid
  misc_feature (225)..(225): Xaa can be any naturally occurring amino acid
  misc_feature (251)..(251): Xaa can be any naturally occurring amino acid
MLVFLLVILVAFFYLYKKWIYTYWKRRGVYQMKPEFFYGNFKPMTTGKMSVAELIREIYTEIKAKGGQYGGFYQVFKPGFMPVDLDIIKGIVQKDFGHFMNHGNYTNPEVDPLSNHLFAMEGEEWRKMRSKLTPTFTTGKMKMMFPTMVACTQGLNEMLKDHASIQDAVDIKDLIARFTTDIIGSAAFGIDCNSLQDPNSXFRQFGKQVFEVTFWKRLKRLISTXYPKWLLDLIRLKMVDQALEDFFMGIXRSTIKFREQNNVYRRDFLHLMLQLKTKEKL

SEQ ID NO: 29728 - protein, 80 aa, Diabrotica virgifera
  misc_feature: Coding regions on vcDNA: vcDNA=SeqID_9425; Strand=-; Position=430-672
  misc_feature (31)..(60): Xaa can be any naturally occurring amino acid
VGPPLRAKPTGRTSHDTPVDTAYDEPATWDXXXXXXXXXXXXXXXXXXXXXXXXXXXXXXLQLILVKGFRVYSFRLRGLG

SEQ ID NO: 29729 - protein, 239 aa, Diabrotica virgifera
  misc_feature: Coding regions on vcDNA: vcDNA=SeqID_9426; Strand=+; Position=150-869
  misc_feature: Homolog annotation: Hit_ID=XP_320075.1; Match level="QueryCoverage =83%, HitCoverage=43%, E-value=5e-21, Identity=35%"; Hit description =ENSANGP00000012365 [Anopheles gambiae]
  misc_feature: Gene Ontology Annotation: Cellular component=membrane; Biological process=lipid metabolism
  misc_feature (211)..(211): Xaa can be any naturally occurring amino acid
MRLPEFFWNTTIPEIISSSSIPIRNRAGFETIAVILPSFFYSLIIVVLETYISLKTSSKFVLELATIVLPITLGMTLLSEYSNLMIGVLSMLSALLLGVSYKKRTSTKKSDSFHTSFITNSRSTINILSVIAILAVDFDIFPSRFTKMDTLGYSLMDTGVGLYVFANGIVSPESRGVKNPISKSIKGSLPLFLIGSARFVLTKLFHYHVPXGGKYGVHWEFFYNSSCHQNVHFVPSQRF

SEQ ID NO: 29730 - protein, 34 aa, Diabrotica virgifera
  misc_feature: Coding regions on vcDNA: vcDNA=SeqID_9427; Strand=-; Position=0-101
  misc_feature (1)..(33): Xaa can be any naturally occurring amino acid
XXXXXXXXXXXXXXXXXXXXXXXXXXXXXXXXXT

SEQ ID NO: 29731 - protein, 66 aa, Diabrotica virgifera
  misc_feature: Coding regions on vcDNA: vcDNA=SeqID_9428; Strand=-; Position=2-199
  misc_feature (3)..(13): Xaa can be any naturally occurring amino acid
  misc_feature (21)..(21): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PSXXXXXXXXXXXPNLAHTGXNXXXXXXXXSNXXXXXXXXXXXXXXPTSRSXXXXXXXXXXXXXXV

SEQ ID NO: 29732 - protein, 51 aa, Diabrotica virgifera
  misc_feature: Coding regions on vcDNA: vcDNA=SeqID_9429; Strand=+; Position=3-158
  misc_feature (5)..(19): Xaa can be any naturally occurring amino acid
  misc_feature (21)..(28): Xaa can be any naturally occurring amino acid
DAWIXXXXXXXXXXXXXXXRXXXXXXXXDRNQPGSHRFKLRSWKILKVEQT

SEQ ID NO: 29733 - protein, 194 aa, Diabrotica virgifera
  misc_feature: Coding regions on vcDNA: vcDNA=SeqID_9430; Strand=+; Position=2-586
  misc_feature: Homolog annotation: Hit_ID=XP_312792.1; Match level="QueryCoverage =92%, HitCoverage=43%, E-value=1e-43, Identity=51%"; Hit description =ENSANGP00000020326 [Anopheles gambiae]
  misc_feature: Gene Ontology Annotation: Molecular function=transcription co -activator activity; Cellular component=SAGA complex; Biological process=histone acetylation
LLLLDAVELYGFGNWELISEHVETRSAEEVKEEYIARYVDGNLGKVTMTNPNLKKPVLVDHTIDDDASVTPAPPLDVTLEEANLLGYKPYRDDYEMEYNMEAEGLVSKLSLDPEEDSGVEIVLKLMIVDMYMRRLKERTRRKKIVKDYQLVAKYFENLRMDPYKAQITRDQREAGRLRTNNIQSSSVIGTHKVP

SEQ ID NO: 29734 - protein, 51 aa, Diabrotica virgifera
  misc_feature: Coding regions on vcDNA: vcDNA=SeqID_9431; Strand=-; Position=145-300
LVDSSQILRHWRNYYFSAIFRFSNTFYVNSFLRKISTYFIGNGKIIIFRDI

SEQ ID NO: 29735 - protein, 179 aa, Diabrotica virgifera
  misc_feature: Coding regions on vcDNA: vcDNA=SeqID_9432; Strand=+; Position=54-593
  misc_feature: Homolog annotation: Hit_ID=EAA11535.2; Match level="QueryCoverage =94%, HitCoverage=91%, E-value=2e-30, Identity=38%"; Hit description =ENSANGP00000012981 [Anopheles gambiae str. PEST] ref|XP_557034.1| ENSANGP00000012981 [Anopheles gambiae st
  misc_feature: Pfam annotation: Pfam_ID=PBP_GOBP; Match level="Score=6.1, E-value =0.0039, Copies=1"; Pfam description=PBP/GOBP family
MFGGLTILSLVCFSAALAAGLNETKPPNKCEIPASAPKKVEEVINQCQDEIKLAILSEALETINVNENAHSRAKRAAFTDDEKRIAGCLLQCVYRKMKAVNEIGFPTESGLISLYTSGIPHKEYIRATVEAVTLCLRDAKKKYLVNRKSLEEDGKTCDVAYEVFDCVSDEIGKYCGQTP

SEQ ID NO: 29736 - protein, 232 aa, Diabrotica virgifera
  misc_feature: Coding regions on vcDNA: vcDNA=SeqID_9433; Strand=+; Position=187-882
  misc_feature: Homolog annotation: Hit_ID=XP_309178.1; Match level="QueryCoverage =90%, HitCoverage=57%, E-value=1e-39, Identity=39%"; Hit description =ENSANGP00000018673 [Anopheles gambiae]
  misc_feature: Gene Ontology Annotation: Molecular function=phosphodiesterase I activity; Cellular component=integral to plasma membrane; Biological process=nucleotide metabolism
  misc_feature: Pfam annotation: Pfam_ID=Phosphodiest; Match level="Score=-126.9, E -value=0.00016, Copies=1"; Pfam description=Type I phosphodiesterase / nucleotide
  misc_feature (200)..(205): Xaa can be any naturally occurring amino acid
  misc_feature (210)..(210): Xaa can be any naturally occurring amino acid
  misc_feature (217)..(217): Xaa can be any naturally occurring amino acid
MILKIILSCSILNVVWCISRHPILIIISYDAFRYNLFDTKLLPNMENLRKAGTYADYMTNIFPTKTFPNHYSIATGVFAETHGVIGASYLDAATQKVVKKVEEMFHYNEDVVPIWRWNEAQGDGRYSASFMWPGSDFPYQGKDITYNQKFARNFTHVQKVDKMLSWLTDPVKPANLVMLYIEGIDYPAHVYGSNSAQFMXXXXXXDTLTXYIEDQLXKHNLSERANGVQLSD

SEQ ID NO: 29737 - protein, 132 aa, Diabrotica virgifera
  misc_feature: Coding regions on vcDNA: vcDNA=SeqID_9434; Strand=+; Position=478-873
  misc_feature (117)..(117): Xaa can be any naturally occurring amino acid
MINQHFMKHTNTTALIPVRKNPEILTHVFNILYNFNIKLTNDVFQLESLREESWEYQRIKSIFFQSNKSFCKLHSIEKVHNPYLQLHYALKKDEYIRKGIRYMETMLFHGTRRAIIXDICRNNFNWRLTGTA

SEQ ID NO: 29738 - protein, 125 aa, Diabrotica virgifera
  misc_feature: Coding regions on vcDNA: vcDNA=SeqID_9435; Strand=-; Position=303-680
  misc_feature (20)..(20): Xaa can be any naturally occurring amino acid
  misc_feature (32)..(32): Xaa can be any naturally occurring amino acid
  misc_feature (116)..(121): Xaa can be any naturally occurring amino acid
QATPKSTRPRQARGKIRGPXQNYSSCIEQFFXRSLESPQTENVLSDFSPKLIAFVHERLKILKIAKSAIFNPKSDTHPKISMLPRYVDTLQTLIDKIPKSSLQQNIENPFVPLIAXXXXXXLQYK

SEQ ID NO: 29739 - protein, 198 aa, Diabrotica virgifera
  misc_feature: Coding regions on vcDNA: vcDNA=SeqID_9436; Strand=+; Position=4-600
  misc_feature: Homolog annotation: Hit_ID=NP_608514.1; Match level="QueryCoverage =91%, HitCoverage=73%, E-value=7e-22, Identity=30%"; Hit description =CG3625-PB, isoform B [Drosophila melanogaster] gb|AAF51516.1| CG3625- PB, isoform B [Drosophila
  misc_feature: Pfam annotation: Pfam_ID=Far-17a_AIG1; Match level="Score=70.9, E -value=3.4e-18, Copies=1"; Pfam description=FAR-17a/AIG1-like protein
LLTYLLTAILLTCLYYFGLLPLLKKMLQIFFISLAVLDELSKLLSLPSKVQNLLSKVRAYIFNSLVFPCSTLVVFTFWSIWAVDRELIFPKVMDTFFPSWLNHVLHTFIAIPLVIEILLPKKDNFVQFKNAAPILLFYAGLYQTLYFSIYLRDGVWLYPIYKVLSIPQMVLFNIVQMLLILGFQYVGISLEVGKKKVK

SEQ ID NO: 29740 - protein, 21 aa, Diabrotica virgifera
  misc_feature: Coding regions on vcDNA: vcDNA=SeqID_9437; Strand=-; Position=1-63
  misc_feature (7)..(19): Xaa can be any naturally occurring amino acid
IQHRGRXXXXXXXXXXXXXLL

SEQ ID NO: 29741 - protein, 89 aa, Diabrotica virgifera
  misc_feature: Coding regions on vcDNA: vcDNA=SeqID_9438; Strand=-; Position=95-364
  misc_feature (9)..(10): Xaa can be any naturally occurring amino acid
  misc_feature (16)..(16): Xaa can be any naturally occurring amino acid
  misc_feature (18)..(18): Xaa can be any naturally occurring amino acid
  misc_feature (21)..(21): Xaa can be any naturally occurring amino acid
  misc_feature (24)..(24): Xaa can be any naturally occurring amino acid
  misc_feature (28)..(28): Xaa can be any naturally occurring amino acid
  misc_feature (30)..(32): Xaa can be any naturally occurring amino acid
  misc_feature (34)..(35): Xaa can be any naturally occurring amino acid
  misc_feature (38)..(38): Xaa can be any naturally occurring amino acid
  misc_feature (40)..(40): Xaa can be any naturally occurring amino acid
  misc_feature (46)..(49): Xaa can be any naturally occurring amino acid
  misc_feature (51)..(51): Xaa can be any naturally occurring amino acid
  misc_feature (53)..(53): Xaa can be any naturally occurring amino acid
  misc_feature (55)..(55): Xaa can be any naturally occurring amino acid
  misc_feature (57)..(57): Xaa can be any naturally occurring amino acid
  misc_feature (61)..(61): Xaa can be any naturally occurring amino acid
  misc_feature (64)..(64): Xaa can be any naturally occurring amino acid
  misc_feature (68)..(70): Xaa can be any naturally occurring amino acid
  misc_feature (73)..(73): Xaa can be any naturally occurring amino acid
  misc_feature (75)..(75): Xaa can be any naturally occurring amino acid
  misc_feature (77)..(77): Xaa can be any naturally occurring amino acid
  misc_feature (86)..(88): Xaa can be any naturally occurring amino acid
FPFTHYNHXXLKTYHXHXIIXTFXIYFXHXXXYXXLKXIXIHQFIXXXXNXPXIXFXLIKXLLXSPFXXXFPXIXSXISSEIQINXXXI

SEQ ID NO: 29742 - protein, 58 aa, Diabrotica virgifera
  misc_feature: Coding regions on vcDNA: vcDNA=SeqID_9439; Strand=+; Position=405-578
DPLTTTMFTSAPPQELKPMYGEKLFPLNQRTYYYLETVISVILIKIDNTKLFQTLKQQ

SEQ ID NO: 29743 - protein, 129 aa, Diabrotica virgifera
  misc_feature: Coding regions on vcDNA: vcDNA=SeqID_9440; Strand=-; Position=2-388
  misc_feature (9)..(16): Xaa can be any naturally occurring amino acid
  misc_feature (19)..(34): Xaa can be any naturally occurring amino acid
  misc_feature (51)..(57): Xaa can be any naturally occurring amino acid
  misc_feature (63)..(90): Xaa can be any naturally occurring amino acid
  misc_feature (97)..(97): Xaa can be any naturally occurring amino acid
  misc_feature (102)..(127): Xaa can be any naturally occurring amino acid
RVFTPPEHXXXXXXXXDQXXXXXXXXXXXXXXXXYNPPRGGGPNFILDLTXXXXXXXCYPKGXXXXXXXXXXXXXXXXXXXXXXXXXXXXNHPQLNXLLYNXXXXXXXXXXXXXXXXXXXXXXXXXXFL

SEQ ID NO: 29744 - protein, 66 aa, Diabrotica virgifera; identical to SEQ ID NO: 26808
  misc_feature: Coding regions on vcDNA: vcDNA=SeqID_9441; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 29745 - protein, 274 aa, Diabrotica virgifera
  misc_feature: Coding regions on vcDNA: vcDNA=SeqID_9442; Strand=+; Position=1-821
  misc_feature: Homolog annotation: Hit_ID=XP_392800.1; Match level="QueryCoverage =100%, HitCoverage=34%, E-value=1e-117, Identity=77%"; Hit description=similar to ENSANGP00000021534 [Apis mellifera]
  misc_feature: Gene Ontology Annotation: Molecular function=molecular_function unknown; Cellular component=cellular_component unknown; Biological process=cell cycle
  misc_feature: Pfam annotation: Pfam_ID=Cullin; Match level="Score=341.4, E-value =1.3e-99, Copies=1"; Pfam description=Cullin family
  misc_feature (70)..(76): Xaa can be any naturally occurring amino acid
  misc_feature (242)..(242): Xaa can be any naturally occurring amino acid
  misc_feature (247)..(247): Xaa can be any naturally occurring amino acid
EKDKSMVQELLDFKDAMDNVVSTCFAKNEKFTNSLKEAFEHFVNQRTNKPAELIAKFVDYKLRAGNKEAXXXXXXXLLDKIMVIFRFIQGKDVFEAFYKKDLAKRLLVGKSASVDAEKSMLSKLKQECGGGFTSKLEGMFKDMELSKDINVAFKQHLSVNSRNLAPIDMSVSILTMGYWPSYQAMEVSLPYHMVKFQDVFKDFYLSKHSGRKLQFQPTLGHCVLKASFKGGKKELVVSLFQXVVILXFNDYDELSLEDIRAATNIEDGKLRRTL

SEQ ID NO: 29746 - protein, 54 aa, Diabrotica virgifera
  misc_feature: Coding regions on vcDNA: vcDNA=SeqID_9443; Strand=-; Position=0-161
  misc_feature (1)..(51): Xaa can be any naturally occurring amino acid
XXXXXXXXXXXXXXXXXXXXXXXXXXXXXXXXXXXXXXXXXXXXXXXXXXXLLL

SEQ ID NO: 29747 - protein, 270 aa, Diabrotica virgifera
  misc_feature: Coding regions on vcDNA: vcDNA=SeqID_9444; Strand=+; Position=61-873
QDFKNKRSQPRDTERRYDQRDQKRDSGFRGKRDSDRSESGRRFENGNNSDRRSFNNNSGGNRFNRSQASRNEDNRASEANVEDEEEWGSSPKDSSDDIKIQSNTQMAKESTGNAAQKRIEQIKEKPVDSEDSNVKEKPLDSDKDIDVKDSNVKEKPVDSDKDSNFEVEKNNVEPEKKLNDSVKCFFELPKPIKALKDGDQVKIIDQANNQLIVKTKECFAKGKEIVEYIKNLDKDTLLLNEVEGQMIICADGAPNLCRAGVLVDSPDIAQ

SEQ ID NO: 29748 - protein, 273 aa, Diabrotica virgifera
  misc_feature: Coding regions on vcDNA: vcDNA=SeqID_9445; Strand=+; Position=108-929
  misc_feature: Homolog annotation: Hit_ID=NP_731873.1; Match level="QueryCoverage =97%, HitCoverage=51%, E-value=1e-25, Identity=31%"; Hit description =CG3041-PA [Drosophila melanogaster] gb|AAF55006.1| CG3041-PA [Drosophila melanogaster]
  misc_feature: Gene Ontology Annotation: Molecular function=DNA replication origin binding; Cellular component=nuclear origin of replication recognition complex; Biological process=mitotic spindle assembly
  misc_feature (234)..(234): Xaa can be any naturally occurring amino acid
  misc_feature (260)..(260): Xaa can be any naturally occurring amino acid
MESSTPTRRTPRTKKPSLKALESLYSLKIQNSGIVQAIVTSDDESEDEIDLDNIDVDVNKPKVMHENEVVHGEDIFTFQKRKNSEAIAQKVAEACDLKTPKHVRTKTKSRIAKMIQEDSESEFEVSSEESESSSSSNESEDSSGSDSDEKSTKDTKNKKMIFREANLQTTKTRSRNYHIKTDEYFEKTSSKKIETSNNTLERLETPRLPQYKLQKLLHTVSHSSQHIEAIHKLXKVNESCFAKWWFFLNENFNILLYGLXSKRSIISKFPSYT

SEQ ID NO: 29749 - protein, 49 aa, Diabrotica virgifera
  misc_feature: Coding regions on vcDNA: vcDNA=SeqID_9446; Strand=+; Position=2-151
  misc_feature (1)..(20): Xaa can be any naturally occurring amino acid
XXXXXXXXXXXXXXXXXXXXIFFDYRLIYLREKSVFYWKVQSIIKMAPP

SEQ ID NO: 29750 - protein, 74 aa, Diabrotica virgifera
  misc_feature: Coding regions on vcDNA: vcDNA=SeqID_9447; Strand=+; Position=37-261
LYDPRWSQGIWIIHDLMIIFYILRREDGEDGVATIILRSSFYGTGVDPGFIGLSNLVTRYIILFNKHDVHCEEW

SEQ ID NO: 29751 - protein, 199 aa, Diabrotica virgifera
  misc_feature: Coding regions on vcDNA: vcDNA=SeqID_9448; Strand=+; Position=256-852
  misc_feature: Homolog annotation: Hit_ID=XP_311575.1; Match level="QueryCoverage =80%, HitCoverage=35%, E-value=6e-26, Identity=37%"; Hit description =ENSANGP00000016038 [Anopheles gambiae]
  misc_feature: Gene Ontology Annotation: Molecular function=sodium-dependent phosphate transporter activity; Cellular component=integral to membrane; Biological process=phosphate transport
  misc_feature (122)..(122): Xaa can be any naturally occurring amino acid
  misc_feature (138)..(138): Xaa can be any naturally occurring amino acid
MSSATPMEQFEQEDLLNKDQAGNSVSIVRNHEKFRFGRSKIPVRFWIGLMVFFTTYVNYATRVNMAISIISMTKGKSKKTPECLLDEMTNSSSATQKGLPDYGPRYDWDEHIQGIILGSYFXGYTIFSLPAGAVSELXGPARVIFWTTIVSLILNSVSVPAANGHYGLLIACRFLIGAVGGLVYPALQVLIAKWAPPAE

SEQ ID NO: 29752 - protein, 92 aa, Diabrotica virgifera
  misc_feature: Coding regions on vcDNA: vcDNA=SeqID_9449; Strand=+; Position=233-508
  misc_feature (5)..(32): Xaa can be any naturally occurring amino acid
  misc_feature (34)..(41): Xaa can be any naturally occurring amino acid
  misc_feature (44)..(51): Xaa can be any naturally occurring amino acid
NCMKXXXXXXXXXXXXXXXXXXXXXXXXXXXXEXXXXXXXXLCXXXXXXXXQYIKYLYLNMMNVFFLNHAYIYEEDIRSINEFSNICCPGNE

SEQ ID NO: 29753 - protein, 53 aa, Diabrotica virgifera
  misc_feature: Coding regions on vcDNA: vcDNA=SeqID_9450; Strand=+; Position=3-164
  misc_feature (3)..(3): Xaa can be any naturally occurring amino acid
  misc_feature (6)..(6): Xaa can be any naturally occurring amino acid
  misc_feature (14)..(15): Xaa can be any naturally occurring amino acid
LIXFFXDIEIITLXXTAYFLLEKSIDNKMSNSRLGLRVYIGCTAKFFLGFSNL

SEQ ID NO: 29754 - protein, 26 aa, Diabrotica virgifera
  misc_feature: Coding regions on vcDNA: vcDNA=SeqID_9451; Strand=-; Position=0-77
  misc_feature (1)..(24): Xaa can be any naturally occurring amino acid
XXXXXXXXXXXXXXXXXXXXXXXXPP

SEQ ID NO: 29755 - protein, 89 aa, Diabrotica virgifera
  misc_feature: Coding regions on vcDNA: vcDNA=SeqID_9452; Strand=+; Position=488-754
  misc_feature (25)..(55): Xaa can be any naturally occurring amino acid
RYGTHPRPRNRNEYTLNPLTRINWXXXXXXXXXXXXXXXXXXXXXXXXXXXXXXXVPRRWFIVRGVNWGCRGTVLPGGLNSEGEVPSSF

SEQ ID NO: 29756 - protein, 57 aa, Diabrotica virgifera
  misc_feature: Coding regions on vcDNA: vcDNA=SeqID_9453; Strand=+; Position=2-175
  misc_feature (10)..(26): Xaa can be any naturally occurring amino acid
  misc_feature (32)..(42): Xaa can be any naturally occurring amino acid
KFCYENLINXXXXXXXXXXXXXXXXXSNQKVXXXXXXXXXXXNILTNTTKNKGGHFK

SEQ ID NO: 29757 - protein, 58 aa, Diabrotica virgifera
  misc_feature: Coding regions on vcDNA: vcDNA=SeqID_9454; Strand=-; Position=1-174
  misc_feature (8)..(58): Xaa can be any naturally occurring amino acid
IKKLIKKXXXXXXXXXXXXXXXXXXXXXXXXXXXXXXXXXXXXXXXXXXXXXXXXXXX

SEQ ID NO: 29758 - protein, 41 aa, Diabrotica virgifera
  misc_feature: Coding regions on vcDNA: vcDNA=SeqID_9455; Strand=-; Position=30-155
  misc_feature (3)..(20): Xaa can be any naturally occurring amino acid
LLXXXXXXXXXXXXXXXXXXSSFNKKLMICYLARSNTRPSN

SEQ ID NO: 29759 - protein, 227 aa, Diabrotica virgifera
  misc_feature: Coding regions on vcDNA: vcDNA=SeqID_9456; Strand=+; Position=16-699
  misc_feature: Homolog annotation: Hit_ID=NP_649507.1; Match level="QueryCoverage =97%, HitCoverage=92%, E-value=1e-38, Identity=38%"; Hit description =CG14661-PA [Drosophila melanogaster] gb|AAF52078.2| CG14661-PA [Drosophila melanogaster]
  misc_feature: Gene Ontology Annotation: Molecular function=molecular_function unknown; Cellular component=cellular_component unknown; Biological process=circadian rhythm
  misc_feature: Pfam annotation: Pfam_ID=DUF233; Match level="Score=48.5, E-value=2e -11, Copies=1"; Pfam description=Odorant binding protein
MFVKVAVLVFCLVCLADGKLPSYFKVCKRSDPNLDKCVTDSVMTLKPQLAKGIPELEIPPLEPFDLDTIVLKSGNAGVRIDANFSKLIATGASGFEVYDIKCDIPKNVFLFKLKIPHLEFNGDYDIDMNVLVLKYKGSGPISGNFTDLDVQVRLKGHIKKIDGKNYQTFEKILILLKVGGSHLKLGNLFLNQKGLGDATNQVVNDNARPALVDSLSDKFTLIANKSV

SEQ ID NO: 29760 - protein, 76 aa, Diabrotica virgifera
  misc_feature: Coding regions on vcDNA: vcDNA=SeqID_9457; Strand=-; Position=589-819
  misc_feature (12)..(20): Xaa can be any naturally occurring amino acid
  misc_feature (28)..(28): Xaa can be any naturally occurring amino acid
  misc_feature (52)..(52): Xaa can be any naturally occurring amino acid
RLDIRNKQNKTXXXXXXXXXRTNPEIDXNGAVFLKRPKLKQKGLSNNDHDIXRNNRQKIKHNKSRYSIMYSHAKYC

SEQ ID NO: 29761 - protein, 44 aa, Diabrotica virgifera
  misc_feature: Coding regions on vcDNA: vcDNA=SeqID_9458; Strand=-; Position=1-132
  misc_feature (1)..(8): Xaa can be any naturally occurring amino acid
  misc_feature (10)..(18): Xaa can be any naturally occurring amino acid
  misc_feature (21)..(21): Xaa can be any naturally occurring amino acid
  misc_feature (35)..(35): Xaa can be any naturally occurring amino acid
XXXXXXXXSXXXXXXXXXPIXNLIQHRGRNLYYRXELSNKITLL

SEQ ID NO: 29762 - protein, 92 aa, Diabrotica virgifera
  misc_feature: Coding regions on vcDNA: vcDNA=SeqID_9459; Strand=+; Position=1-276
  misc_feature (1)..(55): Xaa can be any naturally occurring amino acid
  misc_feature (71)..(85): Xaa can be any naturally occurring amino acid
XXXXXXXXXXXXXXXXXXXXXXXXXXXXXXXXXXXXXXXXXXXXXXXXXXXXXXXRGGEPPPKVGGGSPGXXXXXXXXXXXXXXXRKKGKGG

SEQ ID NO: 29763 - protein, 239 aa, Diabrotica virgifera
  misc_feature: Coding regions on vcDNA: vcDNA=SeqID_9460; Strand=-; Position=1-717
  misc_feature (3)..(13): Xaa can be any naturally occurring amino acid
  misc_feature (23)..(31): Xaa can be any naturally occurring amino acid
  misc_feature (33)..(46): Xaa can be any naturally occurring amino acid
  misc_feature (53)..(65): Xaa can be any naturally occurring amino acid
  misc_feature (67)..(239): Xaa can be any naturally occurring amino acid
SFXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29764 - protein, 31 aa, Diabrotica virgifera
  misc_feature: Coding regions on vcDNA: vcDNA=SeqID_9461; Strand=-; Position=0-92
  misc_feature (3)..(15): Xaa can be any naturally occurring amino acid
  misc_feature (17)..(28): Xaa can be any naturally occurring amino acid
SLXXXXXXXXXXXXXIXXXXXXXXXXXXNPS

SEQ ID NO: 29765 - protein, 41 aa, Diabrotica virgifera
  misc_feature: Coding regions on vcDNA: vcDNA=SeqID_9462; Strand=-; Position=11-136
PLDVEKVYRGLIRSYWRHLLISHLKVKSLSPSMRKAVLPCR

SEQ ID NO: 29766 - protein, 35 aa, Diabrotica virgifera
  misc_feature: Coding regions on vcDNA: vcDNA=SeqID_9463; Strand=-; Position=1-105
  misc_feature (1)..(1): Xaa can be any naturally occurring amino acid
  misc_feature (3)..(34): Xaa can be any naturally occurring amino acid
XIXXXXXXXXXXXXXXXXXXXXXXXXXXXXXXXXS

SEQ ID NO: 29767 - protein, 107 aa, Diabrotica virgifera
  misc_feature: Coding regions on vcDNA: vcDNA=SeqID_9464; Strand=+; Position=19-342
  misc_feature (3)..(46): Xaa can be any naturally occurring amino acid
  misc_feature (48)..(48): Xaa can be any naturally occurring amino acid
  misc_feature (88)..(94): Xaa can be any naturally occurring amino acid
  misc_feature (97)..(104): Xaa can be any naturally occurring amino acid
RRXXXXXXXXXXXXXXXXXXXXXXXXXXXXXXXXXXXXXXXXXXXXPXFFDIGINNLGIQRIFYWRSQSKIRFGPPMVGVKILNLGEXXXXXXXWGXXXXXXXXLGV

SEQ ID NO: 29768 - protein, 101 aa, Diabrotica virgifera; identical to SEQ ID NO: 29675
  misc_feature: Coding regions on vcDNA: vcDNA=SeqID_9465; Strand=-; Position=159-464
  misc_feature (2)..(20): Xaa can be any naturally occurring amino acid
  misc_feature (23)..(29): Xaa can be any naturally occurring amino acid
  misc_feature (35)..(56): Xaa can be any naturally occurring amino acid
  misc_feature (58)..(82): Xaa can be any naturally occurring amino acid

SEQ ID NO: 29769 - protein, 17 aa, Diabrotica virgifera
  misc_feature: Coding regions on vcDNA: vcDNA=SeqID_9466; Strand=-; Position=1-51
  misc_feature (1)..(17): Xaa can be any naturally occurring amino acid
XXXXXXXXXXXXXXXXX

SEQ ID NO: 29770 - protein, 218 aa, Diabrotica virgifera
  misc_feature: Coding regions on vcDNA: vcDNA=SeqID_9467; Strand=+; Position=116-771
  misc_feature: Homolog annotation: Hit_ID=EAL33543.1; Match level="QueryCoverage =97%, HitCoverage=61%, E-value=2e-68, Identity=53%"; Hit description =GA17451-PA [Drosophila pseudoobscura]
  misc_feature: Gene Ontology Annotation: Molecular function=pre-mRNA splicing factor activity; Cellular component=snRNP U5; Biological process=mRNA splicing
  misc_feature: Pfam annotation: Pfam_ID=WD40; Match level="Score=123.8, E-value=4.2e- 34, Copies=4"; Pfam description=WD domain, G-beta repeat
  misc_feature (175)..(175): Xaa can be any naturally occurring amino acid
  misc_feature (208)..(208): Xaa can be any naturally occurring amino acid
MVIENKRRADDAALVPVSKKQRNEIVQRNKNTSVLQATAPRTSNLFAPIMQLEGHEGEIFSVDFHPEGQYLASTGFDRKIFLWAVYGECENISVMTGHTGAVTEMHFNTDGSQIFTSSTDHTLGLWDVATSQRIKKYKGHTTFVNCVQGARRGPQLMCSGGDDNTVKLWDTRKKXNVGSINTPYQNTAVSFSDTTEEIFSGGIDNEIXVWDMRTYELL

SEQ ID NO: 29771 - protein, 121 aa, Diabrotica virgifera
  misc_feature: Coding regions on vcDNA: vcDNA=SeqID_9468; Strand=-; Position=2-364
  misc_feature (30)..(53): Xaa can be any naturally occurring amino acid
  misc_feature (55)..(87): Xaa can be any naturally occurring amino acid
  misc_feature (89)..(120): Xaa can be any naturally occurring amino acid
TLIHPRGPQSYYRLNSPIKIRRYPKVIYSXXXXXXXXXXXXXXXXXXXXXXXXRXXXXXXXXXXXXXXXXXXXXXXXXXXXXXXXXXAXXXXXXXXXXXXXXXXXXXXXXXXXXXXXXXXI

SEQ ID NO: 29772 - protein, 47 aa, Diabrotica virgifera
  misc_feature: Coding regions on vcDNA: vcDNA=SeqID_9469; Strand=+; Position=97-237
  misc_feature (32)..(41): Xaa can be any naturally occurring amino acid
KNGGTLAWVGFKSFYNWGGTGLIFYFKVWVSXXXXXXXXXXIWEFLK

SEQ ID NO: 29773 - protein, 144 aa, Diabrotica virgifera
  misc_feature: Coding regions on vcDNA: vcDNA=SeqID_9470; Strand=+; Position=168-602
  misc_feature (101)..(116): Xaa can be any naturally occurring amino acid
LVGACLRKQNRFGANLRFCSGGGCHPLSGVKTILLKIATLIDRGTNFKQNLLYQIIKDQKFEFFLKQTRFFINNSKTVSFNKIVMITKIEGNKKSNRFFTXXXXXXXXXXXXXXXXIYFFQLVLKSKYSSLNNGKTMHFVKYTY

SEQ ID NO: 29774 - protein, 125 aa, Diabrotica virgifera
  misc_feature: Coding regions on vcDNA: vcDNA=SeqID_9471; Strand=-; Position=1-375
  misc_feature (1)..(7): Xaa can be any naturally occurring amino acid
  misc_feature (13)..(23): Xaa can be any naturally occurring amino acid
  misc_feature (25)..(71): Xaa can be any naturally occurring amino acid
  misc_feature (77)..(125): Xaa can be any naturally occurring amino acid
XXXXXXXPLPPKXXXXXXXXXXXWXXXXXXXXXXXXXXXXXXXXXXXXXXXXXXXXXXXXXXXXXXXXXXXYRVFSXXXXXXXXXXXXXXXXXXXXXXXXXXXXXXXXXXXXXXXXXXXXXXXXX

SEQ ID NO: 29775 - protein, 65 aa, Diabrotica virgifera
  misc_feature: Coding regions on vcDNA: vcDNA=SeqID_9472; Strand=+; Position=148-342
MINYILSFNNAHGSGGIFYVVHRKMQGVFVETIQMDSKEYGVSRNIVGILIIKTSLHQKETLIWD

SEQ ID NO: 29776 - protein, 55 aa, Diabrotica virgifera
  misc_feature: Coding regions on vcDNA: vcDNA=SeqID_9473; Strand=+; Position=168-335
DVYKFLSVSYLYKILTVGNVVSFSICPTSIVWRAWIYNKDYKFTLSFVITHIHWW

SEQ ID NO: 29777 - protein, 62 aa, Diabrotica virgifera
  misc_feature: Coding regions on vcDNA: vcDNA=SeqID_9474; Strand=-; Position=305-493
ISSESKIGVIAFSYTNGLPTKGAPRRLGLLQLGIWPETRYSIMKRFSLKRSFLMSHTIGKMS

SEQ ID NO: 29778 - protein, 18 aa, Diabrotica virgifera
  misc_feature: Coding regions on vcDNA: vcDNA=SeqID_9475; Strand=-; Position=0-53
  misc_feature (1)..(7): Xaa can be any naturally occurring amino acid
XXXXXXXIMITLARSKSP

SEQ ID NO: 29779 - protein, 194 aa, Diabrotica virgifera
  misc_feature: Coding regions on vcDNA: vcDNA=SeqID_9476; Strand=+; Position=132-716
  misc_feature: Homolog annotation: Hit_ID=XP_395779.1; Match level="QueryCoverage =91%, HitCoverage=85%, E-value=6e-57, Identity=53%"; Hit description =similar to RIKEN cDNA 1110060O18 [Apis mellifera]
  misc_feature: Gene Ontology Annotation: Molecular function=molecular_function unknown
  misc_feature: Pfam annotation: Pfam_ID=zf-AN1; Match level="Score=55.9, E-value =1.1e-13, Copies=2"; Pfam description=AN1-like Zinc finger
YLILLKCFYCEKLLFVYLFKMEFPHLGKHCSKSDCGKLDFLPIKCDACKQLFCEEHFSYNTHSCPYAYQKDNQVPACPLCSRPIPVGKGEHPDFVVGAHIDNDCQSDPAKNRRSKVFTNRCSYNKCKTKELLPFVCQDCSKNFCIKHRHPSDHICEGKKSKISSRNTHMQTMISEDEALARALALSMHDNAPME

SEQ ID NO: 29780 - protein, 244 aa, Diabrotica virgifera
  misc_feature: Coding regions on vcDNA: vcDNA=SeqID_9477; Strand=-; Position=0-731
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(237): Xaa can be any naturally occurring amino acid
  misc_feature (239)..(243): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXV

SEQ ID NO: 29781 - protein, 253 aa, Diabrotica virgifera
  misc_feature: Coding regions on vcDNA: vcDNA=SeqID_9478; Strand=+; Position=49-807
  misc_feature: Pfam annotation: Pfam_ID=zf-C2H2; Match level="Score=21.0, E-value =0.0036, Copies=2"; Pfam description=Zinc finger, C2H2 type
  misc_feature (210)..(210): Xaa can be any naturally occurring amino acid
EFLFYTIICLTSMFYCKDCNLKPFSSQSALVTHRNAVHGAVRVQTYPIDVHANKCLDGCLISFPTVKDLRQHLARIHKILTGQEIFEFDDKDEFLKWMENINRDPRRKYIKTCELQDNEYLLVTHYDCKPIKDSISNDEDSDNSYAIQEDGESPSCTSQILVVNNLRTNLIVVTFFKNHYGHTKDMGHLEKPVSYVCRKSLSCVSKNLLXTPAQLPVRVTNAGDELVETDRRKTQFSEFNPQHKKRKKRMVQV

SEQ ID NO: 29782 - protein, 81 aa, Diabrotica virgifera
  misc_feature: Coding regions on vcDNA: vcDNA=SeqID_9479; Strand=-; Position=751-996
  misc_feature (2)..(12): Xaa can be any naturally occurring amino acid
  misc_feature (16)..(22): Xaa can be any naturally occurring amino acid
  misc_feature (46)..(53): Xaa can be any naturally occurring amino acid
RXXXXXXXXXXXIFPXXXXXXXGIFGYVTTPFNNPAGVDGDCMFFXXXXXXXXSRFGSDFDIGGLQECIIRWYISLAIVTH

SEQ ID NO: 29783 - protein, 64 aa, Diabrotica virgifera
  misc_feature: Coding regions on vcDNA: vcDNA=SeqID_9480; Strand=+; Position=1-192
  misc_feature (6)..(12): Xaa can be any naturally occurring amino acid
  misc_feature (16)..(52): Xaa can be any naturally occurring amino acid
  misc_feature (54)..(63): Xaa can be any naturally occurring amino acid
NPYMRXXXXXXXVFLXXXXXXXXXXXXXXXXXXXXXXXXXXXXXXXXXXXXXSXXXXXXXXXXP

SEQ ID NO: 29784 - protein, 44 aa, Diabrotica virgifera
  misc_feature: Coding regions on vcDNA: vcDNA=SeqID_9481; Strand=-; Position=0-131
  misc_feature (1)..(14): Xaa can be any naturally occurring amino acid
  misc_feature (16)..(32): Xaa can be any naturally occurring amino acid
  misc_feature (34)..(42): Xaa can be any naturally occurring amino acid
XXXXXXXXXXXXXXPXXXXXXXXXXXXXXXXXPXXXXXXXXXRG

SEQ ID NO: 29785 - protein, 57 aa, Diabrotica virgifera
  misc_feature: Coding regions on vcDNA: vcDNA=SeqID_9482; Strand=-; Position=1-171
  misc_feature (28)..(57): Xaa can be any naturally occurring amino acid
SPPLGGPNFFYWDLGLSQKKFPRLSLKXXXXXXXXXXXXXXXXXXXXXXXXXXXXXX

SEQ ID NO: 29786 - protein, 238 aa, Diabrotica virgifera
  misc_feature: Coding regions on vcDNA: vcDNA=SeqID_9483; Strand=+; Position=37-753
  misc_feature: Homolog annotation: Hit_ID=XP_312588.1; Match level="QueryCoverage =61%, HitCoverage=24%, E-value=6e-09, Identity=33%"; Hit description =ENSANGP00000014942 [Anopheles gambiae]
  misc_feature (134)..(143): Xaa can be any naturally occurring amino acid
ELESSYGPPPQKALSDSYGAPLNTVTGSGGVVSASGEEAHGHGQHDLSHHDHQSNVNIGFSASIGYEIFPNGAATILGGQPSGSYKPPVQSGNSYASGHSYSTSFGSSQHSHGSFSSHRGSGYKGLSFSSSGIXXXXXXXXXXAPSGSYGTPLFSGPKLGPPKHSNAGFLTNTFGSNGHSAISYQNVNHGTSSGTTSYHAPLNIVDGSYNQHQTGPLQGGNLYSSSQSHGSSPFKWWE

SEQ ID NO: 29787 - protein, 170 aa, Diabrotica virgifera
  misc_feature: Coding regions on vcDNA: vcDNA=SeqID_9484; Strand=+; Position=11-523
  misc_feature (76)..(83): Xaa can be any naturally occurring amino acid
RRMFTKLVVLFFLYTFVSARTPCRIYESVNKENIRNCLQTRLGDVNETRFTVPNTNETTFSISNLNFKISNNTLNXXXXXXXXRIGRKMKQSTANLLQYALVPAFFMSGMMPWIMPKIQMMVMMLSMMNNMMFSSALFTMIRNYVFEKTPNEHVVYVNNGFKNRIHTRYS

SEQ ID NO: 29788 - protein, 227 aa, Diabrotica virgifera
  misc_feature: Coding regions on vcDNA: vcDNA=SeqID_9485; Strand=+; Position=2-685
  misc_feature (5)..(15): Xaa can be any naturally occurring amino acid
  misc_feature (19)..(197): Xaa can be any naturally occurring amino acid
SPRAXXXXXXXXXXXSGKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVNKGIPQLFFPRLIKNCLFGLNIKDPLAPG

SEQ ID NO: 29789 - protein, 45 aa, Diabrotica virgifera
  misc_feature: Coding regions on vcDNA: vcDNA=SeqID_9486; Strand=+; Position=2-139
  misc_feature (17)..(18): Xaa can be any naturally occurring amino acid
NCWVVDCPPTVYLCSFXXFQVATQLVSLLLLHNILSVLWASAMID

SEQ ID NO: 29790 - protein, 46 aa, Diabrotica virgifera
  misc_feature: Coding regions on vcDNA: vcDNA=SeqID_9487; Strand=+; Position=2-142
  misc_feature (1)..(12): Xaa can be any naturally occurring amino acid
  misc_feature (15)..(15): Xaa can be any naturally occurring amino acid
XXXXXXXXXXXXTLXDTAYFYLESQIDNKDADLDVWIKFIIGVAVY

SEQ ID NO: 29791 - protein, 77 aa, Diabrotica virgifera
  misc_feature: Coding regions on vcDNA: vcDNA=SeqID_9488; Strand=+; Position=296-529
  misc_feature (12)..(23): Xaa can be any naturally occurring amino acid
FQQNQYIYFKQXXXXXXXXXXXXLERTKRIPKKNALSGIRTWDLPISRRMLYRRATEVTHTYDYFSVIIMTIAVTHR

SEQ ID NO: 29792 - protein, 260 aa, Diabrotica virgifera
  misc_feature: Coding regions on vcDNA: vcDNA=SeqID_9489; Strand=+; Position=79-861
  misc_feature (42)..(68): Xaa can be any naturally occurring amino acid
IFKKFAVCSDSIRNRTIRESRMVLFSTRSEMDDTMPQTVPSXXXXXXXXXXXXXXXXXXXXXXXXXXXVSPSTQFYPQSYETEKLLQPKILTSFYPSPRSDPESDLEQLAPDFQTLLVPTDTKKYSGNIYLEVPSPYSPISQGLLSPNDQFSSYRETNYYPSSPEQSVYTPSPSSVYSTSPCGEEYLQKHYIKKETSPVPNFAQFSVKEESYILPTSPASYTSNSSDNLCIQIDKFECPRSAQNSRKSKRDLKRAADPFW

SEQ ID NO: 29793 - protein, 274 aa, Diabrotica virgifera
  misc_feature: Coding regions on vcDNA: vcDNA=SeqID_9490; Strand=+; Position=3-827
  misc_feature: Homolog annotation: Hit_ID=NP_503526.1; Match level="QueryCoverage =92%, HitCoverage=64%, E-value=7e-41, Identity=35%"; Hit description =predicted CDS, reverse transcriptase family member (5C378) [Caenorhabditis elegans]
RLEWEEKGIKICGQRLNHLRYADVIVLITDKKEELFEMMKELDIEAGKIGLNMNYSKTKIITNTDEDITMRIGQDEIEQVHDYIYLGQIIKLNKENQTAEIKRRVRLAWAAFGKLSYILKNKRYPQHLKTKVYNQCVLPVLTYGSQTWTFTKANMDKIIKTQRGMERQMLHIKLLDKKRNEWIREKTKVRDVRQEVAKLKWRFAGHTIRQKEDRWNKILINWRPWQYKRSRGRPQMRWADDVKKHVGSRWITVATDREEWKRIGEAYVRWTEEG

SEQ ID NO: 29794 - protein, 231 aa, Diabrotica virgifera
  misc_feature: Coding regions on vcDNA: vcDNA=SeqID_9491; Strand=-; Position=21-716
  misc_feature (12)..(19): Xaa can be any naturally occurring amino acid
  misc_feature (30)..(37): Xaa can be any naturally occurring amino acid
  misc_feature (40)..(53): Xaa can be any naturally occurring amino acid
  misc_feature (59)..(72): Xaa can be any naturally occurring amino acid
  misc_feature (74)..(224): Xaa can be any naturally occurring amino acid
  misc_feature (231)..(231): Xaa can be any naturally occurring amino acid
LCYIFGPFRTKXXXXXXXXNQPGLHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEYPIFSX

SEQ ID NO: 29795 - protein, 74 aa, Diabrotica virgifera
  misc_feature: Coding regions on vcDNA: vcDNA=SeqID_9492; Strand=-; Position=589-813
GGSRYSTFMALPIFISELQGVLSILPIFFWTHNSRTTLYIFLTFGTHVSLQTQTIELLITRKCRSGLKKIINSF

SEQ ID NO: 29796 - protein, 230 aa, Diabrotica virgifera
  misc_feature: Coding regions on vcDNA: vcDNA=SeqID_9493; Strand=-; Position=180-872
  misc_feature (4)..(4): Xaa can be any naturally occurring amino acid
  misc_feature (6)..(6): Xaa can be any naturally occurring amino acid
DIKXGXTDIPRHVCCPENKNIENKYKQPIQSDVNNIQGNSKIITNELNAQIMEIQTKQTCEYITNLTVKNEESTKMNLNYITMGSSENKTNDEGYQIVTKRRKKIMGTGIGDKDFHGKSEKPDKKLWLFISKVPDSVNADHIKSFIITETNCEDIQVKLLPTEKKRRDNQCFMIGVLPDLREEIYNPAFWPKKIGIERFNFRLGRRFLDREHHNRGLSTGEDRPDSFLVK

SEQ ID NO: 29797 - protein, 18 aa, Diabrotica virgifera
  misc_feature: Coding regions on vcDNA: vcDNA=SeqID_9494; Strand=+; Position=1-54
  misc_feature (2)..(2): Xaa can be any naturally occurring amino acid
  misc_feature (4)..(18): Xaa can be any naturally occurring amino acid
IXLXXXXXXXXXXXXXXX

SEQ ID NO: 29798 - protein, 82 aa, Diabrotica virgifera
  misc_feature: Coding regions on vcDNA: vcDNA=SeqID_9495; Strand=-; Position=258-506
  misc_feature (9)..(9): Xaa can be any naturally occurring amino acid
  misc_feature (12)..(12): Xaa can be any naturally occurring amino acid
  misc_feature (14)..(14): Xaa can be any naturally occurring amino acid
  misc_feature (19)..(19): Xaa can be any naturally occurring amino acid
  misc_feature (25)..(26): Xaa can be any naturally occurring amino acid
  misc_feature (28)..(28): Xaa can be any naturally occurring amino acid
  misc_feature (30)..(33): Xaa can be any naturally occurring amino acid
  misc_feature (35)..(35): Xaa can be any naturally occurring amino acid
  misc_feature (43)..(44): Xaa can be any naturally occurring amino acid
  misc_feature (46)..(50): Xaa can be any naturally occurring amino acid
  misc_feature (53)..(55): Xaa can be any naturally occurring amino acid
  misc_feature (57)..(57): Xaa can be any naturally occurring amino acid
  misc_feature (59)..(61): Xaa can be any naturally occurring amino acid
  misc_feature (65)..(68): Xaa can be any naturally occurring amino acid
  misc_feature (70)..(70): Xaa can be any naturally occurring amino acid
  misc_feature (74)..(74): Xaa can be any naturally occurring amino acid
  misc_feature (77)..(77): Xaa can be any naturally occurring amino acid
  misc_feature (80)..(80): Xaa can be any naturally occurring amino acid
  misc_feature (82)..(82): Xaa can be any naturally occurring amino acid
KYLYYNQIXSLXIXPIHTXKLPIKXXLXRXXXXPXFFNLYSKXXFXXXXXHKXXXIXLXXXLINXXXXIXLFSXKIXSPXIX

SEQ ID NO: 29799 - protein, 124 aa, Diabrotica virgifera
  misc_feature: Coding regions on vcDNA: vcDNA=SeqID_9496; Strand=-; Position=268-642
  misc_feature: Homolog annotation: Hit_ID=S36442; Match level="QueryCoverage=64%, HitCoverage=56%, E-value=1e-12, Identity=50%"; Hit description =reverse transcriptase-like protein - bovine (fragment)
QLIDNVIKKGIKCKHFIHDKLIGGLQEVGIDDEDLGIIKNLYWHPCANIPVGQNTTDAVEIQRGVRQGCIILPLLFNIYSKFIFKEALDEDASIKINGINVNHLSYEDDTVLIASKEFNDLQTG

SEQ ID NO: 29800 - protein, 167 aa, Diabrotica virgifera
  misc_feature: Coding regions on vcDNA: vcDNA=SeqID_9497; Strand=+; Position=3-506
SLGRGNFKRSLSYVYLKKEIESLMPIREKIEPANEDRKMCSVRKHSKSFRHFPKIVVHPPDETNLSSSMPNIHTFVHNDMNDLMINHVFDQNASCPDLTDDRYFTNDNTSIDTDDVFESFDEFAENISVCSESCIPDINFKDFGETHTRKYNSLAEARNFFVIEPGK

SEQ ID NO: 29801 - protein, 156 aa, Diabrotica virgifera
  misc_feature: Coding regions on vcDNA: vcDNA=SeqID_9498; Strand=+; Position=74-541
  misc_feature: Homolog annotation: Hit_ID=BAA04178.1; Match level="QueryCoverage =81%, HitCoverage=24%, E-value=6e-16, Identity=37%"; Hit description =H(+)-transporting ATPase beta subunit [Hemicentrotus pulcherrimus] sp|Q25117|ATPB_HEMPU ATP synthase beta
  misc_feature: Gene Ontology Annotation: Molecular function=transporter activity; Cellular component=proton-transporting ATP synthase, catalytic core (sensu Eukarya); Biological process=energy pathways
  misc_feature (24)..(26): Xaa can be any naturally occurring amino acid
  misc_feature (28)..(28): Xaa can be any naturally occurring amino acid
  misc_feature (31)..(31): Xaa can be any naturally occurring amino acid
  misc_feature (37)..(38): Xaa can be any naturally occurring amino acid
  misc_feature (40)..(41): Xaa can be any naturally occurring amino acid
  misc_feature (44)..(45): Xaa can be any naturally occurring amino acid
  misc_feature (49)..(49): Xaa can be any naturally occurring amino acid
  misc_feature (53)..(53): Xaa can be any naturally occurring amino acid
  misc_feature (56)..(57): Xaa can be any naturally occurring amino acid
  misc_feature (60)..(60): Xaa can be any naturally occurring amino acid
  misc_feature (62)..(62): Xaa can be any naturally occurring amino acid
  misc_feature (65)..(65): Xaa can be any naturally occurring amino acid
  misc_feature (67)..(67): Xaa can be any naturally occurring amino acid
  misc_feature (70)..(71): Xaa can be any naturally occurring amino acid
  misc_feature (76)..(77): Xaa can be any naturally occurring amino acid
  misc_feature (82)..(87): Xaa can be any naturally occurring amino acid
  misc_feature (96)..(96): Xaa can be any naturally occurring amino acid
  misc_feature (99)..(99): Xaa can be any naturally occurring amino acid
  misc_feature (104)..(104): Xaa can be any naturally occurring amino acid
  misc_feature (106)..(108): Xaa can be any naturally occurring amino acid
  misc_feature (110)..(111): Xaa can be any naturally occurring amino acid
  misc_feature (119)..(119): Xaa can be any naturally occurring amino acid
  misc_feature (123)..(123): Xaa can be any naturally occurring amino acid
  misc_feature (125)..(126): Xaa can be any naturally occurring amino acid
  misc_feature (130)..(130): Xaa can be any naturally occurring amino acid
  misc_feature (133)..(133): Xaa can be any naturally occurring amino acid
LQGSALVGWGGPCEKGGEKKKRDXXXKXAAXKAQGKXXAXXGAXXDAQXEEEXPPXXKAXEXQNXQXRRXXEAAQXXGENTXXXXXXEGTEGTGRXQQXNDTGXPXXXPXXEATQGRNXNGKXEXXDERXPKXTDKRATTHRRSPGKPRQERKAKK

SEQ ID NO: 29802 - protein, 155 aa, Diabrotica virgifera
  misc_feature: Coding regions on vcDNA: vcDNA=SeqID_9499; Strand=-; Position=439-907
  misc_feature: Homolog annotation: Hit_ID=ZP_00352682.1; Match level="QueryCoverage =87%, HitCoverage=17%, E-value=3e-09, Identity=34%"; Hit description =hypothetical protein Krad07004237 [Kineococcus radiotolerans SRS30216]
  misc_feature (75)..(83): Xaa can be any naturally occurring amino acid
RGGTRGEPRGGGGEPPVREESPEEGSQGGGGGPGGRRGRRHGRECNDKTARRGRKGRRRGGGAFPGPGDRGGARXXXXXXXXXGGRKPGEGPAGRRGQVGGKARAAAQLPGNEASERIHIQREGTRGEGRASAPAPLREWALFSTVSSRTGQSYG

SEQ ID NO: 29803 - protein, 168 aa, Diabrotica virgifera
  misc_feature: Coding regions on vcDNA: vcDNA=SeqID_9500; Strand=+; Position=2-508
  misc_feature: Homolog annotation: Hit_ID=XP_314345.1; Match level="QueryCoverage =83%, HitCoverage=26%, E-value=5e-48, Identity=62%"; Hit description =ENSANGP00000012656 [Anopheles gambiae]
  misc_feature: Gene Ontology Annotation: Molecular function=receptor activity; Cellular component=plasma membrane; Biological process=apoptosis
SPSYVRSPVLLSFPHFYLADDKYRTALEGVSPPDPEKHAFYMDVQPEMGSAMSAKARIQINLAVSQVIDIKQVATFPDIIFPILWFEEGLDSLPAEMTGLMKIATTVPPIAKIVISVSLFVIGIVLLIIAIWRLLRGANRLSSLHLAPGHVGQSIKTKDVPMANVPKY

SEQ ID NO: 29804 - protein, 108 aa, Diabrotica virgifera
  misc_feature: Coding regions on vcDNA: vcDNA=SeqID_9501; Strand=+; Position=3-327
  misc_feature: Homolog annotation: Hit_ID=ZP_00267103.1; Match level="QueryCoverage =86%, HitCoverage=29%, E-value=3e-25, Identity=60%"; Hit description =COG3712: Fe2+-dicitrate sensor, membrane component [Pseudomonas fluorescens PfO-1]
  misc_feature: Pfam annotation: Pfam_ID=FecR; Match level="Score=95.3, E-value=1.6e -25, Copies=1"; Pfam description=FecR protein
  misc_feature (3)..(3): Xaa can be any naturally occurring amino acid
  misc_feature (70)..(70): Xaa can be any naturally occurring amino acid
GWXGDTGELPTGTGERKLFTLDDGSLLTLNAQSRAIARFDAHQRVLELREGELLVDVVKDPVRPFVAQTXHGQIRALGTRFMEQRDEASIHLVDAAFASVSGHSGRRA

SEQ ID NO: 29805 - protein, 88 aa, Diabrotica virgifera
  misc_feature: Coding regions on vcDNA: vcDNA=SeqID_9502; Strand=-; Position=910-1176
  misc_feature (13)..(21): Xaa can be any naturally occurring amino acid
  misc_feature (34)..(42): Xaa can be any naturally occurring amino acid
  misc_feature (44)..(55): Xaa can be any naturally occurring amino acid
KKPLLGFFGIKPXXXXXXXXXRRFKFLGFFEILXXXXXXXXXLXXXXXXXXXXXXYLRMGHFPEKDSYFEDGIRTKKILFFENSKLFP

SEQ ID NO: 29806 - protein, 139 aa, Diabrotica virgifera
  misc_feature: Coding regions on vcDNA: vcDNA=SeqID_9503; Strand=+; Position=58-477
  misc_feature: Homolog annotation: Hit_ID=NP_609786.2; Match level="QueryCoverage =57%, HitCoverage=19%, E-value=6e-13, Identity=41%"; Hit description =CG17328-PA [Drosophila melanogaster] gb|AAF53516.2| CG17328-PA [Drosophila melanogaster]
  misc_feature: Pfam annotation: Pfam_ID=zf-AD; Match level="Score=87.8, E-value=2.8e- 23, Copies=1"; Pfam description=Zinc-finger associated domain (zf-AD)
DSNDLLNYYLSMNINNICRICLEIGPKLMPIFDPVKPAHFSILIMACAAVQVLQGDGLPPYICQKCLSKLNIAFQFKKQCESSDAKLRQCFEHFHNLPPTPDFTGFIELKKDNHTEDTFREKNDGGTNNITHIETQNNL

SEQ ID NO: 29807 - protein, 95 aa, Diabrotica virgifera
  misc_feature: Coding regions on vcDNA: vcDNA=SeqID_9504; Strand=-; Position=254-541
  misc_feature (44)..(44): Xaa can be any naturally occurring amino acid
  misc_feature (49)..(49): Xaa can be any naturally occurring amino acid
  misc_feature (59)..(59): Xaa can be any naturally occurring amino acid
  misc_feature (62)..(70): Xaa can be any naturally occurring amino acid
  misc_feature (79)..(79): Xaa can be any naturally occurring amino acid
  misc_feature (83)..(83): Xaa can be any naturally occurring amino acid
  misc_feature (89)..(89): Xaa can be any naturally occurring amino acid
IMTLSFLHQISQLNTYPSLSFLTNFLIYISFYHQFFHHQLESFXLIIFXLPSLLPTITXTYXXXXXXXXXLTLKIHSLXISFXSNPSLXFSPYKS

SEQ ID NO: 29808 - protein, 72 aa, Diabrotica virgifera
  misc_feature: Coding regions on vcDNA: vcDNA=SeqID_9505; Strand=-; Position=2-217
  misc_feature (7)..(7): Xaa can be any naturally occurring amino acid
  misc_feature (13)..(14): Xaa can be any naturally occurring amino acid
  misc_feature (16)..(16): Xaa can be any naturally occurring amino acid
  misc_feature (21)..(21): Xaa can be any naturally occurring amino acid
  misc_feature (27)..(29): Xaa can be any naturally occurring amino acid
  misc_feature (35)..(35): Xaa can be any naturally occurring amino acid
  misc_feature (37)..(37): Xaa can be any naturally occurring amino acid
  misc_feature (39)..(39): Xaa can be any naturally occurring amino acid
  misc_feature (41)..(41): Xaa can be any naturally occurring amino acid
  misc_feature (44)..(44): Xaa can be any naturally occurring amino acid
  misc_feature (46)..(48): Xaa can be any naturally occurring amino acid
  misc_feature (50)..(51): Xaa can be any naturally occurring amino acid
  misc_feature (53)..(56): Xaa can be any naturally occurring amino acid
  misc_feature (59)..(68): Xaa can be any naturally occurring amino acid
CSFLGVXGLSPFXXLXSVFHXLGLLAXXXLVGLHXPXFXSXLPXSXXXLXXLXXXXLFXXXXXXXXXXRTID

SEQ ID NO: 29809 - protein, 203 aa, Diabrotica virgifera
  misc_feature: Coding regions on vcDNA: vcDNA=SeqID_9506; Strand=+; Position=47-658
  misc_feature: Homolog annotation: Hit_ID=NP_608323.1; Match level="QueryCoverage =94%, HitCoverage=27%, E-value=1e-18, Identity=30%"; Hit description =CG14205-PA [Drosophila melanogaster] gb|AAF48977.2| CG14205-PA [Drosophila melanogaster]
TCRTHWLSFFLYLQNYVNYDDVCVIPSWYLSADMQLFIIANIILIPLSVILAKSSKNFKLVMGICWTLNILFTVLPLAARLIWTEYDNPYDTHSRIIDYSIGIMMGIYIRETKSSKYLVKSKIVNFVIWIIVLTSMGACAILYQEVVYSLRYSQTVQAFYYSFSRPIWCLGISWITYSCYHGYGRISNWILTKHSCKTGKRAY

SEQ ID NO: 29810 - protein, 18 aa, Diabrotica virgifera
  misc_feature: Coding regions on vcDNA: vcDNA=SeqID_9507; Strand=-; Position=3-56
  misc_feature (3)..(4): Xaa can be any naturally occurring amino acid
  misc_feature (15)..(15): Xaa can be any naturally occurring amino acid
FFXXLLRTTKKHNNXRPC

SEQ ID NO: 29811 - protein, 260 aa, Diabrotica virgifera
  misc_feature: Coding regions on vcDNA: vcDNA=SeqID_9508; Strand=+; Position=3-785
  misc_feature: Homolog annotation: Hit_ID=EAA14843.2; Match level="QueryCoverage =100%, HitCoverage=13%, E-value=1e-44, Identity=34%"; Hit description= ENSANGP00000017181 [Anopheles gambiae str. PEST] ref|XP_552903.1| ENSANGP00000017181 [Anopheles gambiae s
SWSPEDNKIQNISNVLRVFVDVILDVPEHRRIPLYKQLLEQIEVKNHLYLFLLLIFEAQVTHGAHDKQRKENSQKRLDIASELCREFSPKIVIANCIYLIKYLSKLPDEKEENMEVDSDVTTIFNIAAHTPKDFRHYKYVLVKSTGNLLGFPEFVNQVASLSDEDELNLEPLFKEMIVNTLQYIQRISKVCDKASNTPQAHYWKVLLHLSYDILDSVNALLTPQMFLLVTKGLMIHTLSTGRKRVLELVNNKLQHKFTIF

SEQ ID NO: 29812 - protein, 215 aa, Diabrotica virgifera
  misc_feature: Coding regions on vcDNA: vcDNA=SeqID_9509; Strand=+; Position=3-650
  misc_feature (160)..(160): Xaa can be any naturally occurring amino acid
SCVRNREDNRYYLPVIVSIAPNLNTFQCNSQTNALYTSVPFYYSFIKREMTKNHLEDCILPAYPKNGKWFLEGGIEKKPGDIVLSSTILRFSCNMRHILSSRSPYYDCQSFEDHPTCLRVCPKISLPAGSQILCKNFKDQYIDCNDIADGSSITFTCPNXFVSDRGTPTSTRYCRNGVYGNSAPPGQTLSKSLCTSLIHYYNSKPKIELAPTKTT

SEQ ID NO: 29813 - protein, 84 aa, Diabrotica virgifera
  misc_feature: Coding regions on vcDNA: vcDNA=SeqID_9510; Strand=+; Position=114-367
  misc_feature: Homolog annotation: Hit_ID=AAF31051.1; Match level="QueryCoverage =79%, HitCoverage=15%, E-value=8e-14, Identity=62%"; Hit description =elongation factor-1 alpha [Cardiocladius sp.]
  misc_feature (37)..(37): Xaa can be any naturally occurring amino acid
  misc_feature (61)..(61): Xaa can be any naturally occurring amino acid
  misc_feature (67)..(67): Xaa can be any naturally occurring amino acid
MQGNEQRHPLHFQTIKMKSTTTAHLIYQCDDTAKRTXSKSPKKEAQEMGKGPFNHARELDXLKTRDXRGITLDIALRKLETVKY

SEQ ID NO: 29814 - protein, 86 aa, Diabrotica virgifera
  misc_feature: Coding regions on vcDNA: vcDNA=SeqID_9511; Strand=-; Position=0-257
  misc_feature (1)..(1): Xaa can be any naturally occurring amino acid
  misc_feature (8)..(9): Xaa can be any naturally occurring amino acid
  misc_feature (20)..(21): Xaa can be any naturally occurring amino acid
  misc_feature (24)..(24): Xaa can be any naturally occurring amino acid
  misc_feature (28)..(28): Xaa can be any naturally occurring amino acid
  misc_feature (31)..(31): Xaa can be any naturally occurring amino acid
  misc_feature (36)..(37): Xaa can be any naturally occurring amino acid
  misc_feature (44)..(45): Xaa can be any naturally occurring amino acid
  misc_feature (59)..(59): Xaa can be any naturally occurring amino acid
  misc_feature (62)..(65): Xaa can be any naturally occurring amino acid
  misc_feature (75)..(75): Xaa can be any naturally occurring amino acid
  misc_feature (78)..(78): Xaa can be any naturally occurring amino acid
XHIYFLLXXFYHTKTSVISXXIKXIISXNIXQNFLXXQNIQKIXXQPNLKYPSIQCHYXPNXXXXSFNHLKQSFXFTXIIFRSWGG

SEQ ID NO: 29815 - protein, 259 aa, Diabrotica virgifera
  misc_feature: Coding regions on vcDNA: vcDNA=SeqID_9512; Strand=-; Position=1-777
  misc_feature (1)..(255): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDNGK

SEQ ID NO: 29816 - protein, 62 aa, Diabrotica virgifera
  misc_feature: Coding regions on vcDNA: vcDNA=SeqID_9513; Strand=+; Position=19-207
  misc_feature (3)..(4): Xaa can be any naturally occurring amino acid
  misc_feature (6)..(6): Xaa can be any naturally occurring amino acid
  misc_feature (13)..(15): Xaa can be any naturally occurring amino acid
  misc_feature (18)..(20): Xaa can be any naturally occurring amino acid
  misc_feature (23)..(23): Xaa can be any naturally occurring amino acid
  misc_feature (25)..(25): Xaa can be any naturally occurring amino acid
  misc_feature (29)..(29): Xaa can be any naturally occurring amino acid
  misc_feature (32)..(33): Xaa can be any naturally occurring amino acid
  misc_feature (38)..(40): Xaa can be any naturally occurring amino acid
  misc_feature (42)..(42): Xaa can be any naturally occurring amino acid
  misc_feature (45)..(45): Xaa can be any naturally occurring amino acid
  misc_feature (52)..(52): Xaa can be any naturally occurring amino acid
  misc_feature (55)..(55): Xaa can be any naturally occurring amino acid
  misc_feature (62)..(62): Xaa can be any naturally occurring amino acid
LLXXCXVRSFKVXXXEGXXXMEXGXGREXEKXXINLRXXXIXYVXIECRVLXDYXGVEKWFX

SEQ ID NO: 29817 - protein, 155 aa, Diabrotica virgifera
  misc_feature: Coding regions on vcDNA: vcDNA=SeqID_9514; Strand=-; Position=53-520
  misc_feature (26)..(27): Xaa can be any naturally occurring amino acid
  misc_feature (29)..(29): Xaa can be any naturally occurring amino acid
  misc_feature (36)..(36): Xaa can be any naturally occurring amino acid
  misc_feature (48)..(48): Xaa can be any naturally occurring amino acid
  misc_feature (58)..(58): Xaa can be any naturally occurring amino acid
  misc_feature (61)..(61): Xaa can be any naturally occurring amino acid
  misc_feature (64)..(64): Xaa can be any naturally occurring amino acid
  misc_feature (68)..(68): Xaa can be any naturally occurring amino acid
  misc_feature (76)..(76): Xaa can be any naturally occurring amino acid
  misc_feature (78)..(78): Xaa can be any naturally occurring amino acid
  misc_feature (81)..(83): Xaa can be any naturally occurring amino acid
  misc_feature (85)..(85): Xaa can be any naturally occurring amino acid
  misc_feature (88)..(88): Xaa can be any naturally occurring amino acid
  misc_feature (93)..(93): Xaa can be any naturally occurring amino acid
  misc_feature (95)..(97): Xaa can be any naturally occurring amino acid
  misc_feature (99)..(101): Xaa can be any naturally occurring amino acid
  misc_feature (104)..(104): Xaa can be any naturally occurring amino acid
  misc_feature (106)..(106): Xaa can be any naturally occurring amino acid
  misc_feature (109)..(111): Xaa can be any naturally occurring amino acid
  misc_feature (124)..(131): Xaa can be any naturally occurring amino acid
  misc_feature (134)..(135): Xaa can be any naturally occurring amino acid
  misc_feature (138)..(138): Xaa can be any naturally occurring amino acid
FPCVVFGSLFSSCWGAGGLGCVLSFXXPXVCGLCGXSFLRASSLFVRXRSLFVVFPFXCAXCVXSFCXWPPLLVRXSXLSXXXPXPCXFCGCXFXXXFXXXRRXLXPSXXXPFCCVLCGLPFGXXXXXXXXLKXXPAXRRLSLCVFVAFSLKLTY

SEQ ID NO: 29818 - protein, 163 aa, Diabrotica virgifera
  misc_feature: Coding regions on vcDNA: vcDNA=SeqID_9515; Strand=+; Position=47-535
  misc_feature: Homolog annotation: Hit_ID=XP_307994.1; Match level="QueryCoverage =77%, HitCoverage=30%, E-value=2e-30, Identity=53%"; Hit description =ENSANGP00000013512 [Anopheles gambiae]
  misc_feature: Gene Ontology Annotation: Molecular function=isocitrate dehydrogenase (NAD+) activity; Cellular component=mitochondrion; Biological process= hermaphrodite genital morphogenesis
  misc_feature (26)..(26): Xaa can be any naturally occurring amino acid
  misc_feature (29)..(29): Xaa can be any naturally occurring amino acid
  misc_feature (35)..(35): Xaa can be any naturally occurring amino acid
  misc_feature (39)..(39): Xaa can be any naturally occurring amino acid
  misc_feature (48)..(48): Xaa can be any naturally occurring amino acid
  misc_feature (51)..(51): Xaa can be any naturally occurring amino acid
  misc_feature (56)..(56): Xaa can be any naturally occurring amino acid
  misc_feature (58)..(58): Xaa can be any naturally occurring amino acid
  misc_feature (61)..(61): Xaa can be any naturally occurring amino acid
  misc_feature (63)..(63): Xaa can be any naturally occurring amino acid
  misc_feature (74)..(75): Xaa can be any naturally occurring amino acid
  misc_feature (87)..(87): Xaa can be any naturally occurring amino acid
  misc_feature (89)..(89): Xaa can be any naturally occurring amino acid
  misc_feature (114)..(115): Xaa can be any naturally occurring amino acid
  misc_feature (119)..(119): Xaa can be any naturally occurring amino acid
  misc_feature (122)..(122): Xaa can be any naturally occurring amino acid
  misc_feature (126)..(126): Xaa can be any naturally occurring amino acid
  misc_feature (134)..(134): Xaa can be any naturally occurring amino acid
  misc_feature (146)..(159): Xaa can be any naturally occurring amino acid
YWVRSVIEDKEIKKIIGLYGGRNVVXMLXGGGIGXELMXYVREVFKYXVEXVDFEXIXIDXKXEYNVELEYVIXXIKGNGVDIKGNXEXKSESDEVILRNVVIRNELDFFENVXXVKLXKVXMIDXKDIEIVIXRENKEGEYVMLXXXXXXXXXXXXXXVKEL

SEQ ID NO: 29819 - protein, 178 aa, Diabrotica virgifera
  misc_feature: Coding regions on vcDNA: vcDNA=SeqID_9516; Strand=-; Position=64-600
  misc_feature (40)..(45): Xaa can be any naturally occurring amino acid
  misc_feature (51)..(60): Xaa can be any naturally occurring amino acid
  misc_feature (63)..(63): Xaa can be any naturally occurring amino acid
  misc_feature (65)..(73): Xaa can be any naturally occurring amino acid
  misc_feature (79)..(160): Xaa can be any naturally occurring amino acid
  misc_feature (162)..(177): Xaa can be any naturally occurring amino acid
VGGQGGLVVYTKRQVFYKRVLKMLREAVMRRMCCCLVAKXXXXXXVSQYVXXXXXXXXXXEKXMXXXXXXXXXSIITCXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXP

SEQ ID NO: 29820 - protein, 158 aa, Diabrotica virgifera
  misc_feature: Coding regions on vcDNA: vcDNA=SeqID_9517; Strand=-; Position=345-821
  misc_feature (35)..(127): Xaa can be any naturally occurring amino acid
  misc_feature (129)..(129): Xaa can be any naturally occurring amino acid
  misc_feature (132)..(132): Xaa can be any naturally occurring amino acid
  misc_feature (137)..(138): Xaa can be any naturally occurring amino acid
  misc_feature (144)..(155): Xaa can be any naturally occurring amino acid
  misc_feature (157)..(157): Xaa can be any naturally occurring amino acid
WSANYNLYPPWGCNLVIGFDFSIKFRWYPKVFILXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXYLXTVKIXXPFKLIXXXXXXXXXXXXTXF

SEQ ID NO: 29821 - protein, 226 aa, Diabrotica virgifera
  misc_feature: Coding regions on vcDNA: vcDNA=SeqID_9518; Strand=+; Position=51-731
  misc_feature: Homolog annotation: Hit_ID=AAU95200.1; Match level="QueryCoverage =97%, HitCoverage=50%, E-value=2e-33, Identity=37%"; Hit description =enolase [Oncometopia nigricans]
  misc_feature: Gene Ontology Annotation: Molecular function=phosphopyruvate hydratase activity; Cellular component=soluble fraction; Biological process=gluconeogenesis
  misc_feature: Pfam annotation: Pfam_ID=Enolase_C; Match level="Score=4.2, E-value =2.9e-07, Copies=1"; Pfam description=Enolase, C-terminal TIM barrel domain
  misc_feature (4)..(5): Xaa can be any naturally occurring amino acid
  misc_feature (7)..(13): Xaa can be any naturally occurring amino acid
  misc_feature (17)..(17): Xaa can be any naturally occurring amino acid
  misc_feature (19)..(20): Xaa can be any naturally occurring amino acid
  misc_feature (29)..(31): Xaa can be any naturally occurring amino acid
  misc_feature (33)..(33): Xaa can be any naturally occurring amino acid
  misc_feature (40)..(42): Xaa can be any naturally occurring amino acid
  misc_feature (44)..(45): Xaa can be any naturally occurring amino acid
  misc_feature (50)..(51): Xaa can be any naturally occurring amino acid
  misc_feature (54)..(54): Xaa can be any naturally occurring amino acid
  misc_feature (56)..(60): Xaa can be any naturally occurring amino acid
  misc_feature (62)..(62): Xaa can be any naturally occurring amino acid
  misc_feature (65)..(75): Xaa can be any naturally occurring amino acid
  misc_feature (77)..(78): Xaa can be any naturally occurring amino acid
  misc_feature (81)..(83): Xaa can be any naturally occurring amino acid
  misc_feature (85)..(85): Xaa can be any naturally occurring amino acid
  misc_feature (89)..(92): Xaa can be any naturally occurring amino acid
  misc_feature (94)..(94): Xaa can be any naturally occurring amino acid
  misc_feature (96)..(97): Xaa can be any naturally occurring amino acid
  misc_feature (99)..(99): Xaa can be any naturally occurring amino acid
  misc_feature (101)..(102): Xaa can be any naturally occurring amino acid
  misc_feature (104)..(108): Xaa can be any naturally occurring amino acid
  misc_feature (110)..(110): Xaa can be any naturally occurring amino acid
  misc_feature (112)..(112): Xaa can be any naturally occurring amino acid
  misc_feature (115)..(117): Xaa can be any naturally occurring amino acid
  misc_feature (123)..(125): Xaa can be any naturally occurring amino acid
  misc_feature (130)..(130): Xaa can be any naturally occurring amino acid
  misc_feature (132)..(132): Xaa can be any naturally occurring amino acid
  misc_feature (135)..(135): Xaa can be any naturally occurring amino acid
  misc_feature (138)..(140): Xaa can be any naturally occurring amino acid
  misc_feature (143)..(143): Xaa can be any naturally occurring amino acid
  misc_feature (145)..(145): Xaa can be any naturally occurring amino acid
  misc_feature (149)..(149): Xaa can be any naturally occurring amino acid
  misc_feature (161)..(161): Xaa can be any naturally occurring amino acid
  misc_feature (164)..(165): Xaa can be any naturally occurring amino acid
  misc_feature (167)..(167): Xaa can be any naturally occurring amino acid
  misc_feature (170)..(170): Xaa can be any naturally occurring amino acid
  misc_feature (176)..(176): Xaa can be any naturally occurring amino acid
  misc_feature (182)..(183): Xaa can be any naturally occurring amino acid
  misc_feature (186)..(187): Xaa can be any naturally occurring amino acid
  misc_feature (191)..(193): Xaa can be any naturally occurring amino acid
  misc_feature (197)..(197): Xaa can be any naturally occurring amino acid
  misc_feature (201)..(202): Xaa can be any naturally occurring amino acid
  misc_feature (213)..(214): Xaa can be any naturally occurring amino acid
  misc_feature (222)..(222): Xaa can be any naturally occurring amino acid
GDEXXFXXXXXXXKEGXEXXKVVIENGGXXXKXEIGMDVXXXEXXKEGKXXLEXKXXXXXKXKWXXXXXXXXXXXEXXKEXXXVXIEDXXXXDXWXXWXKXXGXXXXXIXGXDLXXXNLKCIXXXVEKKXCXWLXLKXXXIGXVXEFIXVYNVCKVKGWGXMVXXRXGEXEDIFIXDFVVGXXNGXXKNGXXXKIRXFGLXXKIFGIEEELGXXDKYDGKYXVKSK

SEQ ID NO: 29822 - protein, 169 aa, Diabrotica virgifera
  misc_feature: Coding regions on vcDNA: vcDNA=SeqID_9519; Strand=-; Position=1-507
  misc_feature (12)..(18): Xaa can be any naturally occurring amino acid
  misc_feature (28)..(35): Xaa can be any naturally occurring amino acid
  misc_feature (38)..(51): Xaa can be any naturally occurring amino acid
  misc_feature (57)..(70): Xaa can be any naturally occurring amino acid
  misc_feature (72)..(156): Xaa can be any naturally occurring amino acid
  misc_feature (158)..(168): Xaa can be any naturally occurring amino acid
DIFGSFSYLKYXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXQXXXXXXXXXXXP

SEQ ID NO: 29823 - protein, 174 aa, Diabrotica virgifera
  misc_feature: Coding regions on vcDNA: vcDNA=SeqID_9520; Strand=-; Position=2-522
  misc_feature: Homolog annotation: Hit_ID=XP_397074.1; Match level="QueryCoverage =87%, HitCoverage=64%, E-value=7e-18, Identity=32%"; Hit description =similar to ENSANGP00000017031 [Apis mellifera]
  misc_feature: Pfam annotation: Pfam_ID=rve; Match level="Score=2.0, E-value=0.0067, Copies=1"; Pfam description=Integrase core domain
  misc_feature (67)..(67): Xaa can be any naturally occurring amino acid
  misc_feature (118)..(134): Xaa can be any naturally occurring amino acid
PKSIHNLKAIFARHGRPDVIFSDGGPQFTKGYIQKFFKEWEIIHKTSSPRYPQSNGFIERYVQTYKXMFKKILFDQKDMYVALLEIRNTPISHCIPSPAELLFGRKLKGFVPVSDSQXXXXXXXXXXXXXXXXXQMKSEKYFNKTAKHLPLLSPNDKVMMELNSRNWARCRTGE

SEQ ID NO: 29824 - protein, 289 aa, Diabrotica virgifera
  misc_feature: Coding regions on vcDNA: vcDNA=SeqID_9521; Strand=-; Position=0-866
  misc_feature (5)..(15): Xaa can be any naturally occurring amino acid
  misc_feature (25)..(32): Xaa can be any naturally occurring amino acid
  misc_feature (36)..(41): Xaa can be any naturally occurring amino acid
  misc_feature (54)..(67): Xaa can be any naturally occurring amino acid
  misc_feature (72)..(285): Xaa can be any naturally occurring amino acid
VLFVXXXXXXXXXXXTNLAHPGFNXXXXXXXXWTRXXXXXXPPIINFNPTSSSXXXXXXXXXXXXXXVILKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDLEG

SEQ ID NO: 29825 - protein, 142 aa, Diabrotica virgifera
  misc_feature: Coding regions on vcDNA: vcDNA=SeqID_9522; Strand=-; Position=0-425
  misc_feature (9)..(9): Xaa can be any naturally occurring amino acid
  misc_feature (33)..(33): Xaa can be any naturally occurring amino acid
  misc_feature (60)..(61): Xaa can be any naturally occurring amino acid
  misc_feature (83)..(83): Xaa can be any naturally occurring amino acid
  misc_feature (91)..(91): Xaa can be any naturally occurring amino acid
  misc_feature (95)..(96): Xaa can be any naturally occurring amino acid
  misc_feature (104)..(107): Xaa can be any naturally occurring amino acid
  misc_feature (109)..(109): Xaa can be any naturally occurring amino acid
  misc_feature (115)..(115): Xaa can be any naturally occurring amino acid
  misc_feature (118)..(118): Xaa can be any naturally occurring amino acid
  misc_feature (122)..(123): Xaa can be any naturally occurring amino acid
  misc_feature (126)..(137): Xaa can be any naturally occurring amino acid
CVFCFLLFXLCLFFLVRVLVSSFPPSFVGAFFXFWRSFVVFPRVCRSCFLVCVRRSWFLXXPRRWVWLGRWVFSFGFGVGGFXLFGASAAXPAAXXGWSLGVLXXXXAXVALLRXPFXRRRXXRLXXXXXXXXXXXXGPLAP

SEQ ID NO: 29826 - protein, 94 aa, Diabrotica virgifera
  misc_feature: Coding regions on vcDNA: vcDNA=SeqID_9523; Strand=-; Position=348-632
  misc_feature (2)..(30): Xaa can be any naturally occurring amino acid
  misc_feature (35)..(46): Xaa can be any naturally occurring amino acid
  misc_feature (53)..(53): Xaa can be any naturally occurring amino acid
  misc_feature (56)..(57): Xaa can be any naturally occurring amino acid
  misc_feature (59)..(59): Xaa can be any naturally occurring amino acid
  misc_feature (69)..(70): Xaa can be any naturally occurring amino acid
  misc_feature (75)..(75): Xaa can be any naturally occurring amino acid
  misc_feature (77)..(77): Xaa can be any naturally occurring amino acid
  misc_feature (79)..(80): Xaa can be any naturally occurring amino acid
  misc_feature (84)..(84): Xaa can be any naturally occurring amino acid
  misc_feature (86)..(86): Xaa can be any naturally occurring amino acid
  misc_feature (88)..(88): Xaa can be any naturally occurring amino acid
  misc_feature (91)..(91): Xaa can be any naturally occurring amino acid
IXXXXXXXXXXXXXXXXXXXXXXXXXXXXXHNFNXXXXXXXXXXXXSHIIYIXSSXXFXYQSILNYFIXXLSYKXSXLXXLKHXIXLXTKXFIK

SEQ ID NO: 29827 - protein, 90 aa, Diabrotica virgifera
  misc_feature: Coding regions on vcDNA: vcDNA=SeqID_9524; Strand=+; Position=2-274
  misc_feature (6)..(6): Xaa can be any naturally occurring amino acid
  misc_feature (19)..(19): Xaa can be any naturally occurring amino acid
  misc_feature (21)..(21): Xaa can be any naturally occurring amino acid
  misc_feature (25)..(25): Xaa can be any naturally occurring amino acid
  misc_feature (57)..(62): Xaa can be any naturally occurring amino acid
LQVRLXILLFVGFPLALQXIXMMKXPLVLTFVAFLWIWEANGFTAEQINEIRSICSXXXXXXPRKKGIGVFRNSGGLAPHFLGNRTSRKN

SEQ ID NO: 29828 - protein, 83 aa, Diabrotica virgifera
  misc_feature: Coding regions on vcDNA: vcDNA=SeqID_9525; Strand=+; Position=51-302
  misc_feature (2)..(7): Xaa can be any naturally occurring amino acid
  misc_feature (9)..(12): Xaa can be any naturally occurring amino acid
  misc_feature (14)..(14): Xaa can be any naturally occurring amino acid
  misc_feature (16)..(23): Xaa can be any naturally occurring amino acid
  misc_feature (25)..(32): Xaa can be any naturally occurring amino acid
  misc_feature (50)..(59): Xaa can be any naturally occurring amino acid
RXXXXXXKXXXXYXEXXXXXXXXPXXXXXXXXVGGDGNGPPAILSFLALXXXXXXXXXXLDLPFKFLNASERTSHAHPHCTDR

SEQ ID NO: 29829 - protein, 152 aa, Diabrotica virgifera
  misc_feature: Coding regions on vcDNA: vcDNA=SeqID_9526; Strand=+; Position=3-458
  misc_feature (7)..(8): Xaa can be any naturally occurring amino acid
  misc_feature (19)..(22): Xaa can be any naturally occurring amino acid
  misc_feature (24)..(24): Xaa can be any naturally occurring amino acid
  misc_feature (26)..(26): Xaa can be any naturally occurring amino acid
  misc_feature (29)..(30): Xaa can be any naturally occurring amino acid
  misc_feature (33)..(33): Xaa can be any naturally occurring amino acid
  misc_feature (35)..(36): Xaa can be any naturally occurring amino acid
  misc_feature (38)..(38): Xaa can be any naturally occurring amino acid
  misc_feature (43)..(43): Xaa can be any naturally occurring amino acid
  misc_feature (45)..(45): Xaa can be any naturally occurring amino acid
  misc_feature (49)..(51): Xaa can be any naturally occurring amino acid
  misc_feature (54)..(55): Xaa can be any naturally occurring amino acid
  misc_feature (57)..(57): Xaa can be any naturally occurring amino acid
  misc_feature (59)..(61): Xaa can be any naturally occurring amino acid
  misc_feature (63)..(63): Xaa can be any naturally occurring amino acid
  misc_feature (67)..(67): Xaa can be any naturally occurring amino acid
  misc_feature (69)..(71): Xaa can be any naturally occurring amino acid
  misc_feature (73)..(75): Xaa can be any naturally occurring amino acid
  misc_feature (84)..(86): Xaa can be any naturally occurring amino acid
  misc_feature (88)..(88): Xaa can be any naturally occurring amino acid
  misc_feature (93)..(95): Xaa can be any naturally occurring amino acid
  misc_feature (97)..(98): Xaa can be any naturally occurring amino acid
  misc_feature (105)..(105): Xaa can be any naturally occurring amino acid
  misc_feature (107)..(107): Xaa can be any naturally occurring amino acid
  misc_feature (112)..(112): Xaa can be any naturally occurring amino acid
  misc_feature (115)..(115): Xaa can be any naturally occurring amino acid
  misc_feature (120)..(120): Xaa can be any naturally occurring amino acid
  misc_feature (128)..(129): Xaa can be any naturally occurring amino acid
  misc_feature (152)..(152): Xaa can be any naturally occurring amino acid
HTGPMKXXKIYRSFLMIGXXXXLXGXNEXXEDXEXXLXEDKEXNXKVEXXXKRXXEXLXXXGXDVKXFXXXKXXXGDEEGVEIXXXNXEKLKXXXFXXKREIIFXEXGWKDXHKXDVNYXVREYIVRXXDVNIFVVKWSKIVEKGYLKYRGX

SEQ ID NO: 29830 - protein, 93 aa, Diabrotica virgifera
  misc_feature: Coding regions on vcDNA: vcDNA=SeqID_9527; Strand=+; Position=50-331
LIYIWLLPLSTGHPLLAVWLQYKLYRENYGINSFFSRIGHLRCFSPKWPILEKVNLFHNFEPLYEYMSLYASSVILSILNICYLSNDRSKYDF

SEQ ID NO: 29831 - protein, 186 aa, Diabrotica virgifera
  misc_feature: Coding regions on vcDNA: vcDNA=SeqID_9528; Strand=+; Position=27-585
  misc_feature: Homolog annotation: Hit_ID=ATRTC; Match level="QueryCoverage=87%, HitCoverage=43%, E-value=1e-37, Identity=53%"; Hit description=actin beta - rat
  misc_feature: Gene Ontology Annotation: Biological process=reproduction
  misc_feature (10)..(10): Xaa can be any naturally occurring amino acid
  misc_feature (13)..(14): Xaa can be any naturally occurring amino acid
  misc_feature (16)..(16): Xaa can be any naturally occurring amino acid
  misc_feature (18)..(19): Xaa can be any naturally occurring amino acid
  misc_feature (23)..(26): Xaa can be any naturally occurring amino acid
  misc_feature (28)..(28): Xaa can be any naturally occurring amino acid
  misc_feature (30)..(30): Xaa can be any naturally occurring amino acid
  misc_feature (33)..(33): Xaa can be any naturally occurring amino acid
  misc_feature (37)..(37): Xaa can be any naturally occurring amino acid
  misc_feature (39)..(40): Xaa can be any naturally occurring amino acid
  misc_feature (42)..(43): Xaa can be any naturally occurring amino acid
  misc_feature (45)..(45): Xaa can be any naturally occurring amino acid
  misc_feature (54)..(55): Xaa can be any naturally occurring amino acid
  misc_feature (63)..(63): Xaa can be any naturally occurring amino acid
  misc_feature (99)..(99): Xaa can be any naturally occurring amino acid
  misc_feature (106)..(106): Xaa can be any naturally occurring amino acid
  misc_feature (112)..(112): Xaa can be any naturally occurring amino acid
  misc_feature (136)..(136): Xaa can be any naturally occurring amino acid
  misc_feature (142)..(142): Xaa can be any naturally occurring amino acid
AVIDHPLNRXDDXXAXQXXDNGXXXXKXGXAGXDAPXAXXPXXDXRPRQQGARXXTGQKDPHXGDEAQSKRGTHTPKHPTEHGNTTNGDDREKHRHHTXHNERRAXPEEHPXPPTEAPPNPKANREKRTRTTTETXKTPAKXEATQAEPPPNAAGRTKENGGDAGKGGTHTGPKPRRRRTNPTPTA

SEQ ID NO: 29832 - protein, 98 aa, Diabrotica virgifera
  misc_feature: Coding regions on vcDNA: vcDNA=SeqID_9529; Strand=-; Position=3-296
  misc_feature (22)..(22): Xaa can be any naturally occurring amino acid
  misc_feature (24)..(24): Xaa can be any naturally occurring amino acid
  misc_feature (32)..(32): Xaa can be any naturally occurring amino acid
  misc_feature (41)..(41): Xaa can be any naturally occurring amino acid
  misc_feature (53)..(53): Xaa can be any naturally occurring amino acid
  misc_feature (58)..(58): Xaa can be any naturally occurring amino acid
  misc_feature (62)..(62): Xaa can be any naturally occurring amino acid
  misc_feature (65)..(65): Xaa can be any naturally occurring amino acid
  misc_feature (67)..(67): Xaa can be any naturally occurring amino acid
  misc_feature (70)..(70): Xaa can be any naturally occurring amino acid
  misc_feature (75)..(76): Xaa can be any naturally occurring amino acid
  misc_feature (80)..(81): Xaa can be any naturally occurring amino acid
  misc_feature (92)..(92): Xaa can be any naturally occurring amino acid
  misc_feature (94)..(96): Xaa can be any naturally occurring amino acid
LFQIFNTFFLNILLPPNTSLYXFXHFNNHFTXIFTYFPKNXIFLQNLLNSFFXNYYQXHNLXPFXKXTTXTQFYXXILLXXFFSLTYPLILXKXXXKL

SEQ ID NO: 29833 - protein, 62 aa, Diabrotica virgifera
  misc_feature: Coding regions on vcDNA: vcDNA=SeqID_9530; Strand=+; Position=652-837
  misc_feature (2)..(8): Xaa can be any naturally occurring amino acid
  misc_feature (17)..(24): Xaa can be any naturally occurring amino acid
  misc_feature (42)..(42): Xaa can be any naturally occurring amino acid
IXXXXXXXVPFTLMFVXXXXXXXXISIQLISIWQFLCTNPYXDVIHIITSEIYLQKWSVTFH

SEQ ID NO: 29834 - protein, 43 aa, Diabrotica virgifera
  misc_feature: Coding regions on vcDNA: vcDNA=SeqID_9531; Strand=-; Position=2-130
  misc_feature (3)..(41): Xaa can be any naturally occurring amino acid
EVXXXXXXXXXXXXXXXXXXXXXXXXXXXXXXXXXXXXXXXIK

SEQ ID NO: 29835 - protein, 279 aa, Diabrotica virgifera
  misc_feature: Coding regions on vcDNA: vcDNA=SeqID_9532; Strand=-; Position=2-838
  misc_feature (4)..(13): Xaa can be any naturally occurring amino acid
  misc_feature (17)..(17): Xaa can be any naturally occurring amino acid
  misc_feature (21)..(279): Xaa can be any naturally occurring amino acid
AELXXXXXXXXXXLKEXINNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29836 - protein, 77 aa, Diabrotica virgifera
  misc_feature: Coding regions on vcDNA: vcDNA=SeqID_9533; Strand=+; Position=1-234
  misc_feature (60)..(67): Xaa can be any naturally occurring amino acid
PLLRSFSLKPSKKGSVTTSTRLLGENIDSLAIISLLCDPCVPGSTLLDLPVHYFRLHLKXXXXXXXXCYIGRITCSS

SEQ ID NO: 29837 - protein, 44 aa, Diabrotica virgifera
  misc_feature: Coding regions on vcDNA: vcDNA=SeqID_9534; Strand=+; Position=1-132
  misc_feature (4)..(42): Xaa can be any naturally occurring amino acid
IFIXXXXXXXXXXXXXXXXXXXXXXXXXXXXXXXXXXXXXXXTS

SEQ ID NO: 29838 - protein, 100 aa, Diabrotica virgifera
  misc_feature: Coding regions on vcDNA: vcDNA=SeqID_9535; Strand=+; Position=1-300
GSLVGAVLVGGPIDVLTEYESVNRKSGKKTHAAPVHRYLATGGRGSGGGRVITPSKKRGEDNDDNTIFIIRFLQDSTITNIHYCLNWPFTSSWSVPGHFG

SEQ ID NO: 29839 - protein, 276 aa, Diabrotica virgifera
  misc_feature: Coding regions on vcDNA: vcDNA=SeqID_9536; Strand=+; Position=1-828
  misc_feature (1)..(273): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNKL

SEQ ID NO: 29840 - protein, 59 aa, Diabrotica virgifera
  misc_feature: Coding regions on vcDNA: vcDNA=SeqID_9537; Strand=-; Position=93-272
STEPSKYLRNEKNNIHETPHASKATQKASDAIFSPTTPLPVSPEIPIAYLLQMGQGYFR

SEQ ID NO: 29841 - protein, 295 aa, Diabrotica virgifera
  misc_feature: Coding regions on vcDNA: vcDNA=SeqID_9538; Strand=+; Position=1-885
  misc_feature (5)..(43): Xaa can be any naturally occurring amino acid
  misc_feature (46)..(292): Xaa can be any naturally occurring amino acid
FLSYXXXXXXXXXXXXXXXXXXXXXXXXXXXXXXXXXXXXXXXYLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFFS

SEQ ID NO: 29842 - protein, 145 aa, Diabrotica virgifera
  misc_feature: Coding regions on vcDNA: vcDNA=SeqID_9539; Strand=+; Position=24-461
  misc_feature: Pfam annotation: Pfam_ID=PBP_GOBP; Match level="Score=18.5, E-value =0.0003, Copies=1"; Pfam description=PBP/GOBP family
MATKYITVLLVCMYLHTGYCSLSFQDLGEHLQTDGIKWAERCHAITGVTEEAVEDAMKGIFPDTFGPYITCLWLTSEVMTPTMDIIPEKLKYYLNEKVLKSDEIAQYIPCAANARKLGDDVPFNKKVLEMNKCHYKINPDKYIIF

SEQ ID NO: 29843 - protein, 17 aa, Diabrotica virgifera
  misc_feature: Coding regions on vcDNA: vcDNA=SeqID_9540; Strand=-; Position=1-51
  misc_feature (3)..(17): Xaa can be any naturally occurring amino acid
EVXXXXXXXXXXXXXXX

SEQ ID NO: 29844 - protein, 171 aa, Diabrotica virgifera
  misc_feature: Coding regions on vcDNA: vcDNA=SeqID_9541; Strand=+; Position=1-516
  misc_feature (28)..(35): Xaa can be any naturally occurring amino acid
  misc_feature (42)..(53): Xaa can be any naturally occurring amino acid
  misc_feature (55)..(74): Xaa can be any naturally occurring amino acid
  misc_feature (80)..(171): Xaa can be any naturally occurring amino acid
KTLLRKGKEKFHYTVVKYVTGGETFHFXXXXXXXXDLGDQGXXXXXXXXXXXXIXXXXXXXXXXXXXXXXXXXXNGMSIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29845 - protein, 95 aa, Diabrotica virgifera
  misc_feature: Coding regions on vcDNA: vcDNA=SeqID_9542; Strand=+; Position=441-728
  misc_feature (2)..(9): Xaa can be any naturally occurring amino acid
FXXXXXXXXVKLSLVSYNNFKLNNGCECNHSIIHYWLILFLEYFIVSTPKNQPFLQNIVEIVIYVPSQLSDSLSNESDITNRGSEASETSNRRIR

SEQ ID NO: 29846 - protein, 147 aa, Diabrotica virgifera
  misc_feature: Coding regions on vcDNA: vcDNA=SeqID_9543; Strand=+; Position=280-723
IPFWILRLAYPICKIEDRLHKEFHKLCAVHLGNCLRLIGQMIKKFLLGSKNCLYSLWFEDFVDFVSKAGFIVWRDVDVDALEKFNTEFCVLLFINERKRMTERKRKRNGRVRQLSSFLSVTQSEPALIHLVVYQHIRILLIICYNGC

SEQ ID NO: 29847 - protein, 289 aa, Diabrotica virgifera
  misc_feature: Coding regions on vcDNA: vcDNA=SeqID_9544; Strand=-; Position=0-866
  misc_feature (1)..(242): Xaa can be any naturally occurring amino acid
  misc_feature (244)..(264): Xaa can be any naturally occurring amino acid
  misc_feature (266)..(281): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXLXXXXXXXXXXXXXXXXSGGNGRVG

SEQ ID NO: 29848 - protein, 25 aa, Diabrotica virgifera
  misc_feature: Coding regions on vcDNA: vcDNA=SeqID_9545; Strand=-; Position=1-75
  misc_feature (1)..(13): Xaa can be any naturally occurring amino acid
  misc_feature (16)..(24): Xaa can be any naturally occurring amino acid
XXXXXXXXXXXXXFTXXXXXXXXXN

SEQ ID NO: 29849 - protein, 254 aa, Diabrotica virgifera
  misc_feature: Coding regions on vcDNA: vcDNA=SeqID_9546; Strand=+; Position=95-857
  misc_feature: Homolog annotation: Hit_ID=EAL33555.1; Match level="QueryCoverage =88%, HitCoverage=35%, E-value=4e-30, Identity=33%"; Hit description =GA17298-PA [Drosophila pseudoobscura]
  misc_feature (70)..(70): Xaa can be any naturally occurring amino acid
NSSNIDTVRSSLDTHRNQGIVRVLLSIKGQAQPEAVRRHLQEVVRRRDKTGNLAFLRLRHCLVTKCGSYXWQNSEFNLDQHLTVVPFTYKGRAVTEYNIQDYVNEIVSKYMPGNISPWQITIIPSSEDQHYILFRLHHILLSEGLNIGDLLPLIPPTRPPVGSYVSRSPLVEVFKKPEVILVLKDRLTEELSNRWNEFVANNDPLERPELLKSTPTFFQFVSYCLLSFVSVIRDCKGFRVIKPDAFSIQYVVQS

SEQ ID NO: 29850 - protein, 127 aa, Diabrotica virgifera
  misc_feature: Coding regions on vcDNA: vcDNA=SeqID_9547; Strand=+; Position=200-583
NHFFFIWAMSFLNHRNGLEQKIRNSAHYHSEFHTLAPNSADMRNSADVRDYAQYYHGISHISMTRIKSCPFNLDHIVFEPSQWIETKKIRNSAHYPGEITHISEKFCVCAKFRTISLRNFALFHGKN

SEQ ID NO: 29851 - protein, 104 aa, Diabrotica virgifera
  misc_feature: Coding regions on vcDNA: vcDNA=SeqID_9548; Strand=-; Position=64-378
  misc_feature (72)..(80): Xaa can be any naturally occurring amino acid
AIFGKRYLPAISLLESNPMIVYTNNIGMQSPQIVCYFFHKQNGAPKSCFFNFCSITPNILILHQKDTNKNSXXXXXXXXXVFPDPLRRKFSAENAGFSRFRFSR

SEQ ID NO: 29852 - protein, 98 aa, Diabrotica virgifera
  misc_feature: Coding regions on vcDNA: vcDNA=SeqID_9549; Strand=-; Position=125-421
LPNPTNPETSTDRTQLLHSIRFHYQFHTEEMPHLSCLYNLVRLNSPLSNHISSTAERESYQYRSRSLIELSPLDVNDNTQWVCRYKRATSRSIASQRR

SEQ ID NO: 29853 - protein, 152 aa, Diabrotica virgifera
  misc_feature: Coding regions on vcDNA: vcDNA=SeqID_9550; Strand=-; Position=277-735
  misc_feature (52)..(52): Xaa can be any naturally occurring amino acid
  misc_feature (62)..(62): Xaa can be any naturally occurring amino acid
  misc_feature (65)..(74): Xaa can be any naturally occurring amino acid
  misc_feature (148)..(148): Xaa can be any naturally occurring amino acid
FFHIHIHYFHYHLILILLYYQYFFPYYLQNFYLHFFQLLFNPLHYFHNHLTXFLLPYHPNLXSYXXXXXXXXXXNYFHIHIHYFHHHLILLFLNYQHFFPYYLQYILLHLFQLLSTLFPNQYHYLHSHLIYILLYYHPKFNYYFFNLXFYSL

SEQ ID NO: 29854 - protein, 186 aa, Diabrotica virgifera
  misc_feature: Coding regions on vcDNA: vcDNA=SeqID_9551; Strand=+; Position=1-561
  misc_feature (3)..(18): Xaa can be any naturally occurring amino acid
  misc_feature (20)..(33): Xaa can be any naturally occurring amino acid
  misc_feature (37)..(74): Xaa can be any naturally occurring amino acid
  misc_feature (77)..(131): Xaa can be any naturally occurring amino acid
  misc_feature (139)..(139): Xaa can be any naturally occurring amino acid
  misc_feature (141)..(185): Xaa can be any naturally occurring amino acid
SFXXXXXXXXXXXXXXXXVXXXXXXXXXXXXXXVPWXXXXXXXXXXXXXXXXXXXXXXXXXXXXXXXXXXXXXXEMXXXXXXXXXXXXXXXXXXXXXXXXXXXXXXXXXXXXXXXXXXXXXXXXXXXXXXXIKIFIFLXMXXXXXXXXXXXXXXXXXXXXXXXXXXXXXXXXXXXXXXXXXXXXXG

SEQ ID NO: 29855 - protein, 77 aa, Diabrotica virgifera
  misc_feature: Coding regions on vcDNA: vcDNA=SeqID_9552; Strand=+; Position=100-333
IVVRESVILIVLEEWYYSVMLYKEGDCDIDILEVCDGPKYGKGVKIENVVDLSYGYKKDVVVEEWEMKRLSSFEFGR

SEQ ID NO: 29856 - protein, 224 aa, Diabrotica virgifera
  misc_feature: Coding regions on vcDNA: vcDNA=SeqID_9553; Strand=+; Position=1-672
  misc_feature (3)..(19): Xaa can be any naturally occurring amino acid
  misc_feature (43)..(80): Xaa can be any naturally occurring amino acid
  misc_feature (84)..(223): Xaa can be any naturally occurring amino acid
IYXXXXXXXXXXXXXXXXXTIVNPYRERNPSLFQKKNLLFVPXXXXXXXXXXXXXXXXXXXXXXXXXXXXXXXXXXXXXXIEIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXI

SEQ ID NO: 29857 - protein, 302 aa, Diabrotica virgifera
  misc_feature: Coding regions on vcDNA: vcDNA=SeqID_9554; Strand=+; Position=3-908
  misc_feature: Homolog annotation: Hit_ID=NP_728092.1; Match level="QueryCoverage =58%, HitCoverage=14%, E-value=1e-31, Identity=37%"; Hit description =CG32556-PA, isoform A [Drosophila melanogaster] gb|AAF48755.2| CG32556-PA, isoform A [Drosophila
  misc_feature (183)..(189): Xaa can be any naturally occurring amino acid
RVRIVREVKERKIISREETEEVKETEDVQHYGDITDEDFISAVSSGKTDIRKVLRTQEGNHQVVSTGPRLVLDTKKSKKTTDTEDTRELSAVREDGKIVTETQRTTEHEEVNDDELPDDEPDQNFQKESSQRYVKTKEQEDVDYIADGVNIGHEMRFKTETMEADRRGDGIDEPDLFESLSAXXXXXXXNRQYTEQRHSPPYQSPSPYSGDRTRRSPSPDYRPSHSPVPDYRKQHSPHSPTPDYIRNQHSPVPDYSRNARMSPKRGVVTITPTPPRRTKNERQRPRVGDDRSRYDNEYRNTR

SEQ ID NO: 29858 - protein, 192 aa, Diabrotica virgifera
  misc_feature: Coding regions on vcDNA: vcDNA=SeqID_9555; Strand=-; Position=3-578
  misc_feature (112)..(119): Xaa can be any naturally occurring amino acid
  misc_feature (179)..(188): Xaa can be any naturally occurring amino acid
FQHILCHHILQFRLQQKQIFSILLQHPSQILHPTYKFLTNPTKKNPYFLHFKHLHYTQFPHLSAPFLSNFLIFTQFFKKTTLPIPQNFSTQNQPYIFKIKKTFPFFIIISIXXXXXXXXQNFISKPIFISLSKKQFHNLYFSPLQSFIAPPQRFINLYFSPHPFFSLLIFPIFIPFKDXXXXXXXXXXGLLK

SEQ ID NO: 29859 - protein, 206 aa, Diabrotica virgifera
  misc_feature: Coding regions on vcDNA: vcDNA=SeqID_9556; Strand=-; Position=1-618
  misc_feature (6)..(150): Xaa can be any naturally occurring amino acid
  misc_feature (153)..(206): Xaa can be any naturally occurring amino acid
PVKIPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSXXXXXXXXXXXXXXXXXXXXXXXXXXXXXXXXXXXXXXXXXXXXXXXXXXXXXX

SEQ ID NO: 29860 - protein, 86 aa, Diabrotica virgifera
  misc_feature: Coding regions on vcDNA: vcDNA=SeqID_9557; Strand=-; Position=123-383
  misc_feature (16)..(22): Xaa can be any naturally occurring amino acid
YPLKILSPISMFFISXXXXXXXSIFSYISKHKKFHINSNFLIIFKLLKSFSYFNKNKISLYIYSTPKKTYIYNYISQPPYNLLPIS

SEQ ID NO: 29861 - protein, 56 aa, Diabrotica virgifera
  misc_feature: Coding regions on vcDNA: vcDNA=SeqID_9558; Strand=-; Position=1-168
  misc_feature (4)..(4): Xaa can be any naturally occurring amino acid
  misc_feature (12)..(56): Xaa can be any naturally occurring amino acid
IDLXSPIKLRCXXXXXXXXXXXXXXXXXXXXXXXXXXXXXXXXXXXXXXXXXXXXX

SEQ ID NO: 29862 - protein, 26 aa, Diabrotica virgifera
  misc_feature: Coding regions on vcDNA: vcDNA=SeqID_9559; Strand=+; Position=2-79
NWSLPEDQERLNVLSENHQKNLSIDL

SEQ ID NO: 29863 - protein, 107 aa, Diabrotica virgifera
  misc_feature: Coding regions on vcDNA: vcDNA=SeqID_9560; Strand=+; Position=2-322
  misc_feature (7)..(13): Xaa can be any naturally occurring amino acid
  misc_feature (15)..(48): Xaa can be any naturally occurring amino acid
  misc_feature (52)..(70): Xaa can be any naturally occurring amino acid
  misc_feature (89)..(89): Xaa can be any naturally occurring amino acid
TTKPPPXXXXXXXPXXXXXXXXXXXXXXXXXXXXXXXXXXXXXXXXXXLPPXXXXXXXXXXXXXXXXXXXGGGRGEEKGQRLPPPSPPXGLPLSGGGLFLLNHTQQG

SEQ ID NO: 29864 - protein, 365 aa, Diabrotica virgifera
  misc_feature: Coding regions on vcDNA: vcDNA=SeqID_9561; Strand=-; Position=2-1096
  misc_feature (5)..(40): Xaa can be any naturally occurring amino acid
  misc_feature (92)..(106): Xaa can be any naturally occurring amino acid
  misc_feature (128)..(142): Xaa can be any naturally occurring amino acid
  misc_feature (152)..(160): Xaa can be any naturally occurring amino acid
  misc_feature (175)..(206): Xaa can be any naturally occurring amino acid
  misc_feature (209)..(215): Xaa can be any naturally occurring amino acid
  misc_feature (219)..(261): Xaa can be any naturally occurring amino acid
  misc_feature (265)..(277): Xaa can be any naturally occurring amino acid
  misc_feature (286)..(292): Xaa can be any naturally occurring amino acid
  misc_feature (306)..(341): Xaa can be any naturally occurring amino acid
  misc_feature (343)..(362): Xaa can be any naturally occurring amino acid
GVWLXXXXXXXXXXXXXXXXXXXXXXXXXXXXXXXXXXXXVRDKKKKERREDFGVCWWFGWCDGGRGQGNRITLSYPPPSPPPHPHHHQTKXXXXXXXXXXXXXXXTPLSHLASPLALRWWWGGVCGXXXXXXXXXXXXXXXSSLPPPPPAXXXXXXXXXSPTFFFSLSFSPYTXXXXXXXXXXXXXXXXXXXXXXXXXXXXXXXXPPXXXXXXXEPEXXXXXXXXXXXXXXXXXXXXXXXXXXXXXXXXXXXXXXXXXXXGKEXXXXXXXXXXXXXGGGKQRTAXXXXXXXLYFFLPLPPHQKKXXXXXXXXXXXXXXXXXXXXXXXXXXXXXXXXXXXXEXXXXXXXXXXXXXXXXXXXXSPP

SEQ ID NO: 29865 - protein, 95 aa, Diabrotica virgifera
  misc_feature: Coding regions on vcDNA: vcDNA=SeqID_9562; Strand=-; Position=246-533
IIARYYYKTVQKHTHAIIMQYYNVPITYISNNISYHTVNNAAVRYYRQYLYFDNSQHHKIMMLTIFVSQSSHPIHNNILSRNKIRRSSGKVRKIM

SEQ ID NO: 29866 - protein, 70 aa, Diabrotica virgifera
  misc_feature: Coding regions on vcDNA: vcDNA=SeqID_9563; Strand=+; Position=180-392
KIRIVDFALYYLLEVLRLHIIQGSFKVIDSHRDARFDSQYRVGVVKQKYPKDLCKLTIRNHMRITSYLTL

SEQ ID NO: 29867 - protein, 224 aa, Diabrotica virgifera
  misc_feature: Coding regions on vcDNA: vcDNA=SeqID_9564; Strand=-; Position=209-883
  misc_feature (7)..(143): Xaa can be any naturally occurring amino acid
  misc_feature (146)..(152): Xaa can be any naturally occurring amino acid
  misc_feature (158)..(179): Xaa can be any naturally occurring amino acid
  misc_feature (181)..(205): Xaa can be any naturally occurring amino acid
KIPRSFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKKXXXXXXXRRPYRXXXXXXXXXXXXXXXXXXXXXXGXXXXXXXXXXXXXXXXXXXXXXXXXIRINYLRDNSVILLESSNR

SEQ ID NO: 29868 - protein, 84 aa, Diabrotica virgifera
  misc_feature: Coding regions on vcDNA: vcDNA=SeqID_9565; Strand=-; Position=2-253
  misc_feature (3)..(12): Xaa can be any naturally occurring amino acid
  misc_feature (14)..(56): Xaa can be any naturally occurring amino acid
  misc_feature (65)..(84): Xaa can be any naturally occurring amino acid
ISXXXXXXXXXXYXXXXXXXXXXXXXXXXXXXXXXXXXXXXXXXXXXXXXXXXXXXSTNTELTIXXXXXXXXXXXXXXXXXXXX

SEQ ID NO: 29869 - protein, 224 aa, Diabrotica virgifera
  misc_feature: Coding regions on vcDNA: vcDNA=SeqID_9566; Strand=+; Position=1-675
  misc_feature (10)..(150): Xaa can be any naturally occurring amino acid
  misc_feature (152)..(177): Xaa can be any naturally occurring amino acid
  misc_feature (182)..(188): Xaa can be any naturally occurring amino acid
  misc_feature (192)..(212): Xaa can be any naturally occurring amino acid
  misc_feature (215)..(221): Xaa can be any naturally occurring amino acid
VMKCYSVFTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMXXXXXXXXXXXXXXXXXXXXXXXXXXLYLIXXXXXXXVGKXXXXXXXXXXXXXXXXXXXXXYSXXXXXXXKYS

SEQ ID NO: 29870 - protein, 36 aa, Diabrotica virgifera
  misc_feature: Coding regions on vcDNA: vcDNA=SeqID_9567; Strand=-; Position=1-108
SIKISYYSQIQFVGIYHFISQQTTEKRLLFYTSTKP

SEQ ID NO: 29871 - protein, 59 aa, Diabrotica virgifera
  misc_feature: Coding regions on vcDNA: vcDNA=SeqID_9568; Strand=-; Position=1-177
HMMVAVSVSFHYSHLLVDKLTLVRQIKIARPPYLILALHPDALSGISLAWSIVNQRHVN

SEQ ID NO: 29872 - protein, 241 aa, Diabrotica virgifera
  misc_feature: Coding regions on vcDNA: vcDNA=SeqID_9569; Strand=+; Position=148-869
  misc_feature: Homolog annotation: Hit_ID=XP_391879.1; Match level="QueryCoverage =85%, HitCoverage=85%, E-value=9e-44, Identity=43%"; Hit description =similar to ENSANGP00000021657 [Apis mellifera]
  misc_feature (48)..(48): Xaa can be any naturally occurring amino acid
  misc_feature (133)..(133): Xaa can be any naturally occurring amino acid
  misc_feature (145)..(150): Xaa can be any naturally occurring amino acid
  misc_feature (160)..(160): Xaa can be any naturally occurring amino acid
  misc_feature (175)..(175): Xaa can be any naturally occurring amino acid
  misc_feature (187)..(187): Xaa can be any naturally occurring amino acid
  misc_feature (222)..(222): Xaa can be any naturally occurring amino acid
MLKNIIGVCLAFFHSSGMKYNENTNRWEGNWFPHSPNELDQNPVGQLXGSNNGDNKHGVIMGIRNPECDDAKTNLTLDWDMNPTNYTCFGGKDLYEPHRYIHPVHRYEYIPASYQAPHQCMDGFIEYREIGSXFGTQRSPWAKYXXXXXXSRQRWIHILXHGAVVMLYHPCANKXEVNLLKEIVRGXGLFKHVITPYNLLSPNRPLALLTWGHRLEMSKISXSLVVRFIRDHAHRGPEDTF

SEQ ID NO: 29873 - protein, 112 aa, Diabrotica virgifera
  misc_feature: Coding regions on vcDNA: vcDNA=SeqID_9570; Strand=+; Position=38-373
LRICSNPLARRTLTESFIFVRLCSVHSIFHIHYEHVTFGSGGGSMTEHRLSLLHGARASTTQIRPAIGSGLTSPLSKVFRLALLTRTCMDAGAHCAPLNCSSLKSSDVPHLS

SEQ ID NO: 29874 - protein, 18 aa, Diabrotica virgifera
  misc_feature: Coding regions on vcDNA: vcDNA=SeqID_9571; Strand=-; Position=0-53
  misc_feature (5)..(16): Xaa can be any naturally occurring amino acid
FPFRXXXXXXXXXXXXRT

SEQ ID NO: 29875 - protein, 111 aa, Diabrotica virgifera
  misc_feature: Coding regions on vcDNA: vcDNA=SeqID_9572; Strand=-; Position=264-599
  misc_feature: Homolog annotation: Hit_ID=CAA10770.1; Match level="QueryCoverage =73%, HitCoverage=24%, E-value=4e-12, Identity=39%"; Hit description =reverse transcriptase-like [Bos taurus]
MFINSKTIEAFEMWCTRRMWKIPWPERVTNQDVLLKMGKECEVIKTIQTKKLEYLGHIMRGEKYSLLRLIIQGKISGKRNMGRRRISWLRNLREWYGCQFNKIAVMVATLR

SEQ ID NO: 29876 - protein, 229 aa, Diabrotica virgifera
  misc_feature: Coding regions on vcDNA: vcDNA=SeqID_9573; Strand=+; Position=229-915
  misc_feature: Homolog annotation: Hit_ID=NP_082324.1; Match level="QueryCoverage =99%, HitCoverage=76%, E-value=1e-52, Identity=47%"; Hit description =RIKEN cDNA 1810012H11 [Mus musculus] emb|CAI25536.1| novel protein [Mus musculus]
  misc_feature: Gene Ontology Annotation: Molecular function=sulfate porter activity; Cellular component=membrane; Biological process=mitochondrial transport
  misc_feature: Pfam annotation: Pfam_ID=Mito_carr; Match level="Score=140.5, E-value= 3.9e-39, Copies=2"; Pfam description=Mitochondrial carrier protein
MDFVIGGLAASGAAIFSNPFDVVKTRMQLQGELQARGKHQVFYKNVFHAGWVIAKNEGIRGLQKGLGTAILMHSVRNSTRLGIYQWLHKKEYLTNEHGKTIFHRSALASAFSGAAGAFLGSPLFLVKTQLQAQAADNISVGTQHGHKGAFAAFRTIYHQDGISGLWRGGNAVVLRAVVGSSAQLTSFAITKDMLRDYEVFVRYPIVTSFVASIIGGVFQCILMNPFDLV

SEQ ID NO: 29877 - protein, 74 aa, Diabrotica virgifera
  misc_feature: Coding regions on vcDNA: vcDNA=SeqID_9574; Strand=+; Position=1-225
  misc_feature (1)..(7): Xaa can be any naturally occurring amino acid
  misc_feature (10)..(28): Xaa can be any naturally occurring amino acid
  misc_feature (33)..(39): Xaa can be any naturally occurring amino acid
XXXXXXXFLXXXXXXXXXXXXXXXXXXXLHSSXXXXXXXLCYLSTVKIPGPFKSISWPGETLYLIQKDMFLIYR

SEQ ID NO: 29878 - protein, 83 aa, Diabrotica virgifera
  misc_feature: Coding regions on vcDNA: vcDNA=SeqID_9575; Strand=+; Position=680-928
VISRPVHRIDTPSSHSAADSSLIFLSDNSSYCLQYCRLFSLSPHCNPNQHLHLPYQPFCVIRFCHHHTFCTRMHSAWLCQQLH

SEQ ID NO: 29879 - protein, 110 aa, Diabrotica virgifera
  misc_feature: Coding regions on vcDNA: vcDNA=SeqID_9576; Strand=+; Position=36-368
  misc_feature (19)..(28): Xaa can be any naturally occurring amino acid
  misc_feature (79)..(87): Xaa can be any naturally occurring amino acid
LGLIGTAADPGYRKFGLAXXXXXXXXXXVCLQINSVIIGTQTLVNHVRVPHIQSVVESLIFSFLSFAPIVQTVFCYHFXXXXXXXXXLPLRRQKITQTQQNLNIFTRNEQ

SEQ ID NO: 29880 - protein, 263 aa, Diabrotica virgifera
  misc_feature: Coding regions on vcDNA: vcDNA=SeqID_9577; Strand=+; Position=63-855
  misc_feature: Homolog annotation: Hit_ID=NP_612047.1; Match level="QueryCoverage =89%, HitCoverage=24%, E-value=1e-44, Identity=42%"; Hit description =CG12189-PA [Drosophila melanogaster] gb|AAF47401.1| CG12189-PA [Drosophila melanogaster]
  misc_feature: Gene Ontology Annotation: Molecular function=deoxycytidyl transferase activity, template dependent; Cellular component=nucleus; Biological process=bypass DNA synthesis
  misc_feature: Pfam annotation: Pfam_ID=BRCT; Match level="Score=53.0, E-value=8.3e -13, Copies=1"; Pfam description=BRCA1 C Terminus (BRCT) domain
  misc_feature (148)..(148): Xaa can be any naturally occurring amino acid
MNDKSNGTVKEETDNKKKEDNGFKEWGGYMAAKRAKLLNQFEESNITKLSNIFEGVSIHVNGLTRPPIDELKNLMAAHGGVFHMYQVSSTTHIIASNLPNVKIKHLGTTPIVKPAWITDSIDFGKLLDYRRYLLYNNQSKSQPKISFXNNQSKSQPKIGFPVIEKVSASASISENNSANVESDTVVAETSELIQNSIAQIKSDKLSSTNQINRFPTKTASDPNFLEEFYNNSRLHLISTLGAEFKHLVGQMRGLSDGKFPGLE

SEQ ID NO: 29881 - protein, 86 aa, Diabrotica virgifera
  misc_feature: Coding regions on vcDNA: vcDNA=SeqID_9578; Strand=+; Position=544-804
PFKSKIQSFLENYLWQILRFNNLLVVIIRHQQLKLSRWCKKIVVWMAEMVSLNNTIKSMSKVRRLKSPLFSSDLSYQKFVASGHGG

SEQ ID NO: 29882 - protein, 229 aa, Diabrotica virgifera
  misc_feature: Coding regions on vcDNA: vcDNA=SeqID_9579; Strand=-; Position=0-686
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(182): Xaa can be any naturally occurring amino acid
  misc_feature (185)..(228): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGXXXXXXXXXXXXXXXXXXXXXXXXXXXXXXXXXXXXXXXXXXXXR

SEQ ID NO: 29883 - protein, 190 aa, Diabrotica virgifera
  misc_feature: Coding regions on vcDNA: vcDNA=SeqID_9580; Strand=+; Position=107-676
  misc_feature (22)..(190): Xaa can be any naturally occurring amino acid
ILSYLTISSYQLNTFHHLSNIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29884 - protein, 41 aa, Diabrotica virgifera
  misc_feature: Coding regions on vcDNA: vcDNA=SeqID_9581; Strand=-; Position=1-123
  misc_feature (3)..(14): Xaa can be any naturally occurring amino acid
  misc_feature (27)..(34): Xaa can be any naturally occurring amino acid
RYXXXXXXXXXXXXFLSRILINYPLEXXXXXXXXKKIFYYF

SEQ ID NO: 29885 - protein, 246 aa, Diabrotica virgifera
  misc_feature: Coding regions on vcDNA: vcDNA=SeqID_9582; Strand=+; Position=15-755
  misc_feature: Pfam annotation: Pfam_ID=DUF227; Match level="Score=17.9, E-value =1.5e-05, Copies=1"; Pfam description=Domain of unknown function (DUF227)
  misc_feature (76)..(82): Xaa can be any naturally occurring amino acid
MYVCSKFIVSKMSSVEAETIGLVAKAFSEEPNNIEIIDVKGNDIGRGYSSEVLFIFAKNKRTGSQRRFIIKQALPXXXXXXXQITAFSFHNEKMFYLTVFPALINFQKLHNSNNVFNNMAECYGGITEPSKEKLIFEDLTFQGYEIFPSTEKLLDTSMYEVLFKVYGRLHGISYAFKHYQKEKFFEMKEQVRGPFQLFIEQDKFISDLENVIERVERYLKEENEINASKKLKIHKDNCKEILMEAL

SEQ ID NO: 29886 - protein, 202 aa, Diabrotica virgifera
  misc_feature: Coding regions on vcDNA: vcDNA=SeqID_9583; Strand=+; Position=2-607
  misc_feature (11)..(171): Xaa can be any naturally occurring amino acid
  misc_feature (176)..(200): Xaa can be any naturally occurring amino acid
HNLLSFSNLQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAHWIXXXXXXXXXXXXXXXXXXXXXXXXXKG

SEQ ID NO: 29887 - protein, 274 aa, Diabrotica virgifera
  misc_feature: Coding regions on vcDNA: vcDNA=SeqID_9584; Strand=-; Position=1-822
  misc_feature (2)..(257): Xaa can be any naturally occurring amino acid
  misc_feature (260)..(274): Xaa can be any naturally occurring amino acid
YXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 29888 - protein, 245 aa, Diabrotica virgifera
  misc_feature: Coding regions on vcDNA: vcDNA=SeqID_9585; Strand=-; Position=2-736
  misc_feature (1)..(45): Xaa can be any naturally occurring amino acid
  misc_feature (48)..(58): Xaa can be any naturally occurring amino acid
  misc_feature (68)..(75): Xaa can be any naturally occurring amino acid
  misc_feature (78)..(91): Xaa can be any naturally occurring amino acid
  misc_feature (97)..(110): Xaa can be any naturally occurring amino acid
  misc_feature (112)..(223): Xaa can be any naturally occurring amino acid
  misc_feature (231)..(245): Xaa can be any naturally occurring amino acid
XXXXXXXXXXXXXXXXXXXXXXXXXXXXXXXXXXXXXXXXXXXXXPFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVQINRWAXXXXXXXXXXXXXXX

SEQ ID NO: 29889 - protein, 27 aa, Diabrotica virgifera
  misc_feature: Coding regions on vcDNA: vcDNA=SeqID_9586; Strand=+; Position=3-86
  misc_feature (10)..(18): Xaa can be any naturally occurring amino acid
  misc_feature (25)..(25): Xaa can be any naturally occurring amino acid
FVKHVTFNIXXXXXXXXXLIYFNLXPV

SEQ ID NO: 29890 - protein, 133 aa, Diabrotica virgifera
  misc_feature: Coding regions on vcDNA: vcDNA=SeqID_9587; Strand=+; Position=1-402
EIYCKKRIQYYNCPVQNCQIQNSALPLSDHLLIDHDCNSVTDHLLIEASFFPIFELPEECFVFVEDQIIYFQLTAQDEYNMECKIVTNDDKIQLQWKPHVLFFNNNTLSTLANLCINDKNIDCIAKIVLVKNE

SEQ ID NO: 29891 - protein, 26 aa, Diabrotica virgifera
  misc_feature: Coding regions on vcDNA: vcDNA=SeqID_9588; Strand=-; Position=2-79
  misc_feature (1)..(21): Xaa can be any naturally occurring amino acid
  misc_feature (23)..(24): Xaa can be any naturally occurring amino acid
XXXXXXXXXXXXXXXXXXXXXSXXIN

SEQ ID NO: 29892 - protein, 69 aa, Diabrotica virgifera
  misc_feature: Coding regions on vcDNA: vcDNA=SeqID_9589; Strand=+; Position=202-411
LEKQEFNNLEFPIEFSMARLTMHHPVYFKADSLYSKLTKNTTVSPQQFIVNSCKFFRSLDSEDEDVFSS

SEQ ID NO: 29893 - protein, 84 aa, Diabrotica virgifera
  misc_feature: Coding regions on vcDNA: vcDNA=SeqID_9590; Strand=-; Position=141-395
  misc_feature (49)..(56): Xaa can be any naturally occurring amino acid
MADRKILQLVFFPSFYAFANRVQYTLVTKLPSVSKSLKMSEYPLKQMNXXXXXXXXVNKLVNVFLVSFWHYFFKSSITKNTIQS

SEQ ID NO: 29894 - protein, 173 aa, Diabrotica virgifera
  misc_feature: Coding regions on vcDNA: vcDNA=SeqID_9591; Strand=-; Position=218-739
  misc_feature (28)..(36): Xaa can be any naturally occurring amino acid
TMTNLNTRIYLWKTLNLTQLQLQENTFXXXXXXXXXTGDLKILKGDLLILTGKVLMMQDSNQNISDKSLDHSRNKENTRLSPSSKFNSHLLNSKYELIDCNNEDVDNLNENRKYTFEWNHNWISFIDSMIRIFTAHKPGNTLFPQKIDKCCFSPQTLLTIVNKSIGNAKIPVR

SEQ ID NO: 29895 - protein, 94 aa, Diabrotica virgifera
  misc_feature: Coding regions on vcDNA: vcDNA=SeqID_9592; Strand=+; Position=1-285
  misc_feature (26)..(33): Xaa can be any naturally occurring amino acid
SCNPPPLTDHHRLRHPGRSSRLLVDXXXXXXXXFRYSVVDVALFISWRLLHRHSSSLSSFTSRGYISLSNRLLYWLVSLSALSIMLLIIRLLSV

SEQ ID NO: 29896 - protein, 103 aa, Diabrotica virgifera
  misc_feature: Coding regions on vcDNA: vcDNA=SeqID_9593; Strand=-; Position=2-310
TCFYYIATQSKQVHGKQILSYIGIIKCLIYFLRLLTKMIPSTFLTSTPNHLNHKNKSKDMYKLIFLWCYALLYTINLRGTYGCLYTIIKFRMLVMIVFYEISK

SEQ ID NO: 29897 - protein, 262 aa, Diabrotica virgifera
  misc_feature: Coding regions on vcDNA: vcDNA=SeqID_9594; Strand=+; Position=116-904
  misc_feature: Homolog annotation: Hit_ID=AAB62657.1; Match level="QueryCoverage =87%, HitCoverage=20%, E-value=5e-09, Identity=18%"; Hit description =ORF 73, contains large complex repeat CR 73 [Human herpesvirus 8]
  misc_feature (80)..(84): Xaa can be any naturally occurring amino acid
MDIPDTRLLQVDDINLNQSRNEEEQEDLEDQKRRKEELHALLGDKLNDYDESTDDSIVSGMSCNDTESNKYLQSNNQHEXXXXXYEVRLRELQALREEHKGKTEGLTKEIKTYKRQLLLTKAELEQIKVSYKNSEDLLVEKTSNLKDLETMLESKEQQIQNYEKNIQNMQLEIATYKTTINDLYLQMQDERNPFNKYNKQFISEEYKNATKEQINRLVKTLEKANLIIEEELLRIRDIDSRNTIEVPSRNFDSANAMCSANC

SEQ ID NO: 29898 - protein, 68 aa, Diabrotica virgifera
  misc_feature: Coding regions on vcDNA: vcDNA=SeqID_9595; Strand=-; Position=550-756
  misc_feature (5)..(11): Xaa can be any naturally occurring amino acid
DVKTXXXXXXXTVLRRQRPSVGIYGGVSPSRKPLSLAVPLLHRPIRRQCIPDQVVDSIEFYTTALAFY

SEQ ID NO: 29899 - protein, 39 aa, Diabrotica virgifera
  misc_feature: Coding regions on vcDNA: vcDNA=SeqID_9596; Strand=-; Position=2-118
  misc_feature (11)..(11): Xaa can be any naturally occurring amino acid
  misc_feature (13)..(13): Xaa can be any naturally occurring amino acid
RVLCLRRRKLXDXGEFRGAAPWGQRTGFLAEARKVFREC

SEQ ID NO: 29900 - protein, 91 aa, Diabrotica virgifera
  misc_feature: Coding regions on vcDNA: vcDNA=SeqID_9597; Strand=+; Position=37-312
QITKMGVVQVALLVLLALVIVQALPNPKSVEEIEKPATIIKPQADQPDSTSSTDENVKVENVPRRVAREANPQNGHFVNYIRADDRFPTLA

SEQ ID NO: 29901 - protein, 39 aa, Diabrotica virgifera
  misc_feature: Coding regions on vcDNA: vcDNA=SeqID_9598; Strand=+; Position=99-215
NYFLYIVRKEQSVQIKKICAMYLSLFKSLHVDTKIRTHS

SEQ ID NO: 29902 - protein, 54 aa, Diabrotica virgifera
  misc_feature: Coding regions on vcDNA: vcDNA=SeqID_9599; Strand=-; Position=34-198
LASVIKYFFLKLATNCQIHYLFHNVQLLPNELFNTKMFLSLKINILKIQHSFPF

SEQ ID NO: 29903 - protein, 86 aa, Diabrotica virgifera
  misc_feature: Coding regions on vcDNA: vcDNA=SeqID_9600; Strand=+; Position=206-466
  misc_feature (48)..(53): Xaa can be any naturally occurring amino acid
TSYYFYSSSCFVTIANMNFCSGELISSKLFVLGEYNKNVLLGNKSLSXXXXXXTTAGKRNFSKFTRIVSTYWTLRLQERSYIADSQ

SEQ ID NO: 29904 - protein, 67 aa, Diabrotica virgifera
  misc_feature: Coding regions on vcDNA: vcDNA=SeqID_9601; Strand=+; Position=3-206
  misc_feature: Homolog annotation: Hit_ID=XP_393744.1; Match level="QueryCoverage =94%, HitCoverage=10%, E-value=8e-13, Identity=50%"; Hit description =similar to ENSANGP00000018366 [Apis mellifera]
NIPSTPTDVVDGRLLYASTSIDEWSLLSRLAIMGASSQGTMGGLLVAGFLFKTIGWRILAITGAMYG

SEQ ID NO: 29905 - protein, 295 aa, Diabrotica virgifera
  misc_feature: Coding regions on vcDNA: vcDNA=SeqID_9602; Strand=+; Position=54-938
  misc_feature: Homolog annotation: Hit_ID=NP_572707.3; Match level="QueryCoverage =98%, HitCoverage=35%, E-value=1e-61, Identity=42%"; Hit description =CG1597-PA [Drosophila melanogaster] gb|AAF48028.3| CG1597-PA [Drosophila melanogaster]
  misc_feature: Gene Ontology Annotation: Molecular function=glucosidase activity; Cellular component=membrane fraction; Biological process=N-linked glycosylation
  misc_feature (176)..(182): Xaa can be any naturally occurring amino acid
  misc_feature (184)..(189): Xaa can be any naturally occurring amino acid
  misc_feature (228)..(235): Xaa can be any naturally occurring amino acid
  misc_feature (284)..(284): Xaa can be any naturally occurring amino acid
MVRQRERRSQANSDGTNSSSSNGSSTSTSKSSESVNLFHYWKQFVVVVVLSVAVCFGYMGYLETRINTPFDDRKVVSQSGLDVPELFWGSYRPGAYFGLKTRDPTSLVTGLMWYFPLRLKPGGDGIRHWCEQGDNLEKYGWLQHDGYNFGIQEIIDGPFNITTSFVKKPGGLHGGXXXXXXXVXXXXXXPNVSKEEVSLLWYVALDEETKGSIQPTNLATKITGIRGXXXXXXXXRIKLVNTSGVLSHESFLSTTAPGLHLLKETVISSLRLCSDNPKSPRKIXVGGQLQAFNGD

SEQ ID NO: 29906 - protein, 65 aa, Diabrotica virgifera
  misc_feature: Coding regions on vcDNA: vcDNA=SeqID_9603; Strand=-; Position=47-244
  misc_feature (6)..(6): Xaa can be any naturally occurring amino acid
  misc_feature (23)..(29): Xaa can be any naturally occurring amino acid
RISLFXKENARKIPFFGKPFTIXXXXXXXSLSAFAEKNLNFSFLGGRLRYPIIESMLIFNYRKDV

SEQ ID NO: 29907 - protein, 55 aa, Diabrotica virgifera
  misc_feature: Coding regions on vcDNA: vcDNA=SeqID_9604; Strand=-; Position=1-165
  misc_feature (12)..(12): Xaa can be any naturally occurring amino acid
CKKKTKDKLSLXIIAIPKKMVLMFLHFSDISAPFHPKSRPNPPLRKKKHSVFALS

SEQ ID NO: 29908 - protein, 68 aa, Diabrotica virgifera
  misc_feature: Coding regions on vcDNA: vcDNA=SeqID_9605; Strand=-; Position=489-695
DNSVVLGCGIIMSYNHLAAIVMMWYTRKCIGNTSICRDRFFYNLMNIKNVFSCSATWDNFALFLGNLW

SEQ ID NO: 29909 - protein, 118 aa, Diabrotica virgifera
  misc_feature: Coding regions on vcDNA: vcDNA=SeqID_9606; Strand=+; Position=22-378
  misc_feature: Homolog annotation: Hit_ID=AAM88603.1; Match level="QueryCoverage =97%, HitCoverage=98%, E-value=4e-18, Identity=45%"; Hit description =NADH dehydrogenase subunit I [Monolepta togoensis]
  misc_feature (62)..(72): Xaa can be any naturally occurring amino acid
  misc_feature (76)..(88): Xaa can be any naturally occurring amino acid
  misc_feature (95)..(103): Xaa can be any naturally occurring amino acid
MISSLIFLSPELVSIAFLTLLERPELGYIQILPGPNKVGFLGLIQSFIDAIKLFTKKHIYPXXXXXXXXXXXPILXXXXXXXXXXXXXYITINVXXXXXXXXXLSGYMLRAYAIILAG

SEQ ID NO: 29910 - protein, 239 aa, Diabrotica virgifera
  misc_feature: Coding regions on vcDNA: vcDNA=SeqID_9607; Strand=-; Position=1-717
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(239): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29911 - protein, 84 aa, Diabrotica virgifera
  misc_feature: Coding regions on vcDNA: vcDNA=SeqID_9608; Strand=+; Position=685-936
  misc_feature: Homolog annotation: Hit_ID=XP_318567.1; Match level="QueryCoverage =94%, HitCoverage=25%, E-value=6e-09, Identity=39%"; Hit description =ENSANGP00000022349 [Anopheles gambiae]
  misc_feature (72)..(72): Xaa can be any naturally occurring amino acid
QGDALSPLLFNLVLEKAMRSAEIRTELLSVQNPKLLLAYADDIDLVGDSILFTKAIFNQVEGATSEVGLEIXEEKDEYMCIIER

SEQ ID NO: 29912 - protein, 86 aa, Diabrotica virgifera
  misc_feature: Coding regions on vcDNA: vcDNA=SeqID_9609; Strand=+; Position=1-258
KECNGLVINNFLGFTTFGKLEVKQLVLKEYAQILFEDDTEIILDPDSENKINCVATNGTEMNLHKWHNPVNWLLQGRLNGNEAIPH

SEQ ID NO: 29913 - protein, 284 aa, Diabrotica virgifera
  misc_feature: Coding regions on vcDNA: vcDNA=SeqID_9610; Strand=-; Position=1-852
  misc_feature (4)..(28): Xaa can be any naturally occurring amino acid
  misc_feature (30)..(73): Xaa can be any naturally occurring amino acid
  misc_feature (84)..(91): Xaa can be any naturally occurring amino acid
  misc_feature (113)..(166): Xaa can be any naturally occurring amino acid
  misc_feature (173)..(197): Xaa can be any naturally occurring amino acid
  misc_feature (200)..(214): Xaa can be any naturally occurring amino acid
  misc_feature (224)..(243): Xaa can be any naturally occurring amino acid
  misc_feature (246)..(263): Xaa can be any naturally occurring amino acid
  misc_feature (268)..(275): Xaa can be any naturally occurring amino acid
  misc_feature (277)..(284): Xaa can be any naturally occurring amino acid
SPLXXXXXXXXXXXXXXXXXXXXXXXXXAXXXXXXXXXXXXXXXXXXXXXXXXXXXXXXXXXXXXXXXXXXXXGRRGAGEEEKXXXXXXXXPPPGGVWAPPHHPPTERGGGAXXXXXXXXXXXXXXXXXXXXXXXXXXXXXXXXXXXXXXXXXXXXXXXXXXXXXXGGGKGSXXXXXXXXXXXXXXXXXXXXXXXXXPPXXXXXXXXXXXXXXXTKIFPPKKKXXXXXXXXXXXXXXXXXXXXAGXXXXXXXXXXXXXXXXXXRALFXXXXXXXXTXXXXXXXX

SEQ ID NO: 29914 - protein, 223 aa, Diabrotica virgifera
  misc_feature: Coding regions on vcDNA: vcDNA=SeqID_9611; Strand=+; Position=58-726
  misc_feature (6)..(12): Xaa can be any naturally occurring amino acid
  misc_feature (20)..(55): Xaa can be any naturally occurring amino acid
  misc_feature (59)..(181): Xaa can be any naturally occurring amino acid
  misc_feature (186)..(196): Xaa can be any naturally occurring amino acid
  misc_feature (200)..(223): Xaa can be any naturally occurring amino acid
EKSFIXXXXXXXLFRTSVYXXXXXXXXXXXXXXXXXXXXXXXXXXXXXXXXXXXXNRNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLKTXXXXXXXXXXXPTDXXXXXXXXXXXXXXXXXXXXXXXX

SEQ ID NO: 29915 - protein, 99 aa, Diabrotica virgifera
  misc_feature: Coding regions on vcDNA: vcDNA=SeqID_9612; Strand=-; Position=2-298
  misc_feature (2)..(21): Xaa can be any naturally occurring amino acid
  misc_feature (23)..(44): Xaa can be any naturally occurring amino acid
  misc_feature (59)..(67): Xaa can be any naturally occurring amino acid
  misc_feature (69)..(85): Xaa can be any naturally occurring amino acid
  misc_feature (88)..(99): Xaa can be any naturally occurring amino acid
NXXXXXXXXXXXXXXXXXXXXSXXXXXXXXXXXXXXXXXXXXXXSTLIPASIKNNDMLXXXXXXXXXQXXXXXXXXXXXXXXXXXNKXXXXXXXXXXXX

SEQ ID NO: 29916 - protein, 32 aa, Diabrotica virgifera
  misc_feature: Coding regions on vcDNA: vcDNA=SeqID_9613; Strand=-; Position=2-97
  misc_feature (14)..(14): Xaa can be any naturally occurring amino acid
  misc_feature (20)..(20): Xaa can be any naturally occurring amino acid
SSLSKTAASTMVAXLRILRXRTFDSKGTPHAS

SEQ ID NO: 29917 - protein, 23 aa, Diabrotica virgifera
  misc_feature: Coding regions on vcDNA: vcDNA=SeqID_9614; Strand=+; Position=1-69
  misc_feature (1)..(10): Xaa can be any naturally occurring amino acid
  misc_feature (23)..(23): Xaa can be any naturally occurring amino acid
XXXXXXXXXXWNVISFLIYLIFX

SEQ ID NO: 29918 - protein, 150 aa, Diabrotica virgifera
  misc_feature: Coding regions on vcDNA: vcDNA=SeqID_9615; Strand=-; Position=145-597
YSLSQEACCDEFFQEIYQHYLENPSDSTEYAIRMYLKHKDRPWAYKKLNELFKPLIYKIPPENSNFKATNIILVGKLLKYFNSGVEFDKKCLEEMKLWFEGLLEDNSADPIVLQSIQYSLKLIPRRIRNPELEIIKKPKKPKPIPMVPQE

SEQ ID NO: 29919 - protein, 105 aa, Diabrotica virgifera
  misc_feature: Coding regions on vcDNA: vcDNA=SeqID_9616; Strand=+; Position=100-580
  misc_feature: Homolog annotation: Hit_ID=NP_572217.1; Match level="QueryCoverage =93%, HitCoverage=15%, E-value=5e-20, Identity=55%"; Hit description =CG4208-PA [Drosophila melanogaster] gb|AAF46025.1| CG4208-PA [Drosophila melanogaster]
  misc_feature: Gene Ontology Annotation: Molecular function=DNA binding; Biological process=single strand break repair
WKIYQFTKPFHELLSGVTLVISGIQNPDRGVLRTMALSMGAKFNLELVCSSGRCNHSVQCAFSNTPKINQNKGIGKIVIRSWVEAWYSVIKRLSCRRKALDKADL

SEQ ID NO: 29920 - protein, 295 aa, Diabrotica virgifera
  misc_feature: Coding regions on vcDNA: vcDNA=SeqID_9617; Strand=+; Position=51-938
  misc_feature: Homolog annotation: Hit_ID=XP_321797.1; Match level="QueryCoverage =96%, HitCoverage=57%, E-value=2e-64, Identity=45%"; Hit description =ENSANGP00000016921 [Anopheles gambiae]
  misc_feature: Gene Ontology Annotation: Molecular function=molecular_function unknown; Cellular component=nucleus; Biological process=neurogenesis
MSNTPENSPGRKAIETMENLHKDLVFKKPFGIIKKRTKKKILEEDNYVEEIGKIIQRDFFPDLEKLKAQNAYLQALETNDTLKLKELYAKYSGSQHPPERIPSPATFETPANIHGSQHENQASTKNTDNIEKPIENKLSLDQYLNSHTSQDNESFEELLQESEQKRREKYSYLFNEEDKSEEHQKKILALPSIEEQAAIPEKKFGLDMWGYKNRNYIMYVPDGVDLSEEEIIEVNKRRQEIVHSNTRLAINPFNEVQSAETINELAKSQAKVLDGKNGVDGKELLKTDTPKVGGI

SEQ ID NO: 29921 - protein, 82 aa, Diabrotica virgifera
  misc_feature: Coding regions on vcDNA: vcDNA=SeqID_9618; Strand=+; Position=37-285
  misc_feature (58)..(63): Xaa can be any naturally occurring amino acid
LMPILKKLDIYQKEIRCIENWYQTTQLKIDNSISKPLHIRRGVQHGCVLSPLLFNIYXXXXXXESLEDASKVNGVLINNLSL

SEQ ID NO: 29922 - protein, 98 aa, Diabrotica virgifera
  misc_feature: Coding regions on vcDNA: vcDNA=SeqID_9619; Strand=+; Position=236-532
SLGGRTSCRLTTSTIGSDIWGKRRELVQIQLARVIEEIRFPGDDLVSPAICLILDEARMQTALLVPCINVLDDRSNAVPQLEKECLKLVDKKSFDSVN

SEQ ID NO: 29923 - protein, 19 aa, Diabrotica virgifera
  misc_feature: Coding regions on vcDNA: vcDNA=SeqID_9620; Strand=-; Position=0-56
  misc_feature (4)..(4): Xaa can be any naturally occurring amino acid
  misc_feature (18)..(18): Xaa can be any naturally occurring amino acid
VFYXFIIKDSSTRSHISXG

SEQ ID NO: 29924 - protein, 223 aa, Diabrotica virgifera
  misc_feature: Coding regions on vcDNA: vcDNA=SeqID_9621; Strand=+; Position=68-739
  misc_feature: Homolog annotation: Hit_ID=CAA49283.1; Match level="QueryCoverage =97%, HitCoverage=14%, E-value=2e-46, Identity=45%"; Hit description =gag,protease,endonuclease, reverse transcriptase,RNaseH [Volvox carteri f. nagariensis] pir||S32437
MNPDYQKLIGALMYLAVGTRPDICFAVSYLSQFNNSNSKEHFSAAKRVVRYLKGTASLGITYSKKDKNLVGYADADYGSCVVDRRSFTGYVFMLGGGAISWKARKQTSVTIADSTTFAEYVAISECGKECMFLKQLMKELKSPTGTVTIYNDNSSANQLCNSHTSHARSKHIDVKYHQIKEWVKRGEIEVSYLPGEEMIADFLTKVLSKKKHWACAVGLGLKN

SEQ ID NO: 29925 - protein, 75 aa, Diabrotica virgifera
  misc_feature: Coding regions on vcDNA: vcDNA=SeqID_9622; Strand=+; Position=1-226
  misc_feature: Homolog annotation: Hit_ID=XP_391989.1; Match level="QueryCoverage =93%, HitCoverage=8%, E-value=1e-26, Identity=81%"; Hit description =similar to thickveins [Apis mellifera]
  misc_feature (24)..(24): Xaa can be any naturally occurring amino acid
ASSTWENETDGREAINNLNGHMVXGQPMKCEAAKSRKAPQTPTTKIFVGNLTDNTKAPQIRELVQKYGTVVECDI

SEQ ID NO: 29926 - protein, 86 aa, Diabrotica virgifera
  misc_feature: Coding regions on vcDNA: vcDNA=SeqID_9623; Strand=-; Position=464-724
  misc_feature (2)..(2): Xaa can be any naturally occurring amino acid
LXLNMVISRTVVHIKSINKIFTNNTYKNTNIIIKTNPYDPIFSRHYGSGLVGVLPPGFTFLLFAHKLAYFLYKKLCQTQILVSFLI

SEQ ID NO: 29927 - protein, 191 aa, Diabrotica virgifera
  misc_feature: Coding regions on vcDNA: vcDNA=SeqID_9624; Strand=+; Position=2-574
  misc_feature (69)..(80): Xaa can be any naturally occurring amino acid
KLSTMTRIIISVTIISVVANSVSGFGPFDFDSHSNYHPKYLNDYQFKGLFKPHFGGSSVGEDSFSKGSXXXXXXXXXXXXGVAGEDIKHGDSGVYKGEGAFKGLKGESEYYFDSDGVKKEHNDGKEYYGGHHFGNEAKSEDEKAIKQGHRKGHKVTGFSTSHHNDEREKLKNITTKPMMKQAVKLSKENLG

SEQ ID NO: 29928 - protein, 31 aa, Diabrotica virgifera
  misc_feature: Coding regions on vcDNA: vcDNA=SeqID_9625; Strand=-; Position=1-93
  misc_feature (6)..(13): Xaa can be any naturally occurring amino acid
  misc_feature (16)..(29): Xaa can be any naturally occurring amino acid
FRRHLXXXXXXXXGQXXXXXXXXXXXXXXNN

SEQ ID NO: 29929 - protein, 51 aa, Diabrotica virgifera
  misc_feature: Coding regions on vcDNA: vcDNA=SeqID_9626; Strand=-; Position=212-367
FRHNCECRGTHSTHALPVPPLRTKKYFLQINIFIPCLDFVILELCTKFFYL

SEQ ID NO: 29930 - protein, 166 aa, Diabrotica virgifera
  misc_feature: Coding regions on vcDNA: vcDNA=SeqID_9627; Strand=-; Position=2-499
  misc_feature (3)..(65): Xaa can be any naturally occurring amino acid
  misc_feature (75)..(82): Xaa can be any naturally occurring amino acid
  misc_feature (84)..(141): Xaa can be any naturally occurring amino acid
  misc_feature (149)..(166): Xaa can be any naturally occurring amino acid
LSXXXXXXXXXXXXXXXXXXXXXXXXXXXXXXXXXXXXXXXXXXXXXXXXXXXXXXXXXXXXXXXRRLFFLTQPXXXXXXXXKXXXXXXXXXXXXXXXXXXXXXXXXXXXXXXXXXXXXXXXXXXXXXXXXXXXXXXXXXXGGNFFFPXXXXXXXXXXXXXXXXXX

SEQ ID NO: 29931 - protein, 66 aa, Diabrotica virgifera
  misc_feature: Coding regions on vcDNA: vcDNA=SeqID_9628; Strand=+; Position=437-637
KLNCIFLRFFCFWIFPALQKGGENISSKHTYRELYIDIAITPKSFLILLKINCIISRRYLVFISFV

SEQ ID NO: 29932 - protein, 52 aa, Diabrotica virgifera
  misc_feature: Coding regions on vcDNA: vcDNA=SeqID_9629; Strand=+; Position=62-217
GLSVTFLCFWGVVSVFPVFEIFHHKNRISKKVRLSKTTSCFDENSKDLTPWH

SEQ ID NO: 29933 - protein, 89 aa, Diabrotica virgifera
  misc_feature: Coding regions on vcDNA: vcDNA=SeqID_9630; Strand=-; Position=0-266
  misc_feature (2)..(8): Xaa can be any naturally occurring amino acid
  misc_feature (14)..(29): Xaa can be any naturally occurring amino acid
  misc_feature (32)..(42): Xaa can be any naturally occurring amino acid
  misc_feature (52)..(65): Xaa can be any naturally occurring amino acid
  misc_feature (70)..(79): Xaa can be any naturally occurring amino acid
YXXXXXXXDKSRGXXXXXXXXXXXXXXXXSGXXXXXXXXXXXARGAAATFFXXXXXXXXXXXXXXKSSRXXXXXXXXXXTPQTTSLRVA

SEQ ID NO: 29934 - protein, 22 aa, Diabrotica virgifera
  misc_feature: Coding regions on vcDNA: vcDNA=SeqID_9631; Strand=+; Position=1-66
  misc_feature (2)..(2): Xaa can be any naturally occurring amino acid
  misc_feature (13)..(13): Xaa can be any naturally occurring amino acid
FXRTQSMDVGQLXGVFAPVHPP

SEQ ID NO: 29935 - protein, 18 aa, Diabrotica virgifera
  misc_feature: Coding regions on vcDNA: vcDNA=SeqID_9632; Strand=-; Position=0-53
  misc_feature (8)..(8): Xaa can be any naturally occurring amino acid
PSWLSAMXYSTNNSKMHR

SEQ ID NO: 29936 - protein, 28 aa, Diabrotica virgifera
  misc_feature: Coding regions on vcDNA: vcDNA=SeqID_9633; Strand=-; Position=2-85
TTRAATSSSHMCLCGDHCSLDRKTQLIS

SEQ ID NO: 29937 - protein, 141 aa, Diabrotica virgifera
  misc_feature: Coding regions on vcDNA: vcDNA=SeqID_9634; Strand=-; Position=3-425
  misc_feature (2)..(3): Xaa can be any naturally occurring amino acid
  misc_feature (7)..(9): Xaa can be any naturally occurring amino acid
  misc_feature (12)..(63): Xaa can be any naturally occurring amino acid
  misc_feature (66)..(66): Xaa can be any naturally occurring amino acid
  misc_feature (70)..(70): Xaa can be any naturally occurring amino acid
  misc_feature (72)..(114): Xaa can be any naturally occurring amino acid
  misc_feature (116)..(141): Xaa can be any naturally occurring amino acid
LXXYIKXXXDQXXXXXXXXXXXXXXXXXXXXXXXXXXXXXXXXXXXXXXXXXXXXXXXXXXXXKLXTLKXKXXXXXXXXXXXXXXXXXXXXXXXXXXXXXXXXXXXXXXXXXXXQXXXXXXXXXXXXXXXXXXXXXXXXXX

SEQ ID NO: 29938 - protein, 270 aa, Diabrotica virgifera
  misc_feature: Coding regions on vcDNA: vcDNA=SeqID_9635; Strand=+; Position=1-812
  misc_feature: Homolog annotation: Hit_ID=AAM51140.1; Match level="QueryCoverage =94%, HitCoverage=25%, E-value=2e-49, Identity=41%"; Hit description =SD27140p [Drosophila melanogaster]
  misc_feature (75)..(75): Xaa can be any naturally occurring amino acid
GSSLSTDCFLAAFKRFLSRRENRKVLYSDNGTNFVDAKRVVDEYQLTTSKTYKDAFQQELNNTKISWKLNVLMAXHFGGIWKSNIKSVKLHLSRIVGNQILTYEEFLTVLTKIECPLNSRPLCVQSNGPENPVALTPSHFLCTEPLVSLLSMDIDLDKNMSILKRYKLLDIVQHYWKRWHSEYLSSMQSLSKWNINSNPPKEGMVVVIKNETVPPLQWNLTVMETLYPGKDGIVRIVKVRTKHGSYMLPVVKLCPLPSQLTGEDFFLFDS

SEQ ID NO: 29939 - protein, 227 aa, Diabrotica virgifera
  misc_feature: Coding regions on vcDNA: vcDNA=SeqID_9636; Strand=-; Position=1-681
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(204): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYRFNKGIRQHFFHLFIKNMSFCI

SEQ ID NO: 29940 - protein, 163 aa, Diabrotica virgifera
  misc_feature: Coding regions on vcDNA: vcDNA=SeqID_9637; Strand=-; Position=1-489
  misc_feature (5)..(27): Xaa can be any naturally occurring amino acid
  misc_feature (35)..(55): Xaa can be any naturally occurring amino acid
  misc_feature (65)..(71): Xaa can be any naturally occurring amino acid
  misc_feature (78)..(89): Xaa can be any naturally occurring amino acid
  misc_feature (95)..(137): Xaa can be any naturally occurring amino acid
  misc_feature (143)..(163): Xaa can be any naturally occurring amino acid
AGPGXXXXXXXXXXXXXXXXXXXXXXXRRPRPKKXXXXXXXXXXXXXXXXXXXXXGRPGGAGGGXXXXXXXHPQQKKXXXXXXXXXXXXNREGGXXXXXXXXXXXXXXXXXXXXXXXXXXXXXXXXXXXXXXXXXXXRGGGGXXXXXXXXXXXXXXXXXXXXX

SEQ ID NO: 29941 - protein, 111 aa, Diabrotica virgifera
  misc_feature: Coding regions on vcDNA: vcDNA=SeqID_9638; Strand=-; Position=516-851
  misc_feature: Homolog annotation: Hit_ID=XP_392609.1; Match level="QueryCoverage =100%, HitCoverage=25%, E-value=9e-39, Identity=69%"; Hit description= similar to RAB3A interacting protein (rabin3)-like 1 [Apis mellifera]
ELSHRVVHAVESGTLLIEAVGDKTKAMFPKKCALLEVPRLCFYRMSIGETDDWYNISQICRNRIIAVCDFLNYLKYIEGGLVKSSAHDVYWEIVRLRKNMCLARLGLVLSS

SEQ ID NO: 29942 - protein, 26 aa, Diabrotica virgifera
  misc_feature: Coding regions on vcDNA: vcDNA=SeqID_9639; Strand=-; Position=1-78
  misc_feature (12)..(12): Xaa can be any naturally occurring amino acid
KCDFLTSLTRNXAEVYERSTQNAFRA

SEQ ID NO: 29943 - protein, 170 aa, Diabrotica virgifera
  misc_feature: Coding regions on vcDNA: vcDNA=SeqID_9640; Strand=+; Position=108-620
  misc_feature: Homolog annotation: Hit_ID=EAL28905.1; Match level="QueryCoverage =100%, HitCoverage=53%, E-value=5e-37, Identity=44%"; Hit description= GA11523-PA [Drosophila pseudoobscura]
  misc_feature: Gene Ontology Annotation: Molecular function=protein kinase activity; Cellular component=cellular_component unknown; Biological process =biological_process unknown
  misc_feature (127)..(133): Xaa can be any naturally occurring amino acid
  misc_feature (145)..(159): Xaa can be any naturally occurring amino acid
MNTLGLSMILKMGCICAKENLSINGIRYVVLERLGEGGFSCVDLVENSTTKKKYALKRITCHSIEDQKIAMQEINYYKKLRHPNIIELVDSTFKGSADIVVHATSEAFLVLPYYKRGTLHDYLTLRXXXXXXXDVKDVWRIYFDXXXXXXXXXXXXXXXISHRDIATDNI

SEQ ID NO: 29944 - protein, 100 aa, Diabrotica virgifera
  misc_feature: Coding regions on vcDNA: vcDNA=SeqID_9641; Strand=+; Position=544-846
  misc_feature (79)..(79): Xaa can be any naturally occurring amino acid
  misc_feature (86)..(86): Xaa can be any naturally occurring amino acid
VQSIIERYLTNNYSGIISSCHITIFFTYTLNIYISSSIEKKRTHGIRKQSKLIYTSKCALIKDEIPIRHIIEAISGIKXESSLLLXIFFFPQFLEIQRIS

SEQ ID NO: 29945 - protein, 33 aa, Diabrotica virgifera
  misc_feature: Coding regions on vcDNA: vcDNA=SeqID_9642; Strand=+; Position=2-100
SSCQFHTYYYLFPGKVSLFYCGIIRPIYLPIVR

SEQ ID NO: 29946 - protein, 122 aa, Diabrotica virgifera
  misc_feature: Coding regions on vcDNA: vcDNA=SeqID_9643; Strand=-; Position=113-481
  misc_feature (30)..(38): Xaa can be any naturally occurring amino acid
  misc_feature (44)..(56): Xaa can be any naturally occurring amino acid
  misc_feature (68)..(74): Xaa can be any naturally occurring amino acid
STRIHAKKYNILLYSISGFNILNILIVTFXXXXXXXXXVTFFTXXXXXXXXXXXXXHLFVYVYIIHQXXXXXXXNAFIMGTISIQYSKYATILNILFSCTIHTIQYQYTTVYIIWGYKLNTL

SEQ ID NO: 29947 - protein, 95 aa, Diabrotica virgifera
  misc_feature: Coding regions on vcDNA: vcDNA=SeqID_9644; Strand=+; Position=168-452
  misc_feature (3)..(10): Xaa can be any naturally occurring amino acid
  misc_feature (20)..(31): Xaa can be any naturally occurring amino acid
  misc_feature (39)..(80): Xaa can be any naturally occurring amino acid
  misc_feature (88)..(95): Xaa can be any naturally occurring amino acid
NKXXXXXXXXTKSLLVFKSXXXXXXXXXXXXYLTISFIXXXXXXXXXXXXXXXXXXXXXXXXXXXXXXXXXXXXXXXXXXVIIYLLSXXXXXXXX

SEQ ID NO: 29948 - protein, 190 aa, Diabrotica virgifera
  misc_feature: Coding regions on vcDNA: vcDNA=SeqID_9645; Strand=+; Position=110-679
  misc_feature: Homolog annotation: Hit_ID=XP_319073.1; Match level="QueryCoverage =100%, HitCoverage=32%, E-value=1e-66, Identity=59%"; Hit description= ENSANGP00000013296 [Anopheles gambiae]
  misc_feature: Gene Ontology Annotation: Molecular function=molecular_function unknown; Cellular component=cellular_component unknown; Biological process=endocytosis
  misc_feature: Pfam annotation: Pfam_ID=DnaJ; Match level="Score=122.2, E-value=1.3e- 33, Copies=1"; Pfam description=DnaJ domain
  misc_feature (165)..(165): Xaa can be any naturally occurring amino acid
MKCHYEVLSVSRDAEDGEIKTAYRKLALKWHPDKNLDNAEFAKEQFQIVQQAYDVLSDRQERAWYDNHREQILRGSSSDFQDNSLDVFQYFTTTCFNGYGDDENGFYTIYKNVFEKLSKEDMDFMEDKEEFCSVPSFRNSTSDFEVASQYYAYWLNYATTKSFVXLDPYNIKDIIDRRYAKMVEKESKKI

SEQ ID NO: 29949 - protein, 206 aa, Diabrotica virgifera
  misc_feature: Coding regions on vcDNA: vcDNA=SeqID_9646; Strand=+; Position=63-685
  misc_feature: Homolog annotation: Hit_ID=CAA46187.1; Match level="QueryCoverage =73%, HitCoverage=96%, E-value=9e-33, Identity=55%"; Hit description =vacuolar ATPase 16 kD proteolipid subunit [Manduca sexta] sp|P31403|VATL_MANSE Vacuolar ATP synthase 16 kD
  misc_feature: Gene Ontology Annotation: Molecular function=hydrogen-transporting two-sector ATPase activity; Cellular component=vacuolar membrane; Biological process=hydrogen transport
  misc_feature: Pfam annotation: Pfam_ID=ATP-synt_C; Match level="Score=-2.7, E-value= 0.019, Copies=1"; Pfam description=ATP synthase subunit C
  misc_feature (41)..(41): Xaa can be any naturally occurring amino acid
  misc_feature (52)..(52): Xaa can be any naturally occurring amino acid
  misc_feature (87)..(87): Xaa can be any naturally occurring amino acid
  misc_feature (110)..(110): Xaa can be any naturally occurring amino acid
LNEWKKTNTPAIGPFFAFMGAAGAITFQIRMGAAYGTVKSXTGIAAMSVHEXNLCMKCHYPTMSWRIYIAIYGLVIAVLISGNIPDXSSTYSLHSGYCPFGSWSFLMIVXLALGVAIAMAGDAAVKLTGQLPKLFVRMILILIFPKVLRLYGLIHPIYLYTIIYLPSSPMLSSPKHSVPEVAHLAPIMLDVVSTCNNTNCIYGIRR

SEQ ID NO: 29950 - protein, 103 aa, Diabrotica virgifera
  misc_feature: Coding regions on vcDNA: vcDNA=SeqID_9647; Strand=+; Position=34-345
  misc_feature (96)..(102): Xaa can be any naturally occurring amino acid
ALEFKQASPFLEYHQDTVLQSLPCMMSHYLALPINPAYGITRSCRIFIMYRCVVNVPLSIKTRSICAPKEIPAQNIWCRVLLPPMMGLIKSNTITXXXXXXXH

SEQ ID NO: 29951 - protein, 301 aa, Diabrotica virgifera
  misc_feature: Coding regions on vcDNA: vcDNA=SeqID_9648; Strand=+; Position=45-950
  misc_feature: Homolog annotation: Hit_ID=CAB39733.1; Match level="QueryCoverage =95%, HitCoverage=24%, E-value=1e-49, Identity=36%"; Hit description =protease, reverse transcriptase, ribonuclease H, integrase [Drosophila buzzatii]
  misc_feature: Pfam annotation: Pfam_ID=rve; Match level="Score=88.1, E-value=2.3e -23, Copies=1"; Pfam description=Integrase core domain
  misc_feature (248)..(248): Xaa can be any naturally occurring amino acid
MWYQNMIDRVTQDPQKYPDFKVENNILYKHILSPIESLSNMSEWKIVVPTPNRENILHMFHDEVTAGHFGFYKTYHRIAELYYWPGMRKSIKRYISKCMVCATCKPSNLPQAGLMGSFRNINFPWQMISMDLIGPYPRSYKGNTYCLVVVDYFTKFPLVCPLRQATTPAILKYLEEQVFLVYGVPQIVSCDNGPQFVSKAFKDLLAKYKVQKTFYNAAYHPQANHTERVNRSIVTALRSYTYPDHRAXDQYIHSIAQAIRTSVHEVTQCSPAYLNFGRNVALSGELFWCNFRQFRKSSSNI

SEQ ID NO: 29952 - protein, 36 aa, Diabrotica virgifera
  misc_feature: Coding regions on vcDNA: vcDNA=SeqID_9649; Strand=+; Position=3-110
DAWGGLHRLQSLGMTHVGREADRPGFKIKQKRIVEA

SEQ ID NO: 29953 - protein, 245 aa, Diabrotica virgifera
  misc_feature: Coding regions on vcDNA: vcDNA=SeqID_9650; Strand=+; Position=104-838
  misc_feature: Homolog annotation: Hit_ID=NP_651621.2; Match level="QueryCoverage =87%, HitCoverage=32%, E-value=7e-58, Identity=52%"; Hit description =CG12413-PA [Drosophila melanogaster] gb|AAF56796.2| CG12413-PA [Drosophila melanogaster]
  misc_feature: Pfam annotation: Pfam_ID=GTP_EFTU; Match level="Score=-16.1, E-value =1e-05, Copies=1"; Pfam description=Elongation factor Tu GTP binding domai
MNVTCRWISSVIYRKTRHKARLVQCIYPSSIHTSFVNSKRRKTAEERKSTRIIEYSPKAKGEVIDVWRNITLEELAKVMNQDIRYVYDIFLNQFNNPKISITDIKLLQQGITRSGRRMRIIGKPEDTIEEVIKRDAFPRPPPNKSELRPRPPVVTVMGHIDHGKTTLLDALRNARVVDEEFGGITQHIGAFSVVLDSGARITFLDTPGHAAFTAMRSRGANLTDLVVLVVAADDGVMGQTLAGGS

SEQ ID NO: 29954 - protein, 25 aa, Diabrotica virgifera
  misc_feature: Coding regions on vcDNA: vcDNA=SeqID_9651; Strand=+; Position=1-75
  misc_feature (2)..(24): Xaa can be any naturally occurring amino acid
NXXXXXXXXXXXXXXXXXXXXXXXG

SEQ ID NO: 29955 - protein, 93 aa, Diabrotica virgifera
  misc_feature: Coding regions on vcDNA: vcDNA=SeqID_9652; Strand=+; Position=2-283
  misc_feature: Homolog annotation: Hit_ID=EAL26655.1; Match level="QueryCoverage =100%, HitCoverage=12%, E-value=2e-25, Identity=62%"; Hit description= GA20935-PA [Drosophila pseudoobscura]
  misc_feature: Gene Ontology Annotation: Molecular function=calcium ion binding; Cellular component=mitochondrion; Biological process=glucose catabolism
DRKGYVSINDIRRSLKSLGMKLTDDEIHVLLSEINLMFNGQLDMADYLHMMSAIKSGHVAYSRFARMAELEEIKQETELLKKKVSVERSGGGL

SEQ ID NO: 29956 - protein, 73 aa, Diabrotica virgifera
  misc_feature: Coding regions on vcDNA: vcDNA=SeqID_9653; Strand=-; Position=0-218
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PFXXXXXXXXXXXTNLAHTGLNXXXXXXXXSNXXXXXXXXXXXXXXPTSRSXXXXXXXXXXXXXXVIPKVIYS

SEQ ID NO: 29957 - protein, 218 aa, Diabrotica virgifera
  misc_feature: Coding regions on vcDNA: vcDNA=SeqID_9654; Strand=-; Position=0-653
  misc_feature (1)..(13): Xaa can be any naturally occurring amino acid
  misc_feature (19)..(52): Xaa can be any naturally occurring amino acid
  misc_feature (68)..(74): Xaa can be any naturally occurring amino acid
  misc_feature (78)..(94): Xaa can be any naturally occurring amino acid
  misc_feature (100)..(107): Xaa can be any naturally occurring amino acid
  misc_feature (116)..(126): Xaa can be any naturally occurring amino acid
  misc_feature (129)..(165): Xaa can be any naturally occurring amino acid
  misc_feature (167)..(174): Xaa can be any naturally occurring amino acid
  misc_feature (178)..(198): Xaa can be any naturally occurring amino acid
  misc_feature (203)..(209): Xaa can be any naturally occurring amino acid
XXXXXXXXXXXXXCFFSPXXXXXXXXXXXXXXXXXXXXXXXXXXXXXXXXXXPPPRAGRRGENQPPLXXXXXXXGWGXXXXXXXXXXXXXXXXXKQTKSXXXXXXXXERGRRGEKXXXXXXXXXXXLPXXXXXXXXXXXXXXXXXXXXXXXXXXXXXXXXXXXXXVXXXXXXXXGGAXXXXXXXXXXXXXXXXXXXXXPPLPXXXXXXXRGRGCFFLS

SEQ ID NO: 29958 - protein, 289 aa, Diabrotica virgifera
  misc_feature: Coding regions on vcDNA: vcDNA=SeqID_9655; Strand=-; Position=0-866
  misc_feature (3)..(43): Xaa can be any naturally occurring amino acid
  misc_feature (45)..(56): Xaa can be any naturally occurring amino acid
  misc_feature (60)..(105): Xaa can be any naturally occurring amino acid
  misc_feature (112)..(129): Xaa can be any naturally occurring amino acid
  misc_feature (132)..(152): Xaa can be any naturally occurring amino acid
  misc_feature (156)..(171): Xaa can be any naturally occurring amino acid
  misc_feature (173)..(187): Xaa can be any naturally occurring amino acid
  misc_feature (196)..(219): Xaa can be any naturally occurring amino acid
  misc_feature (231)..(245): Xaa can be any naturally occurring amino acid
  misc_feature (248)..(257): Xaa can be any naturally occurring amino acid
  misc_feature (264)..(288): Xaa can be any naturally occurring amino acid
WLXXXXXXXXXXXXXXXXXXXXXXXXXXXXXXXXXXXXXXXXXPXXXXXXXXXXXXRGVXXXXXXXXXXXXXXXXXXXXXXXXXXXXXXXXXXXXXXXXXXXXXXPRVFSLXXXXXXXXXXXXXXXXXXPAXXXXXXXXXXXXXXXXXXXXXWGGXXXXXXXXXXXXXXXXWXXXXXXXXXXXXXXXTPPLFIVLXXXXXXXXXXXXXXXXXXXXXXXXSLSPPAGGVVVXXXXXXXXXXXXXXXNAXXXXXXXXXXGGGARLXXXXXXXXXXXXXXXXXXXXXXXXXG

SEQ ID NO: 29959 - protein, 206 aa, Diabrotica virgifera
  misc_feature: Coding regions on vcDNA: vcDNA=SeqID_9656; Strand=+; Position=88-708
  misc_feature: Homolog annotation: Hit_ID=NP_610355.1; Match level="QueryCoverage =50%, HitCoverage=18%, E-value=4e-13, Identity=41%"; Hit description =CG2158-PA [Drosophila melanogaster] gb|AAF59131.1| CG2158-PA [Drosophila melanogaster]
  misc_feature (15)..(30): Xaa can be any naturally occurring amino acid
VNHILRYTNLPLVDXXXXXXXXXXXXXXXXWDKEEPPEDAGTFQRASEDSLKSRVIKTARRRNPISSVRDGGDGEKKSAFTSFTGFGKAAPPTSTAFSFLSNLAKPNTPPKVNGTGGISEKSKNDASAFKYSSSPVDQVIREHIPASMYKSEISCIMILHDNHTTPAVIKGGLRFKYVVIEFDFDLLLESSYVIFIYTLENEDSSV

SEQ ID NO: 29960 - protein, 28 aa, Diabrotica virgifera
  misc_feature: Coding regions on vcDNA: vcDNA=SeqID_9657; Strand=-; Position=1-84
  misc_feature (11)..(12): Xaa can be any naturally occurring amino acid
SRTIVVTTMCXXVVDHCSLARKTQLISL

SEQ ID NO: 29961 - protein, 40 aa, Diabrotica virgifera
  misc_feature: Coding regions on vcDNA: vcDNA=SeqID_9658; Strand=-; Position=1-120
  misc_feature (1)..(40): Xaa can be any naturally occurring amino acid
XXXXXXXXXXXXXXXXXXXXXXXXXXXXXXXXXXXXXXXX

SEQ ID NO: 29962 - protein, 140 aa, Diabrotica virgifera
  misc_feature: Coding regions on vcDNA: vcDNA=SeqID_9659; Strand=-; Position=1-420
  misc_feature (11)..(44): Xaa can be any naturally occurring amino acid
  misc_feature (49)..(60): Xaa can be any naturally occurring amino acid
  misc_feature (75)..(96): Xaa can be any naturally occurring amino acid
  misc_feature (105)..(111): Xaa can be any naturally occurring amino acid
  misc_feature (118)..(134): Xaa can be any naturally occurring amino acid
RGRPPRFFMLXXXXXXXXXXXXXXXXXXXXXXXXXXXXXXXXXXGAPPXXXXXXXXXXXXSHIRISAHPTPLPPXXXXXXXXXXXXXXXXXXXXXXKGRSQKKEXXXXXXXHPKTSCXXXXXXXXXXXXXXXXXGCGAAP

SEQ ID NO: 29963 - protein, 302 aa, Diabrotica virgifera
  misc_feature: Coding regions on vcDNA: vcDNA=SeqID_9660; Strand=-; Position=1-906
  misc_feature (7)..(285): Xaa can be any naturally occurring amino acid
  misc_feature (288)..(302): Xaa can be any naturally occurring amino acid
KNGSKNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 29964 - protein, 25 aa, Diabrotica virgifera
  misc_feature: Coding regions on vcDNA: vcDNA=SeqID_9661; Strand=-; Position=1-75
  misc_feature (9)..(25): Xaa can be any naturally occurring amino acid
LIINIKLHXXXXXXXXXXXXXXXXX

SEQ ID NO: 29965 - protein, 218 aa, Diabrotica virgifera
  misc_feature: Coding regions on vcDNA: vcDNA=SeqID_9662; Strand=+; Position=1-654
  misc_feature (2)..(12): Xaa can be any naturally occurring amino acid
  misc_feature (16)..(24): Xaa can be any naturally occurring amino acid
  misc_feature (35)..(112): Xaa can be any naturally occurring amino acid
  misc_feature (117)..(137): Xaa can be any naturally occurring amino acid
  misc_feature (140)..(146): Xaa can be any naturally occurring amino acid
  misc_feature (174)..(190): Xaa can be any naturally occurring amino acid
  misc_feature (199)..(208): Xaa can be any naturally occurring amino acid
  misc_feature (210)..(218): Xaa can be any naturally occurring amino acid
LXXXXXXXXXXXKKEXXXXXXXXXFWVGGWGGRTXXXXXXXXXXXXXXXXXXXXXXXXXXXXXXXXXXXXXXXXXXXXXXXXXXXXXXXXXXXXXXXXXXXXXXXXXXXXXXINFLXXXXXXXXXXXXXXXXXXXXXEAXXXXXXXRTPPHSYCFLFVVVVLFLFLFLDRRGRXXXXXXXXXXXXXXXXXSPSPLPGGXXXXXXXXXXDXXXXXXXXX

SEQ ID NO: 29966 - protein, 44 aa, Diabrotica virgifera
  misc_feature: Coding regions on vcDNA: vcDNA=SeqID_9663; Strand=-; Position=0-131
  misc_feature (1)..(11): Xaa can be any naturally occurring amino acid
  misc_feature (15)..(15): Xaa can be any naturally occurring amino acid
XXXXXXXXXXXLSHXNNFFLIAKIPKFRFLSCFHFPLSLFPLEL

SEQ ID NO: 29967 - protein, 26 aa, Diabrotica virgifera
  misc_feature: Coding regions on vcDNA: vcDNA=SeqID_9664; Strand=-; Position=0-77
VKVHPSAFKTSPSGILLIQPLTKTPS

SEQ ID NO: 29968 - protein, 54 aa, Diabrotica virgifera
  misc_feature: Coding regions on vcDNA: vcDNA=SeqID_9665; Strand=+; Position=3-164
  misc_feature (40)..(40): Xaa can be any naturally occurring amino acid
  misc_feature (49)..(49): Xaa can be any naturally occurring amino acid
KAVFSSANNLKMERVTRICAQHLIKHLSAENCVEIRSLPXICRNKKLSXQWIPS

SEQ ID NO: 29969 - protein, 212 aa, Diabrotica virgifera
  misc_feature: Coding regions on vcDNA: vcDNA=SeqID_9666; Strand=+; Position=69-709
  misc_feature: Homolog annotation: Hit_ID=NP_996253.1; Match level="QueryCoverage =100%, HitCoverage=65%, E-value=2e-58, Identity=55%"; Hit description= CG5730-PC, isoform C [Drosophila melanogaster] gb|AAS65189.1| CG5730 -PC, isoform C [Drosophila
  misc_feature: Gene Ontology Annotation: Molecular function=anticoagulant activity; Cellular component=nuclear membrane
  misc_feature: Pfam annotation: Pfam_ID=Annexin; Match level="Score=73.7, E-value =4.9e-19, Copies=2"; Pfam description=Annexin
  misc_feature (95)..(95): Xaa can be any naturally occurring amino acid
  misc_feature (159)..(159): Xaa can be any naturally occurring amino acid
  misc_feature (191)..(191): Xaa can be any naturally occurring amino acid
MSNRAYHPFKCTPTGYPDYPFYPVADAASLKNAMLSFDTGKKYFIHVLSRRGIVQRLDISETFETSYSKHLGSELKIKLGSMFHDEMEALMTPLXQLYDVELHKAIACMATAEEAIIHILCTFSHYGMRTISQFYQQMYSSPLEQHLTGDTLGHFEWLXVSLVQANLDEKEGDNAQQALTDSEAMIEAGEXNEATEYPIFNAVLIAKSYQQL

SEQ ID NO: 29970 - protein, 269 aa, Diabrotica virgifera
  misc_feature: Coding regions on vcDNA: vcDNA=SeqID_9667; Strand=-; Position=1-807
  misc_feature (5)..(269): Xaa can be any naturally occurring amino acid
YFNNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29971 - protein, 49 aa, Diabrotica virgifera
  misc_feature: Coding regions on vcDNA: vcDNA=SeqID_9668; Strand=+; Position=31-180
  misc_feature (10)..(19): Xaa can be any naturally occurring amino acid
DIKEFLRFLXXXXXXXXXXRCADYKSVIFIFFVILVRYEFYFYRIGAFS

SEQ ID NO: 29972 - protein, 99 aa, Diabrotica virgifera
  misc_feature: Coding regions on vcDNA: vcDNA=SeqID_9669; Strand=+; Position=443-739
  misc_feature (8)..(16): Xaa can be any naturally occurring amino acid
  misc_feature (40)..(54): Xaa can be any naturally occurring amino acid
  misc_feature (57)..(64): Xaa can be any naturally occurring amino acid
NMFLVIFXXXXXXXXXQCFITHHTFKSSKFSDDANCSQMXXXXXXXXXXXXXXXRTXXXXXXXXHVALYDPYRLACPLINLNGRGISTVLMSHRHYTSY

SEQ ID NO: 29973 - protein, 81 aa, Diabrotica virgifera
  misc_feature: Coding regions on vcDNA: vcDNA=SeqID_9670; Strand=-; Position=453-698
  misc_feature (48)..(54): Xaa can be any naturally occurring amino acid
  misc_feature (72)..(78): Xaa can be any naturally occurring amino acid
KLLLVFVEYLKLESSTNLDLRNVLEIDLPQLLNLVVLLLLERVSHLFXXXXXXXRNAFCTKKIFIWQFFNKXXXXXXXCSH

SEQ ID NO: 29974 - protein, 36 aa, Diabrotica virgifera
  misc_feature: Coding regions on vcDNA: vcDNA=SeqID_9671; Strand=+; Position=1-108
  misc_feature (1)..(33): Xaa can be any naturally occurring amino acid
XXXXXXXXXXXXXXXXXXXXXXXXXXXXXXXXXLKS

SEQ ID NO: 29975 - protein, 49 aa, Diabrotica virgifera
  misc_feature: Coding regions on vcDNA: vcDNA=SeqID_9672; Strand=-; Position=0-146
SADSAVSLVEIIRLRSKAHSRIKLALICNITQRGKHIKTQTYPGAAVRG

SEQ ID NO: 29976 - protein, 104 aa, Diabrotica virgifera
  misc_feature: Coding regions on vcDNA: vcDNA=SeqID_9673; Strand=-; Position=315-629
KLNCSLRNICNKYASLLIFYIIKNFPILEACSSYYFLISDSVCPMTILRLQRSHQISKTSSLLMKLALQRPCFHSVKEKRPNVKPLKPLTRKIFQEFDCALTEI

SEQ ID NO: 29977 - protein, 64 aa, Diabrotica virgifera
  misc_feature: Coding regions on vcDNA: vcDNA=SeqID_9674; Strand=-; Position=117-311
YKIKFHSTTRKPAAPRDMFHLLETRKERYLKNFIKPLFSAHHLPIRAHDYPHGWGIVRKVTFRF

SEQ ID NO: 29978 - protein, 80 aa, Diabrotica virgifera
  misc_feature: Coding regions on vcDNA: vcDNA=SeqID_9675; Strand=+; Position=1-243
  misc_feature (64)..(69): Xaa can be any naturally occurring amino acid
  misc_feature (71)..(78): Xaa can be any naturally occurring amino acid
ISGNVRKHVVCREREQGNIVRTSPCVVNQNNNKTNNTIKYNKKRVCVLRTRVRSYTSTIMILTXXXXXXQXXXXXXXXLH

SEQ ID NO: 29979 - protein, 92 aa, Diabrotica virgifera
  misc_feature: Coding regions on vcDNA: vcDNA=SeqID_9676; Strand=+; Position=554-831
  misc_feature: Homolog annotation: Hit_ID=XP_525925.1; Match level="QueryCoverage =91%, HitCoverage=67%, E-value=2e-24, Identity=74%"; Hit description =PREDICTED: similar to rRNA intron-encoded homing endonuclease [Pan troglodytes]
  misc_feature (45)..(45): Xaa can be any naturally occurring amino acid
NSWIVARRTEAKAFAKNAFIDQERKLEVRRRSDTALVLTINDASXAIRRRSPMTRRAASGKPKLLGSGGSMVAKLKLKGIDGRAPPGVEPAA

SEQ ID NO: 29980 - protein, 287 aa, Diabrotica virgifera
  misc_feature: Coding regions on vcDNA: vcDNA=SeqID_9677; Strand=-; Position=1-861
  misc_feature (1)..(7): Xaa can be any naturally occurring amino acid
  misc_feature (9)..(287): Xaa can be any naturally occurring amino acid
XXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29981 - protein, 76 aa, Diabrotica virgifera
  misc_feature: Coding regions on vcDNA: vcDNA=SeqID_9678; Strand=+; Position=38-265
  misc_feature (4)..(17): Xaa can be any naturally occurring amino acid
  misc_feature (40)..(46): Xaa can be any naturally occurring amino acid
  misc_feature (57)..(74): Xaa can be any naturally occurring amino acid
GINXXXXXXXXXXXXXXCPPQGWVKIIYLGEAAYFINSVXXXXXXXDLELNPGGTPXXXXXXXXXXXXXXXXXXGP

SEQ ID NO: 29982 - protein, 46 aa, Diabrotica virgifera
  misc_feature: Coding regions on vcDNA: vcDNA=SeqID_9679; Strand=-; Position=0-137
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
FXXXXXXXXXXXNQPGSHRFKXXXXXXXXXEXXXXXXXXXXXXXXS

SEQ ID NO: 29983 - protein, 285 aa, Diabrotica virgifera
  misc_feature: Coding regions on vcDNA: vcDNA=SeqID_9680; Strand=+; Position=156-1010
  misc_feature: Homolog annotation: Hit_ID=P23414; Match level="QueryCoverage=97%, HitCoverage=50%, E-value=1e-147, Identity=89%"; Hit description =Acetylcholine receptor protein, alpha-L1 chain precursor emb|CAA39081.1| neuronal nicotinic
  misc_feature: Gene Ontology Annotation: Molecular function=acetylcholine receptor activity; Cellular component=nicotinic acetylcholine-gated receptor -channel complex; Biological process=synaptic transmission
  misc_feature: Pfam annotation: Pfam_ID=Neur_chan_LBD; Match level="Score=365.6, E -value=6.9e-107, Copies=1"; Pfam description=Neurotransmitter-gated ion-channel lig
  misc_feature (232)..(232): Xaa can be any naturally occurring amino acid
MKLEWMIFVLYLFCVLDFCLCNPDAKRLYDDLLSNYNRLIRPVSNNTDTVLVKLGLRLSQLIELNLKDQILTTNVWLEHEWQDHKFMWDPQEYGGVTELYVPSEHIWLPDIVLYNNADGEYVVTTMTKAVLRHTGKVLWTPPAIFKSSCEIDVRYFPFDQQTCFMKFGSWTYDGNQIDLKHINQKLGEDKVEVGIDLREYYPSVEWDILGVPAERHERYYPCCAEPYPDIFXHITLRKKTLFYTVNLIVPCVGISYLSVLVVYLPADSGEKIALCINILLSQTMV

SEQ ID NO: 29984 - protein, 181 aa, Diabrotica virgifera
  misc_feature: Coding regions on vcDNA: vcDNA=SeqID_9681; Strand=+; Position=102-646
  misc_feature: Homolog annotation: Hit_ID=XP_391961.1; Match level="QueryCoverage =100%, HitCoverage=13%, E-value=3e-31, Identity=43%"; Hit description= similar to putative tropomyosin [Apis mellifera]
  misc_feature: Gene Ontology Annotation: Molecular function=structural constituent of cytoskeleton; Cellular component=muscle thin filament tropomyosin; Biological process=pole plasm oskar mRNA localization
  misc_feature: Pfam annotation: Pfam_ID=Tropomyosin; Match level="Score=-10.5, E -value=1.2e-05, Copies=1"; Pfam description=Tropomyosin
  misc_feature (56)..(56): Xaa can be any naturally occurring amino acid
  misc_feature (89)..(89): Xaa can be any naturally occurring amino acid
  misc_feature (119)..(119): Xaa can be any naturally occurring amino acid
  misc_feature (150)..(150): Xaa can be any naturally occurring amino acid
QRQCKDASGHAEYDNEEIRDFADKLTPFKNDLTTNKNALQYANQQLENQEYALTSXEPEIPSHHLRAHLLEEDLKRTEETLRSTTTKWXTDYYTSSNDESSLMTRALENRVHLDEKRMXTATTRSKKSLYMAVHADNISEEVSRKLATVXDKLAINEDRRKGVDSKIMELYEKLKVGRNTL

SEQ ID NO: 29985 - protein, 285 aa, Diabrotica virgifera
  misc_feature: Coding regions on vcDNA: vcDNA=SeqID_9682; Strand=+; Position=1-855
  misc_feature (1)..(284): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 29986 - protein, 209 aa, Diabrotica virgifera
  misc_feature: Coding regions on vcDNA: vcDNA=SeqID_9683; Strand=+; Position=2-631
  misc_feature: Homolog annotation: Hit_ID=AAQ63406.1; Match level="QueryCoverage =97%, HitCoverage=18%, E-value=1e-33, Identity=38%"; Hit description =nardilysin isoform [Homo sapiens]
  misc_feature: Gene Ontology Annotation: Molecular function=signal transducer activity; Cellular component=soluble fraction; Biological process =cell-cell signaling
EEPLFDILRTKEQLGYHVYCALRDTYGVLGYSITVNSQANKFTTKHLDNRIEEFLKHTETIIEKSSGKEYEEMKQGLIETKEIVDSHLKEEVDRNWSEIINDEYMFDRSKQEIEEIKQVLHEDVKNWWNRHNYFGTKGNFRKISVQVVGHVPDDASKGEPAEPSFTKKVQLKILDSDNEIVEAKSPDYFVSEIDQFRSKLQSYPARLKK

SEQ ID NO: 29987 - protein, 299 aa, Diabrotica virgifera
  misc_feature: Coding regions on vcDNA: vcDNA=SeqID_9684; Strand=+; Position=18-916
  misc_feature: Homolog annotation: Hit_ID=XP_314141.1; Match level="QueryCoverage =73%, HitCoverage=44%, E-value=4e-54, Identity=49%"; Hit description =ENSANGP00000003806 [Anopheles gambiae]
  misc_feature: Gene Ontology Annotation: Molecular function=glucose transporter activity; Cellular component=membrane; Biological process=glucose transport
  misc_feature (195)..(195): Xaa can be any naturally occurring amino acid
  misc_feature (200)..(200): Xaa can be any naturally occurring amino acid
  misc_feature (279)..(279): Xaa can be any naturally occurring amino acid
MHFNFVYRRVPLVVDYRTSSRFNTRTVFDFGGSLHYLCYFIMEQGGVSECLFSGADGPRGRKNSWQLPYTDISIERPGWTFLLILAGTATTIGLSLPVGYNIGVVNTPAEIIKEFCRNIITERFGNEPSTYQLELIWSSIVSIFLVGAAIGSLGGSVLADKIGRKGVLAVCSGLAALSALVFFISRPVMSIELFXSEDYXVGFSSGLTTTVVPMYLTELAPIHLRGSTGVLCPLGVTIGVLMGQIMSMHDILGNNDYWPYCLAAYVIPVIICSFTLPIXPESPKYLFCIKRDQQRAVQH

SEQ ID NO: 29988 - protein, 127 aa, Diabrotica virgifera
  misc_feature: Coding regions on vcDNA: vcDNA=SeqID_9685; Strand=-; Position=1-381
  misc_feature (1)..(127): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 29989 - protein, 302 aa, Diabrotica virgifera
  misc_feature: Coding regions on vcDNA: vcDNA=SeqID_9686; Strand=+; Position=1-909
  misc_feature (1)..(244): Xaa can be any naturally occurring amino acid
  misc_feature (247)..(276): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGGXXXXXXXXXXXXXXXXXXXXXXXXXXXXXXLKENSVILWESSNRYKDCNSEVGLKV

SEQ ID NO: 29990 - protein, 93 aa, Diabrotica virgifera
  misc_feature: Coding regions on vcDNA: vcDNA=SeqID_9687; Strand=+; Position=8-289
RPEVFASRNTSFPLGSLTYCGCGRDICRRRCLLQRCTAVAPEEHPFLLSESPLILPAILLETTQSMVESFVTTTIVELITDVLSLARVWSYLC

SEQ ID NO: 29991 - protein, 275 aa, Diabrotica virgifera
  misc_feature: Coding regions on vcDNA: vcDNA=SeqID_9688; Strand=+; Position=26-853
  misc_feature: Homolog annotation: Hit_ID=NP_652705.1; Match level="QueryCoverage =98%, HitCoverage=7%, E-value=7e-18, Identity=28%"; Hit description =CG1915-PC, isoform C [Drosophila melanogaster] gb|AAG22226.2| CG1915- PC, isoform C [Drosophila
  misc_feature: Gene Ontology Annotation: Biological process=mitotic chromosome condensation
  misc_feature (191)..(198): Xaa can be any naturally occurring amino acid
  misc_feature (230)..(230): Xaa can be any naturally occurring amino acid
  misc_feature (242)..(248): Xaa can be any naturally occurring amino acid
KKRKQKDVLKSTEEDVEPSEGIVQEVEEEEIITEEKVELVADETTSKLQQSTVTVVEEPVNLAAPRKIEPKTTKAPKFLLKSRIVHVPFPPENEANSIPVIKELPPVYRDNGVLSRNLKESEKVPKKKKIRVKDIEREIKSLEKLDKDFEDSKKGLEKVDDEYKAPKKPKEKPEIIEEEAKPLKIGKGKLXXXXXXXXPDEKLPEEVTKKPKKPKVKPKPETEEITLELXKGQPKEEEETPXXXXXXXQKPKPEEVVEKPGLKPFKKKMITRHIQ

SEQ ID NO: 29992 - protein, 294 aa, Diabrotica virgifera
  misc_feature: Coding regions on vcDNA: vcDNA=SeqID_9689; Strand=-; Position=2-884
  misc_feature: Homolog annotation: Hit_ID=XP_397439.1; Match level="QueryCoverage =81%, HitCoverage=23%, E-value=2e-81, Identity=57%"; Hit description =similar to ENSANGP00000015381 [Apis mellifera]
  misc_feature: Gene Ontology Annotation: Biological process=protein biosynthesis
  misc_feature: Pfam annotation: Pfam_ID=PCI; Match level="Score=27.4, E-value=4.2e -05, Copies=1"; Pfam description=PCI domain
  misc_feature (9)..(9): Xaa can be any naturally occurring amino acid
  misc_feature (190)..(190): Xaa can be any naturally occurring amino acid
EFHPLLCVXRVHEVIKSLESEENAALQQYVPALQDVTLVRLVRQIAQVYQTIEFARLIQIAKFTTPFHLERLLVDCVRHNDMQIRIDHGKDCIHFGMDLSESQREDKPEGPTLQVMPSEQVRNQLINMSTVLNQAIQVINPNKKKLEREKLRAVMVQNYHETKVREHQKILQRHKIIEDRKEYIERLNSXKEQEQQERALKEEQERKKKEHQESLDRAWTMQKAKEEEIEKKLAMEKESSDKGKDSWRKDPKNSSSWRRDEKPADEPKNEPWRASRFRSNAEEPPKGDNTTTSS

SEQ ID NO: 29993 - protein, 109 aa, Diabrotica virgifera
  misc_feature: Coding regions on vcDNA: vcDNA=SeqID_9690; Strand=-; Position=1-327
WAVHRWYTTEEYCIVGLMIFSVGRWFFLSGLGSVPLSWLASGFLPSGVLFGPGLVLWVFGRVYGRLWSVAPVLGCVLCCAACFSPGCLGGFWLLVYFVVVGFVLFVCPW

SEQ ID NO: 29994 - protein, 198 aa, Diabrotica virgifera
  misc_feature: Coding regions on vcDNA: vcDNA=SeqID_9691; Strand=-; Position=89-685
  misc_feature: Homolog annotation: Hit_ID=NP_501308.1; Match level="QueryCoverage =92%, HitCoverage=70%, E-value=1e-23, Identity=35%"; Hit description =predicted CDS, reverse transcriptase family member (4I638) [Caenorhabditis elegans]
SVIDNVSLENVDHYIYLGHTIKIGKENQISEIKRRIQLSWVAFGKLSFILKNKDIPMCLKRRVYDKCILPVTTYGLETMAFTKKTLEQLSTTQRAMERTMLAISLRDRILNIDIRERTKMTDVAERIARQWVGHVARDNPEKWTQRLTNWRPTENRRGVGRPQKRWADDIKQVAGKQWMRIAKSRNRWKQMEEAYVQQ

SEQ ID NO: 29995 - protein, 239 aa, Diabrotica virgifera
  misc_feature: Coding regions on vcDNA: vcDNA=SeqID_9692; Strand=+; Position=48-767
  misc_feature: Homolog annotation: Hit_ID=AAC61264.1; Match level="QueryCoverage =100%, HitCoverage=39%, E-value=7e-98, Identity=73%"; Hit description= soluble guanylyl cyclase beta-1 subunit [Manduca sexta]
  misc_feature: Gene Ontology Annotation: Molecular function=guanylate cyclase activity; Cellular component=guanylate cyclase complex, soluble; Biological process=signal transduction
  misc_feature: Pfam annotation: Pfam_ID=HNOB; Match level="Score=233.4, E-value=4.2e- 67, Copies=1"; Pfam description=Heme NO binding
  misc_feature (14)..(21): Xaa can be any naturally occurring amino acid
  misc_feature (71)..(78): Xaa can be any naturally occurring amino acid
MYGFVNYALEVLVXXXXXXXXWEIIKKKADFQMEGHFLVRQIYEDELTYNLIGAAVEVLKIPATTILELFXXXXXXXXQDSGYDKILQVLGATPRDFLTNLDALHDHLGTLYPGMKAPSFRCTERPEDGALILHYYSDRAGLEHIVIGIVKTVASRLHNTEVEVELIQTKDESDHVQFLITEKFGTKKSQLREMDEIETLSLEPKVSPATFCRIFPFHIMFDAEMKIVQTGFSVAKIIP

SEQ ID NO: 29996 - protein, 20 aa, Diabrotica virgifera
  misc_feature: Coding regions on vcDNA: vcDNA=SeqID_9693; Strand=-; Position=1-60
NKKQQGLHDVSYVTELGRGG

SEQ ID NO: 29997 - protein, 106 aa, Diabrotica virgifera
  misc_feature: Coding regions on vcDNA: vcDNA=SeqID_9694; Strand=-; Position=202-522
  misc_feature (7)..(24): Xaa can be any naturally occurring amino acid
  misc_feature (27)..(33): Xaa can be any naturally occurring amino acid
  misc_feature (39)..(61): Xaa can be any naturally occurring amino acid
  misc_feature (63)..(86): Xaa can be any naturally occurring amino acid
ESWNEGXXXXXXXXXXXXXXXXXXLKXXXXXXXREDPIXXXXXXXXXXXXXXXXXXXXXXXGXXXXXXXXXXXXXXXXXXXXXXXXIIRINYLRDNSVILLESSNR

SEQ ID NO: 29998 - protein, 46 aa, Diabrotica virgifera
  misc_feature: Coding regions on vcDNA: vcDNA=SeqID_9695; Strand=-; Position=1-138
  misc_feature (2)..(9): Xaa can be any naturally occurring amino acid
  misc_feature (12)..(19): Xaa can be any naturally occurring amino acid
  misc_feature (32)..(44): Xaa can be any naturally occurring amino acid
TXXXXXXXXSTXXXXXXXXPIITFNPTIEVAXXXXXXXXXXXXXLL

SEQ ID NO: 29999 - protein, 78 aa, Diabrotica virgifera
  misc_feature: Coding regions on vcDNA: vcDNA=SeqID_9696; Strand=+; Position=333-569
  misc_feature (37)..(42): Xaa can be any naturally occurring amino acid
  misc_feature (44)..(50): Xaa can be any naturally occurring amino acid
IMQYLIYKYLISQILDISIHYKHVNVWLVFMFPALLXXXXXXHXXXXXXXWRYTCHKIIAGNLNLKLVTNSFVFEWCG

SEQ ID NO: 30000 - protein, 267 aa, Diabrotica virgifera
  misc_feature: Coding regions on vcDNA: vcDNA=SeqID_9697; Strand=+; Position=138-941
  misc_feature: Homolog annotation: Hit_ID=XP_393193.1; Match level="QueryCoverage =77%, HitCoverage=69%, E-value=2e-14, Identity=27%"; Hit description =similar to ENSANGP00000012540 [Apis mellifera]
  misc_feature: Pfam annotation: Pfam_ID=C1-set; Match level="Score=-10.4, E-value =0.0074, Copies=1"; Pfam description=Immunoglobulin C1-set domain
MIGFEMDKFKFVLTVGFLSCAYSTIVIKDMTVPQSIELNSTVDHADFDCNYEAVNESDIEVKWFFNGDVEQVYQWLPGYNTTGYGMNSLRDKLDIEYKATNDSDTEYRGFRIKHIGRELTGNYTCKVSSDTHEAYDTRQMVIYTPVESELDLVLLSSDALVKCMASGISPMPEVDFSLLSENGTKIDLTETVEMDDDSEGYYNITATHNFASYNHTLTGPTKFICNVSIPGTSYFLTKEITHQGSTASLIPGFSITFHSTYIIVTDA

SEQ ID NO: 30001 - protein, 82 aa, Diabrotica virgifera
  misc_feature: Coding regions on vcDNA: vcDNA=SeqID_9698; Strand=-; Position=186-434
  misc_feature (35)..(44): Xaa can be any naturally occurring amino acid
  misc_feature (72)..(81): Xaa can be any naturally occurring amino acid
RMQLMQHKLQLSVLKCMLNQHSRFCYLAHPAIKKXXXXXXXXXXNNILHNVKLLSNSSYTYTYNEVNLNRKXXXXXXXXXXN

SEQ ID NO: 30002 - protein, 312 aa, Diabrotica virgifera
  misc_feature: Coding regions on vcDNA: vcDNA=SeqID_9699; Strand=+; Position=2-940
  misc_feature: Homolog annotation: Hit_ID=XP_316779.1; Match level="QueryCoverage =92%, HitCoverage=34%, E-value=2e-47, Identity=38%"; Hit description =ENSANGP00000012127 [Anopheles gambiae]
DAQELKLRKLRALRGQVDQHKQNNISLTSDLDSIRALFNEKEKELSLAVAKVEELTRQLEELRRGRSNKNSPPPSALELDKLRRELMYRNKLNEQQNQRLHQQREALTARQEEMSAIDKRISELQERLHRKRMLNQQLANQISATSHKAAYHQLVRLTGNQDQTNQAAFARKHQQNNDRKGLSRGNIAAVEPYNHIPVQPQPTHQINNINTHPDIKLQSTYDPYQPVYYMKKDQDSPKSNLESQDVGSKLPNLYPPKTDENELHKDFPASKTDPKYQTLPYNTKFTVNLIMKHANKPNKEEISKTTKTNRRY

SEQ ID NO: 30003 - protein, 37 aa, Diabrotica virgifera
  misc_feature: Coding regions on vcDNA: vcDNA=SeqID_9700; Strand=-; Position=2-112
  misc_feature (6)..(14): Xaa can be any naturally occurring amino acid
GSRFNXXXXXXXXXVNSSSSDMVREIKKKLAMSGPAG

SEQ ID NO: 30004 - protein, 66 aa, Diabrotica virgifera; identical to SEQ ID NO: 26808
  misc_feature: Coding regions on vcDNA: vcDNA=SeqID_9701; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 30005 - protein, 52 aa, Diabrotica virgifera
  misc_feature: Coding regions on vcDNA: vcDNA=SeqID_9702; Strand=+; Position=79-234
  misc_feature (5)..(13): Xaa can be any naturally occurring amino acid
  misc_feature (38)..(48): Xaa can be any naturally occurring amino acid
RLIIXXXXXXXXXFRLLKFYMNLKFKPGGEARVGFLIXXXXXXXXXXXPKGT

SEQ ID NO: 30006 - protein, 50 aa, Diabrotica virgifera
  misc_feature: Coding regions on vcDNA: vcDNA=SeqID_9703; Strand=+; Position=170-319
YYFPATSRIYKHPNDFRSLMGETSTPRTSHGKRRPSTQDISRSTRDPPTI

SEQ ID NO: 30007 - protein, 298 aa, Diabrotica virgifera
  misc_feature: Coding regions on vcDNA: vcDNA=SeqID_9704; Strand=+; Position=2-895
  misc_feature: Homolog annotation: Hit_ID=T13798; Match level="QueryCoverage=78%, HitCoverage=15%, E-value=3e-29, Identity=30%"; Hit description =hypothetical protein - fruit fly (Drosophila melanogaster) retrotransposon mdg3 emb|CAA65152.1|
  misc_feature: Pfam annotation: Pfam_ID=RVT_1; Match level="Score=83.3, E-value=6.3e- 22, Copies=1"; Pfam description=Reverse transcriptase (RNA-dependent
  misc_feature (56)..(63): Xaa can be any naturally occurring amino acid
  misc_feature (167)..(173): Xaa can be any naturally occurring amino acid
ACVKLNLVQKIDSLKSQCDDKENFVKNNIEVFEGTGKVPFQYKIMLKNDYKPYISXXXXXXXXVKPLLKNTLEDLERRDIICRLDEPTEWVNNIVIVEKPNKSLRICLDPMHLNNNICTEQFPIPTVDELSLKLQGKSIFTVLDLKEGFYHVPLDKESMNYTAFITXXXXXXXKRLAFGLNISPQVFQRINEKIFGDLNIGIYFDDLIIPASDEETHDLILSKVLQRAKKFGVKFNKNKIQYKVREVKYVGQIFSREGVKPDPSYVEAVLKYKIRLIKRVIKNNWYDYYLTKYIPILS

SEQ ID NO: 30008 - protein, 311 aa, Diabrotica virgifera
  misc_feature: Coding regions on vcDNA: vcDNA=SeqID_9705; Strand=-; Position=1-936
  misc_feature (3)..(310): Xaa can be any naturally occurring amino acid
LFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXT

SEQ ID NO: 30009 - protein, 301 aa, Diabrotica virgifera
  misc_feature: Coding regions on vcDNA: vcDNA=SeqID_9706; Strand=-; Position=1-903
  misc_feature (4)..(284): Xaa can be any naturally occurring amino acid
  misc_feature (287)..(301): Xaa can be any naturally occurring amino acid
QKIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 30010 - protein, 132 aa, Diabrotica virgifera
  misc_feature: Coding regions on vcDNA: vcDNA=SeqID_9707; Strand=-; Position=2-397
  misc_feature (15)..(15): Xaa can be any naturally occurring amino acid
  misc_feature (17)..(17): Xaa can be any naturally occurring amino acid
  misc_feature (20)..(132): Xaa can be any naturally occurring amino acid
NYAVSLKVIISYNQXNXIKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30011 - protein, 331 aa, Diabrotica virgifera
  misc_feature: Coding regions on vcDNA: vcDNA=SeqID_9708; Strand=-; Position=0-992
  misc_feature (1)..(315): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQEYVFCTLPVKSTSEA

SEQ ID NO: 30012 - protein, 104 aa, Diabrotica virgifera
  misc_feature: Coding regions on vcDNA: vcDNA=SeqID_9709; Strand=-; Position=1-312
  misc_feature (93)..(100): Xaa can be any naturally occurring amino acid
VYKNLQTHPFNPYRYHHSPEFTKSENNQFKELKPSTHFLLINYYMSKPKINVFLPPLTSHNGCSGLILQAAILNTPISGKKAYFRFQESILAXXXXXXXXLKDG

SEQ ID NO: 30013 - protein, 281 aa, Diabrotica virgifera
  misc_feature: Coding regions on vcDNA: vcDNA=SeqID_9710; Strand=-; Position=1-843
  misc_feature (4)..(265): Xaa can be any naturally occurring amino acid
  misc_feature (267)..(276): Xaa can be any naturally occurring amino acid
SKIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMXXXXXXXXXXTDEVG

SEQ ID NO: 30014 - protein, 268 aa, Diabrotica virgifera
  misc_feature: Coding regions on vcDNA: vcDNA=SeqID_9711; Strand=-; Position=6-812
  misc_feature (2)..(41): Xaa can be any naturally occurring amino acid
  misc_feature (44)..(67): Xaa can be any naturally occurring amino acid
  misc_feature (69)..(81): Xaa can be any naturally occurring amino acid
  misc_feature (86)..(207): Xaa can be any naturally occurring amino acid
  misc_feature (212)..(246): Xaa can be any naturally occurring amino acid
  misc_feature (251)..(262): Xaa can be any naturally occurring amino acid
LXXXXXXXXXXXXXXXXXXXXXXXXXXXXXXXXXXXXXXXXSIXXXXXXXXXXXXXXXXXXXXXXXXIXXXXXXXXXXXXXLFLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTISIXXXXXXXXXXXXXXXXXXXXXXXXXXXXXXXXXXXIPEVXXXXXXXXXXXXFSQDTD

SEQ ID NO: 30015 - protein, 98 aa, Diabrotica virgifera
  misc_feature: Coding regions on vcDNA: vcDNA=SeqID_9712; Strand=+; Position=380-677
  misc_feature: Homolog annotation: Hit_ID=CAH60167.1; Match level="QueryCoverage =97%, HitCoverage=18%, E-value=2e-18, Identity=48%"; Hit description =putative esterase [Tribolium confusum]
  misc_feature: Gene Ontology Annotation: Molecular function=carboxylesterase activity; Cellular component=synaptic junction
  misc_feature (40)..(40): Xaa can be any naturally occurring amino acid
  misc_feature (48)..(48): Xaa can be any naturally occurring amino acid
  misc_feature (58)..(58): Xaa can be any naturally occurring amino acid
  misc_feature (79)..(79): Xaa can be any naturally occurring amino acid
NLMTEDMNLESITDRVGLLGIIRIQDDSLDGPGYAGLKDXVLTLMWAXNHMNFNGDPXDVSIFGQSAGGSSVGGLLLSXTVQGLFHQVIVQRDSTFNS

SEQ ID NO: 30016 - protein, 314 aa, Diabrotica virgifera
  misc_feature: Coding regions on vcDNA: vcDNA=SeqID_9713; Strand=+; Position=24-964
  misc_feature: Homolog annotation: Hit_ID=NP_609487.2; Match level="QueryCoverage =89%, HitCoverage=37%, E-value=3e-58, Identity=39%"; Hit description =CG6192-PA [Drosophila melanogaster] gb|AAF53068.2| CG6192-PA [Drosophila melanogaster]
  misc_feature: Gene Ontology Annotation: Molecular function=calcium ion binding; Biological process=EGF receptor signaling pathway
  misc_feature: Pfam annotation: Pfam_ID=efhand; Match level="Score=18.4, E-value =0.022, Copies=1"; Pfam description=EF hand
  misc_feature (259)..(259): Xaa can be any naturally occurring amino acid
EGYDICHDLQLSDTLQRYFSDVFLCCDEDNSGKASLAKTVELIQSGSVPEDVISQISDICWTLGTNYLNKKQFFSALKLVAAYQANIPIRSEVLTSKVELPLPRFTWTVIDNKSPIGDLIELRNEPNDYSEHVDTSTDSEIESETVKNGSPDASSATSDSPTPTNSVQDRSWLVSGVWHGLISEEQRQLLGTEEESSEKHSSEDDTEVSSEVWTITNEQREYYTNQFRSLQPDTNALLAGPVARTFFERSRLPIHELRXIWQLADVTKDGALSLHEFTQHASCVRKTTLTTLMSSTTLVPETNSFVCESETEPI

SEQ ID NO: 30017 - protein, 54 aa, Diabrotica virgifera
  misc_feature: Coding regions on vcDNA: vcDNA=SeqID_9714; Strand=+; Position=2-166
  misc_feature: Homolog annotation: Hit_ID=AAM90089.1; Match level="QueryCoverage =100%, HitCoverage=23%, E-value=2e-11, Identity=66%"; Hit description= cytochrome b [Austrochlus centralaustralis]
  misc_feature (10)..(10): Xaa can be any naturally occurring amino acid
  misc_feature (21)..(21): Xaa can be any naturally occurring amino acid
  misc_feature (40)..(49): Xaa can be any naturally occurring amino acid
FYPINKILFXRLLSIVIFLTXIGARPVEDPYILTGQILTXXXXXXXXXXPLIRK

SEQ ID NO: 30018 - protein, 60 aa, Diabrotica virgifera
  misc_feature: Coding regions on vcDNA: vcDNA=SeqID_9715; Strand=+; Position=3-185
  misc_feature (1)..(33): Xaa can be any naturally occurring amino acid
XXXXXXXXXXXXXXXXXXXXXXXXXXXXXXXXXKGKTGVIFIGKGSNSIIKNWRPLIFGI

SEQ ID NO: 30019 - protein, 27 aa, Diabrotica virgifera
  misc_feature: Coding regions on vcDNA: vcDNA=SeqID_9716; Strand=-; Position=1-81
  misc_feature (8)..(8): Xaa can be any naturally occurring amino acid
  misc_feature (10)..(26): Xaa can be any naturally occurring amino acid
QKKLGSKXLXXXXXXXXXXXXXXXXXQ

SEQ ID NO: 30020 - protein, 56 aa, Diabrotica virgifera
  misc_feature: Coding regions on vcDNA: vcDNA=SeqID_9717; Strand=+; Position=1-168
  misc_feature (1)..(9): Xaa can be any naturally occurring amino acid
XXXXXXXXXERTNRYRSGVSISLRILRIRIRKQVFSCGIFFVIFCGFYFFYLTKNF

SEQ ID NO: 30021 - protein, 37 aa, Diabrotica virgifera
  misc_feature: Coding regions on vcDNA: vcDNA=SeqID_9718; Strand=+; Position=1-114
  misc_feature (14)..(29): Xaa can be any naturally occurring amino acid
RSRFSLYRSRNGLXXXXXXXXXXXXXXXXDLNVILIN

SEQ ID NO: 30022 - protein, 237 aa, Diabrotica virgifera
  misc_feature: Coding regions on vcDNA: vcDNA=SeqID_9719; Strand=+; Position=136-849
  misc_feature: Homolog annotation: Hit_ID=XP_321825.1; Match level="QueryCoverage =81%, HitCoverage=18%, E-value=3e-33, Identity=35%"; Hit description =ENSANGP00000020376 [Anopheles gambiae]
  misc_feature: Gene Ontology Annotation: Cellular component=integral to membrane
  misc_feature: Pfam annotation: Pfam_ID=Cys_rich_FGFR; Match level="Score=16.3, E -value=0.00042, Copies=1"; Pfam description=Cysteine rich repeat
  misc_feature (217)..(217): Xaa can be any naturally occurring amino acid
MYYFSLFLLFNILWIIATCSVINHREVSNSIVDEKACQDVAIICHNLSEKDDLLILECLLSSNPHQVNRLNRECMNIVWGRVNNLTSSSGVKERLLPECGKELDKLQCQENNYLQCIVKNVNNIQDQNCYNTINRLESIAFTDYKWITDFLHECAQDINKFQCGIIDGDNFSQIRTVECLQNKIVEVSEECRKEVFHLSELQSNNIKLDAQLYLECXEDYQRYCSQFKVQEEYFPVY

SEQ ID NO: 30023 - protein, 83 aa, Diabrotica virgifera
  misc_feature: Coding regions on vcDNA: vcDNA=SeqID_9720; Strand=+; Position=504-754
  misc_feature: Homolog annotation: Hit_ID=XP_321420.1; Match level="QueryCoverage =100%, HitCoverage=20%, E-value=9e-17, Identity=59%"; Hit description= ENSANGP00000022175 [Anopheles gambiae]
  misc_feature: Gene Ontology Annotation: Molecular function=structural constituent of cytoskeleton; Cellular component=cytoskeleton; Biological process= actin cytoskeleton organization and biogenesis
  misc_feature (27)..(27): Xaa can be any naturally occurring amino acid
  misc_feature (54)..(54): Xaa can be any naturally occurring amino acid
  misc_feature (75)..(75): Xaa can be any naturally occurring amino acid
HASGLTTGTALHLQISVAHHTNPTYHXKTLPHGIRRMDAAISDLTDYLLKILTXERGYYFTTTDSRELARDFKYXLCYATLDF

SEQ ID NO: 30024 - protein, 92 aa, Diabrotica virgifera
  misc_feature: Coding regions on vcDNA: vcDNA=SeqID_9721; Strand=-; Position=79-357
VAELRRCIIVTQRWNGLSGYRRFQQGTIIGNSEEYAISSTHYPSYARPVSRSRSLPQPPPPLTPYCRLLAILSQGRLLCFYVFLYITDDLSL

SEQ ID NO: 30025 - protein, 24 aa, Diabrotica virgifera
  misc_feature: Coding regions on vcDNA: vcDNA=SeqID_9722; Strand=-; Position=1-72
  misc_feature (1)..(9): Xaa can be any naturally occurring amino acid
  misc_feature (11)..(24): Xaa can be any naturally occurring amino acid
XXXXXXXXXIXXXXXXXXXXXXXX

SEQ ID NO: 30026 - protein, 47 aa, Diabrotica virgifera
  misc_feature: Coding regions on vcDNA: vcDNA=SeqID_9723; Strand=-; Position=63-206
  misc_feature (2)..(16): Xaa can be any naturally occurring amino acid
VXXXXXXXXXXXXXXXWVPPGLTQIMKIFKVNQLYNKLFPKYTLIHH

SEQ ID NO: 30027 - protein, 147 aa, Diabrotica virgifera
  misc_feature: Coding regions on vcDNA: vcDNA=SeqID_9724; Strand=+; Position=42-485
  misc_feature (14)..(21): Xaa can be any naturally occurring amino acid
ICASELFLPLKKPXXXXXXXXLLACVAVFNAVSALDCYTCTDDACKKDIKEMQKVTYGKPADQNQESVCQKVTYKGKDGKEHIERKCAYAPKNGEAQCPASINKADVTDLKCPSCKADLCNSATTINFSLTAFAAVVFAIVGQKFLM

SEQ ID NO: 30028 - protein, 180 aa, Diabrotica virgifera
  misc_feature: Coding regions on vcDNA: vcDNA=SeqID_9725; Strand=-; Position=1-540
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (56)..(64): Xaa can be any naturally occurring amino acid
  misc_feature (66)..(180): Xaa can be any naturally occurring amino acid
FXXXXXXXXXXXNQPGSHRFKXXXXXXXXXEXXXXXXXXXXXXXXSNIEVAIFIIXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30029 - protein, 201 aa, Diabrotica virgifera
  misc_feature: Coding regions on vcDNA: vcDNA=SeqID_9726; Strand=-; Position=1-603
  misc_feature (3)..(3): Xaa can be any naturally occurring amino acid
  misc_feature (5)..(17): Xaa can be any naturally occurring amino acid
  misc_feature (20)..(20): Xaa can be any naturally occurring amino acid
  misc_feature (23)..(201): Xaa can be any naturally occurring amino acid
NLXNXXXXXXXXXXXXXNNXINXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30030 - protein, 72 aa, Diabrotica virgifera
  misc_feature: Coding regions on vcDNA: vcDNA=SeqID_9727; Strand=+; Position=117-335
  misc_feature (55)..(61): Xaa can be any naturally occurring amino acid
IDHTVYHAVMTEMLASANEDVLAKKKSPRIRKIHSPEGFIAQVTIHCSPSLLLYXXXXXXXNSVYISCDRTM

SEQ ID NO: 30031 - protein, 80 aa, Diabrotica virgifera
  misc_feature: Coding regions on vcDNA: vcDNA=SeqID_9728; Strand=-; Position=569-811
  misc_feature: Homolog annotation: Hit_ID=XP_392609.1; Match level="QueryCoverage =100%, HitCoverage=18%, E-value=3e-16, Identity=55%"; Hit description= similar to RAB3A interacting protein (rabin3)-like 1 [Apis mellifera]
  misc_feature (9)..(9): Xaa can be any naturally occurring amino acid
  misc_feature (44)..(44): Xaa can be any naturally occurring amino acid
CALLEVARXSFYEMSIGETEAWYDILQICGNGIIAVWDFLAYLXYIEGGRVRSSALGVYWEMVRLRKNTCLASRGLVVSS

SEQ ID NO: 30032 - protein, 195 aa, Diabrotica virgifera
  misc_feature: Coding regions on vcDNA: vcDNA=SeqID_9729; Strand=+; Position=2-589
  misc_feature: Homolog annotation: Hit_ID=EAL32687.1; Match level="QueryCoverage =100%, HitCoverage=68%, E-value=1e-74, Identity=86%"; Hit description= GA11169-PA [Drosophila pseudoobscura]
  misc_feature: Gene Ontology Annotation: Molecular function=chaperone activity; Cellular component=nucleolus; Biological process=rRNA processing
  misc_feature: Pfam annotation: Pfam_ID=KH_1; Match level="Score=25.7, E-value =0.00014, Copies=1"; Pfam description=KH domain
FEIKDVKTLKGDHQSRAIGRLAGKGGRTKFTIENWLKIFTPVVEHLQLQIRFNLKTRNVEIRACKETPDISNLQKAADFVKAFIYGFEVEDALALIRLDDLFVETFEIKDVKTLKGDHQSRAIGRLAGKGGRTKFTIENVTKTRIVLADSKIHILGSFQNIALARRAVCNLILGSPPSKVYGQLRNVASRVSERM

SEQ ID NO: 30033 - protein, 242 aa, Diabrotica virgifera
  misc_feature: Coding regions on vcDNA: vcDNA=SeqID_9730; Strand=+; Position=217-944
  misc_feature: Homolog annotation: Hit_ID=AAK61417.1; Match level="QueryCoverage =97%, HitCoverage=68%, E-value=6e-38, Identity=38%"; Hit description =transposase [Ceratitis rosa]
  misc_feature (15)..(20): Xaa can be any naturally occurring amino acid
  misc_feature (38)..(38): Xaa can be any naturally occurring amino acid
  misc_feature (120)..(120): Xaa can be any naturally occurring amino acid
  misc_feature (148)..(148): Xaa can be any naturally occurring amino acid
  misc_feature (221)..(221): Xaa can be any naturally occurring amino acid
MSLRLTPEQHFQIMXXXXXXHASVRNTYRALRPFYGQXSLIRLTMECFRTTFTLNANTLPYRRRTVRTEEVVAAVERSVEQDPNQSTLHPVQQLDTCPSTVWKTLRKDLGLRSYKINSCXELILHDYLARRRFGERAQNEIAVYPYFXKRILFGDETQFLLKGYVNKQNCRTWNENNSQVYVETPNMTVWCVPYFFKNDAGQKATVNGDRYRAMIRPTTDXFIPQLNHHDVQELWFHKMTHM

SEQ ID NO: 30034 - protein, 225 aa, Diabrotica virgifera
  misc_feature: Coding regions on vcDNA: vcDNA=SeqID_9731; Strand=+; Position=1-675
  misc_feature: Homolog annotation: Hit_ID=XP_392361.1; Match level="QueryCoverage =97%, HitCoverage=6%, E-value=1e-67, Identity=58%"; Hit description =similar to CG30171-PB [Apis mellifera]
  misc_feature (59)..(64): Xaa can be any naturally occurring amino acid
  misc_feature (186)..(186): Xaa can be any naturally occurring amino acid
  misc_feature (217)..(217): Xaa can be any naturally occurring amino acid
IRGALRHPWLERADKKYTDEFQIRSKYLSDYWRLYREWYDNASCRRWFRRRPLEGAFTXXXXXXYPPGDYDSPRGTPAPLDKTPRVPRTWEDQLPTRSPLNYEIGVIKSESHYQNGPDTYLLQLRDVDFPVRLREYMKVAAIRGPGSGYILSDENGYDWGTPIIRERRRFTDIMDEEIDDERKARXHRYGSVEREPDTRRIRHELGSRLDAYVEAEXFLELTRKT

SEQ ID NO: 30035 - protein, 44 aa, Diabrotica virgifera
  misc_feature: Coding regions on vcDNA: vcDNA=SeqID_9732; Strand=+; Position=2-136
LITPYKILKVCIFTYYNYFETGQENKSYLVLNLPIISIKNENMM

SEQ ID NO: 30036 - protein, 232 aa, Diabrotica virgifera
  misc_feature: Coding regions on vcDNA: vcDNA=SeqID_9733; Strand=+; Position=3-698
  misc_feature: Homolog annotation: Hit_ID=AAF87760.1; Match level="QueryCoverage =100%, HitCoverage=52%, E-value=8e-88, Identity=74%"; Hit description= cytochrome oxidase subunit I [Diabrotica virgifera zeae]
  misc_feature: Pfam annotation: Pfam_ID=COX1; Match level="Score=-169.1, E-value =1.7e-05, Copies=1"; Pfam description=Cytochrome C and Quinol oxidase polyp
  misc_feature (8)..(8): Xaa can be any naturally occurring amino acid
  misc_feature (43)..(43): Xaa can be any naturally occurring amino acid
  misc_feature (60)..(60): Xaa can be any naturally occurring amino acid
  misc_feature (63)..(69): Xaa can be any naturally occurring amino acid
  misc_feature (96)..(102): Xaa can be any naturally occurring amino acid
  misc_feature (116)..(116): Xaa can be any naturally occurring amino acid
  misc_feature (124)..(140): Xaa can be any naturally occurring amino acid
  misc_feature (170)..(170): Xaa can be any naturally occurring amino acid
  misc_feature (186)..(193): Xaa can be any naturally occurring amino acid
  misc_feature (214)..(214): Xaa can be any naturally occurring amino acid
GLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFSFQRKRLRPLRITSSIEXLQFNPPAEHRYSELPILS

SEQ ID NO: 30037 - protein, 77 aa, Diabrotica virgifera
  misc_feature: Coding regions on vcDNA: vcDNA=SeqID_9734; Strand=-; Position=1-231
  misc_feature (1)..(12): Xaa can be any naturally occurring amino acid
  misc_feature (14)..(24): Xaa can be any naturally occurring amino acid
  misc_feature (34)..(41): Xaa can be any naturally occurring amino acid
  misc_feature (44)..(56): Xaa can be any naturally occurring amino acid
  misc_feature (63)..(75): Xaa can be any naturally occurring amino acid
XXXXXXXXXXXXFXXXXXXXXXXXTTWAHTGLNXXXXXXXXRTXXXXXXXXXXXXXIQHRGRXXXXXXXXXXXXXLL

SEQ ID NO: 30038 - protein, 93 aa, Diabrotica virgifera
  misc_feature: Coding regions on vcDNA: vcDNA=SeqID_9735; Strand=+; Position=1-282
  misc_feature (75)..(82): Xaa can be any naturally occurring amino acid
EISFRAASDKIRKYFYHHGACAPPWISVIERNTSQFWSETHEVRIVCSKIFFSSGEGLESIKYTPFKWNKDILNXXXXXXXXFKATVTQRYTN

SEQ ID NO: 30039 - protein, 86 aa, Diabrotica virgifera
  misc_feature: Coding regions on vcDNA: vcDNA=SeqID_9736; Strand=+; Position=328-585
LYFTYTFLPPFVPPHQKLPPATPPHPPTGNRFFLLPPSPPPAPPPKVLGLGLPLNSPPPRPLPFVTITRPVNSSTNPQTISPFLSS

SEQ ID NO: 30040 - protein, 69 aa, Diabrotica virgifera
  misc_feature: Coding regions on vcDNA: vcDNA=SeqID_9737; Strand=+; Position=356-565
  misc_feature (36)..(43): Xaa can be any naturally occurring amino acid
  misc_feature (48)..(55): Xaa can be any naturally occurring amino acid
DQSLSYCNTWHDLLICMIILIYYQFYIKVYVRIIHXXXXXXXXPLTHXXXXXXXXGLSRYSSTFFTPVH

SEQ ID NO: 30041 - protein, 65 aa, Diabrotica virgifera
  misc_feature: Coding regions on vcDNA: vcDNA=SeqID_9738; Strand=-; Position=46-243
  misc_feature (4)..(16): Xaa can be any naturally occurring amino acid
  misc_feature (31)..(37): Xaa can be any naturally occurring amino acid
  misc_feature (42)..(48): Xaa can be any naturally occurring amino acid
ALFXXXXXXXXXXXXXRNPTLAPPPVFNLRXXXXXXXWNQTXXXXXXXQIINFIPTSRSASLLSI

SEQ ID NO: 30042 - protein, 211 aa, Diabrotica virgifera
  misc_feature: Coding regions on vcDNA: vcDNA=SeqID_9739; Strand=-; Position=1-633
  misc_feature (1)..(211): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30043 - protein, 223 aa, Diabrotica virgifera
  misc_feature: Coding regions on vcDNA: vcDNA=SeqID_9740; Strand=+; Position=101-769
  misc_feature: Homolog annotation: Hit_ID=XP_320129.1; Match level="QueryCoverage =88%, HitCoverage=42%, E-value=9e-19, Identity=33%"; Hit description =ENSANGP00000008931 [Anopheles gambiae] gb|EAA00711.1| ENSANGP00000008931 [Anopheles gambiae
  misc_feature: Pfam annotation: Pfam_ID=LRR_1; Match level="Score=43.0, E-value=8.6e- 10, Copies=4"; Pfam description=Leucine Rich Repeat
  misc_feature (101)..(107): Xaa can be any naturally occurring amino acid
MKNLGIFAVFTILLVYTRADNLDDFPLCKACGCSFNSNNTEANVTCTKQNPSQLLQDYFWIKKGTNNSIPYNRVMINNEKFINFTYVFPSSPLVYLNLAYXXXXXXXDSIFKNLQNMQVLILSYNDLEVIHPDTFKGLYLPERLMPLKSLIELRLDHNKLHTLNQDTFDHTTDIQILDLSYNPLEVIDHHTLIAINELLYLRELYLQNTEIKTLPDNMLHTPQ

SEQ ID NO: 30044 - protein, 287 aa, Diabrotica virgifera
  misc_feature: Coding regions on vcDNA: vcDNA=SeqID_9741; Strand=+; Position=133-996
  misc_feature: Homolog annotation: Hit_ID=XP_314764.1; Match level="QueryCoverage =59%, HitCoverage=56%, E-value=4e-24, Identity=36%"; Hit description =ENSANGP00000014210 [Anopheles gambiae]
  misc_feature: Pfam annotation: Pfam_ID=MT-A70; Match level="Score=3.9, E-value=5.5e- 06, Copies=1"; Pfam description=MT-A70
  misc_feature (248)..(248): Xaa can be any naturally occurring amino acid
  misc_feature (257)..(257): Xaa can be any naturally occurring amino acid
  misc_feature (261)..(261): Xaa can be any naturally occurring amino acid
MANLLDNRKKQNWSVKMSKIYENESGCLISHEKFINDIYTNLLDVPGRSYHINPNIFKIDTTYKTSGQSKSKRSKNVQPRNEFEDHRKEQDVVKFKYDNFLSACRNYFNNSSEELQSLTNNLALEAADVIQNNSENSVSDMNGANDGPAVVKEINGDKYVFPEKCEFYCKNVFDMDKHLHSRKFDLILLDPPWWNKYIRRKRKKSSDGYSMMYNEDLKNLPIGDLLSDDGLVAVWCTNSKQNLDALLXEVFPKWNVXVTAXWGLVKVTTRGEPILSVFLIPPGKAPL

SEQ ID NO: 30045 - protein, 44 aa, Diabrotica virgifera
  misc_feature: Coding regions on vcDNA: vcDNA=SeqID_9742; Strand=-; Position=0-131
  misc_feature (12)..(42): Xaa can be any naturally occurring amino acid
FQKKIRWFPLRXXXXXXXXXXXXXXXXXXXXXXXXXXXXXXXPT

SEQ ID NO: 30046 - protein, 34 aa, Diabrotica virgifera
  misc_feature: Coding regions on vcDNA: vcDNA=SeqID_9743; Strand=-; Position=0-101
  misc_feature (1)..(1): Xaa can be any naturally occurring amino acid
  misc_feature (4)..(31): Xaa can be any naturally occurring amino acid
XYRXXXXXXXXXXXXXXXXXXXXXXXXXXXXIHP

SEQ ID NO: 30047 - protein, 51 aa, Diabrotica virgifera
  misc_feature: Coding regions on vcDNA: vcDNA=SeqID_9744; Strand=+; Position=20-175
  misc_feature: Homolog annotation: Hit_ID=CAA78126.1; Match level="QueryCoverage =92%, HitCoverage=4%, E-value=4e-10, Identity=60%"; Hit description =NAD(+) ADP-ribosyltransferase [Xenopus laevis] sp|P31669|PPOL_XENLA Poly [ADP-ribose] polymerase (PARP) (AD
TVKKIGDIEVPVGKGVSSNAKSSLLYNEYIVYDVAQVNIKYLLKMHFEYRF

SEQ ID NO: 30048 - protein, 273 aa, Diabrotica virgifera
  misc_feature: Coding regions on vcDNA: vcDNA=SeqID_9745; Strand=+; Position=97-912
  misc_feature: Homolog annotation: Hit_ID=XP_233500.2; Match level="QueryCoverage =97%, HitCoverage=53%, E-value=1e-84, Identity=58%"; Hit description =similar to RIKEN cDNA 4930512K19 [Rattus norvegicus] ref|NP _083433.1| splicing factor 3a, subunit
  misc_feature: Gene Ontology Annotation: Molecular function=pre-mRNA splicing factor activity; Cellular component=spliceosome complex; Biological process =mRNA splicing
  misc_feature (5)..(18): Xaa can be any naturally occurring amino acid
  misc_feature (40)..(40): Xaa can be any naturally occurring amino acid
  misc_feature (181)..(187): Xaa can be any naturally occurring amino acid
  misc_feature (221)..(221): Xaa can be any naturally occurring amino acid
  misc_feature (250)..(250): Xaa can be any naturally occurring amino acid
  misc_feature (255)..(255): Xaa can be any naturally occurring amino acid
  misc_feature (258)..(258): Xaa can be any naturally occurring amino acid
METIXXXXXXXXXXXXXXIDAMVKEMLHKKTTFREAINSXHRQKYLLDRYMASTERLIDLYDDRDGQRKAEVAALTGPNEFQEFYSRLKLIKDFYRRHPNEISVPMSVEFDEFAKARENPNEDMANFVEFTDEEGYGKYLDLHECYEKYINLKGIEKVDYITYLGMFDQLYDIPKERKSGXXXXXXXCLIEYLTWFVQRIKPLKDLDIDLQEQVEQVLLNXDNGSVPGWPKETGSALNKCGAHLDLSAFXQWEDXASXGLDRLKSALNGGRLK

SEQ ID NO: 30049 - protein, 137 aa, Diabrotica virgifera
  misc_feature: Coding regions on vcDNA: vcDNA=SeqID_9746; Strand=-; Position=1-411
  misc_feature: Homolog annotation: Hit_ID=AAB92389.1; Match level="QueryCoverage =91%, HitCoverage=26%, E-value=7e-23, Identity=36%"; Hit description =non-LTR retrotransposon reverse transcriptase [Drosophila subobscura]
LTTGVNKRLIVNAQKTQIVNFTKKTALQGLKPPVLGGKEISFAKETKYLGVYFDHRLTWNTHIIKTTHKATMSLGRCRRMCGKNWGLNPKMTLWLYTRVIRPMITYGSVTWWTKTQQVGAIRLLGNTQRLACWPTRP

SEQ ID NO: 30050 - protein, 119 aa, Diabrotica virgifera
  misc_feature: Coding regions on vcDNA: vcDNA=SeqID_9747; Strand=+; Position=633-989
  misc_feature (45)..(55): Xaa can be any naturally occurring amino acid
  misc_feature (82)..(88): Xaa can be any naturally occurring amino acid
FKAFIVILSSQTFSQECGQYFWTQVDYERTKISLCLTFINLYIKXXXXXXXXXXXQSPSNPTLSNFLALLCIINMVFKVFVXXXXXXXHFSVGFGFAESSGFPGVRNLRGSTCIMKNFF

SEQ ID NO: 30051 - protein, 90 aa, Diabrotica virgifera
  misc_feature: Coding regions on vcDNA: vcDNA=SeqID_9748; Strand=-; Position=0-269
  misc_feature (16)..(22): Xaa can be any naturally occurring amino acid
  misc_feature (62)..(89): Xaa can be any naturally occurring amino acid
HPPRGALPVFFILKVXXXXXXXEPGFIFFTWGPTFKLYPTGGGANFFFRLDFPKKNSWFSKXXXXXXXXXXXXXXXXXXXXXXXXXXXXP

SEQ ID NO: 30052 - protein, 86 aa, Diabrotica virgifera
  misc_feature: Coding regions on vcDNA: vcDNA=SeqID_9749; Strand=+; Position=488-745
RAHKCYYFCRNDIHMSVHRGSLCDALSRKRIIRDAFLMSEFFAACAALFYLSKMYFKQLNLCLGTIITGPLSATTSHFTVFPSASI

SEQ ID NO: 30053 - protein, 66 aa, Diabrotica virgifera; identical to SEQ ID NO: 26808
  misc_feature: Coding regions on vcDNA: vcDNA=SeqID_9750; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 30054 - protein, 184 aa, Diabrotica virgifera
  misc_feature: Coding regions on vcDNA: vcDNA=SeqID_9751; Strand=+; Position=372-926
  misc_feature (151)..(151): Xaa can be any naturally occurring amino acid
  misc_feature (159)..(169): Xaa can be any naturally occurring amino acid
PLDVHSTIINAGLSDHEAVYTKFNILSKPSSKTRRLGRIFFTRNFRNFQNLCLTSEWRFPVMDMDNYFSAFLDKLVCIFNKAFPLIAIKPKHRKPWTTKGIRISSKNMRSLLYIRKFTTNVSITEYITKYRATYLKLIKSAKKDYYHNRLXSSKSVAKXXXXXXXXXXXKTHTAKTISLQTLKI

SEQ ID NO: 30055 - protein, 108 aa, Diabrotica virgifera; identical to SEQ ID NO: 27732
  misc_feature: Coding regions on vcDNA: vcDNA=SeqID_9752; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 30056 - protein, 303 aa, Diabrotica virgifera
  misc_feature: Coding regions on vcDNA: vcDNA=SeqID_9753; Strand=+; Position=37-945
  misc_feature: Homolog annotation: Hit_ID=XP_394371.1; Match level="QueryCoverage =86%, HitCoverage=21%, E-value=7e-51, Identity=38%"; Hit description =similar to pleckstrin homology-like domain, family B, member 2; LL5 beta [Apis
  misc_feature: Pfam annotation: Pfam_ID=PH; Match level="Score=28.2, E-value=2.5e -05, Copies=1"; Pfam description=PH domain
  misc_feature (274)..(279): Xaa can be any naturally occurring amino acid
MFNMSHSFNEKLFQEKSVLEIGISKRFPSQDDIDRISRVTSHTPIIEEGTDSLGRKTIESLKEIERNRHIHLCQQGSHVIEQERQRVNALKQKVQEEVKTKWAQRVQDCDSLNSSEELEDARIRELDQQINDYQRPTYEQNSINLSRDESEHAESPRPLSETSEMSLEVGTISDKQRPLTRYLPIRGTDLDLRQHIESAGHQVVLCPHVIINSSVCRGYLHKRGSKLNGWSRRWFVFDRHKHTFAYYIDKSEKKPRGGAYFQAIEEVYLDHLNXXXXXXPHLTFIVKTHERLYYLMAPSPEAM

SEQ ID NO: 30057 - protein, 49 aa, Diabrotica virgifera
  misc_feature: Coding regions on vcDNA: vcDNA=SeqID_9754; Strand=-; Position=3-149
ILSISLNSLKLYNIMTLPLHDTHGSNLSLTYSYILVAKEQIYKITSINR

SEQ ID NO: 30058 - protein, 99 aa, Diabrotica virgifera
  misc_feature: Coding regions on vcDNA: vcDNA=SeqID_9755; Strand=+; Position=263-562
KAKKKKKYKHRTCFYYPHVKDFVFFSGKNQLKTAILLNAESGADVVRELGTQAVLAGAPQSANALAAAVDSVSTSDVQSVSKQIFLLEIVNFINTYTIV

SEQ ID NO: 30059 - protein, 72 aa, Diabrotica virgifera
  misc_feature: Coding regions on vcDNA: vcDNA=SeqID_9756; Strand=-; Position=93-311
  misc_feature (21)..(27): Xaa can be any naturally occurring amino acid
QCGNAVPERTANFCLQNLNSXXXXXXXNQCGNGVPTHSHTMTPLTILDLLELPVYLNLCLLNIHLNLKVDIS

SEQ ID NO: 30060 - protein, 249 aa, Diabrotica virgifera
  misc_feature: Coding regions on vcDNA: vcDNA=SeqID_9757; Strand=-; Position=3-749
  misc_feature (6)..(15): Xaa can be any naturally occurring amino acid
  misc_feature (18)..(24): Xaa can be any naturally occurring amino acid
  misc_feature (38)..(47): Xaa can be any naturally occurring amino acid
  misc_feature (62)..(114): Xaa can be any naturally occurring amino acid
  misc_feature (118)..(141): Xaa can be any naturally occurring amino acid
  misc_feature (152)..(169): Xaa can be any naturally occurring amino acid
  misc_feature (172)..(249): Xaa can be any naturally occurring amino acid
TSQNLXXXXXXXXXXKQXXXXXXXRPPPNLKNLLNPTXXXXXXXXXXVLDLPKKKIRRFPLXXXXXXXXXXXXXXXXXXXXXXXXXXXXXXXXXXXXXXXXXXXXXXXXXXXXXLYRXXXXXXXXXXXXXXXXXXXXXXXXSFFSSNLSFSXXXXXXXXXXXXXXXXXXAIXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30061 - protein, 232 aa, Diabrotica virgifera
  misc_feature: Coding regions on vcDNA: vcDNA=SeqID_9758; Strand=+; Position=184-880
  misc_feature: Homolog annotation: Hit_ID=NP_573371.1; Match level="QueryCoverage =98%, HitCoverage=12%, E-value=5e-37, Identity=38%"; Hit description =CG8002-PA [Drosophila melanogaster] gb|AAF48942.2| CG8002-PA [Drosophila melanogaster]
  misc_feature (216)..(216): Xaa can be any naturally occurring amino acid
MAVSSWMLRQQNRYNRSTRHNKQEDVLAQLQSLGPQGSCTKLLEKICDLNVKEEILFSYLNAFVKLTLKCGDDFEYTIEQILTCLRLSLIHNSAQIRTAGLRCIRHVLKTETDIVQANKLLIPYLLTRSLDLILRNDVERIEAMKLIRKTLIISATTFDIALARCLVSLAYEGAEAKDRMLRVCMATLSELCVLNSKLFIASGGVTAISRNLLECXSPKIAEILMAGCCFLL

SEQ ID NO: 30062 - protein, 269 aa, Diabrotica virgifera
  misc_feature: Coding regions on vcDNA: vcDNA=SeqID_9759; Strand=+; Position=144-949
  misc_feature: Homolog annotation: Hit_ID=XP_393612.1; Match level="QueryCoverage =99%, HitCoverage=63%, E-value=1e-140, Identity=89%"; Hit description= similar to casein kinase 1, alpha 1; casein kinase I-alpha [Apis mellifera]
  misc_feature: Gene Ontology Annotation: Molecular function=casein kinase I activity; Cellular component=nucleus; Biological process=signal transduction
  misc_feature: Pfam annotation: Pfam_ID=Pkinase; Match level="Score=98.4, E-value =1.8e-26, Copies=1"; Pfam description=Protein kinase domain
  misc_feature (252)..(252): Xaa can be any naturally occurring amino acid
IVEPDYVVGGKYRLLRKIGSGSFGDIYLGINITNGEEVAVKLEPIRARHPQLLYESKLYKILHGGIGIPHIRYYGQEKEYNVLVMDLLGPSLEDLFNFCTRRFTIKTVLMLADQMITRIEFVHCKSFIHRDIKPDNFLMGIGRHCNKLFLIDFGLAKKFRDTRTRMHIIYREDKNLTGTARYASINAHLGIEQSRRDDMESLGYVLMYFNRGCLPWQGLKAATKKQKYEKISEKKMSTPVESLCKGFPAEFXMYLNYCRGLRFEETPTT

SEQ ID NO: 30063 - protein, 108 aa, Diabrotica virgifera; identical to SEQ ID NO: 27732
  misc_feature: Coding regions on vcDNA: vcDNA=SeqID_9760; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 30064 - protein, 313 aa, Diabrotica virgifera
  misc_feature: Coding regions on vcDNA: vcDNA=SeqID_9761; Strand=+; Position=1-939
  misc_feature: Homolog annotation: Hit_ID=XP_315376.1; Match level="QueryCoverage =100%, HitCoverage=87%, E-value=4e-35, Identity=27%"; Hit description= ENSANGP00000020934 [Anopheles gambiae]
  misc_feature: Gene Ontology Annotation: Molecular function=pre-mRNA splicing factor activity; Cellular component=nuclear matrix; Biological process=mRNA splicing
LLISAQENPKGIPFSFINLKREELAIKKEKEDKEREQREKSDKERKYRDRDRSRSRRSRSRSRNRKSSRDRSSRNKKSKSRDRNSRSRDRKSRSRDRKSRSVDKKSRSRDRKSGSRDRNSHSRDRKSRSRSRDKKSASRSRDRVSKSRSRERDRTRSRSASKPKEDIPRNGDVSPKVAVNGGREDSETEKQANNSAPALPVSKLQAKLMSLAENKKVSRSRSRSRSHTRSKSRGPRSKSRSKSRSSSRSFKGRRSTSKEAKVKRRSRSSSGSKENFEIRKKEDSVQKKRHYRSNKDSSDSEADAKRKSRGRNQ

SEQ ID NO: 30065 - protein, 124 aa, Diabrotica virgifera
  misc_feature: Coding regions on vcDNA: vcDNA=SeqID_9762; Strand=+; Position=1-375
  misc_feature: Homolog annotation: Hit_ID=EAA44605.2; Match level="QueryCoverage =70%, HitCoverage=25%, E-value=4e-13, Identity=46%"; Hit description =ENSANGP00000022584 [Anopheles gambiae str. PEST] ref|XP_562306.1| ENSANGP00000022584 [Anopheles gambiae st
EAIDRNGVQYFGLMKDIEVARFVTRGEYGIPGNYSDIVANNQKTLQFVSGIKAIKNPAGGEDIYMVTSRFQRVATGTLNSAEINFRIQKASTTKCDPRYSPPLPPRTTEAPNVSPGPVVFPQDR

SEQ ID NO: 30066 - protein, 54 aa, Diabrotica virgifera
  misc_feature: Coding regions on vcDNA: vcDNA=SeqID_9763; Strand=-; Position=2-163
  misc_feature (11)..(18): Xaa can be any naturally occurring amino acid
  misc_feature (21)..(34): Xaa can be any naturally occurring amino acid
  misc_feature (40)..(53): Xaa can be any naturally occurring amino acid
ETNLPHTGLNXXXXXXXXSNXXXXXXXXXXXXXXPTSRSXXXXXXXXXXXXXXV

SEQ ID NO: 30067 - protein, 94 aa, Diabrotica virgifera
  misc_feature: Coding regions on vcDNA: vcDNA=SeqID_9764; Strand=+; Position=572-856
IYCTYKCFISFVYCLFIFFIKLKLFSLMCFNSYHSFFSFPMSSSYSYSILLVSFPPFVLGVPYSILFKIDFQFLDFSGLIFHSLCVYPSVCLLS

SEQ ID NO: 30068 - protein, 66 aa, Diabrotica virgifera; identical to SEQ ID NO: 26808
  misc_feature: Coding regions on vcDNA: vcDNA=SeqID_9765; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 30069 - protein, 103 aa, Diabrotica virgifera
  misc_feature: Coding regions on vcDNA: vcDNA=SeqID_9766; Strand=+; Position=38-349
ISINNMERKEGNEDEDTVTNIKVENSIFVKPEFIKVEPDLFYLDEYEDCKPTLNHLKTELSVECKTSEQNQNDLAQFQYLDSDVNTKPEHSVKGSQSSEHVFG

SEQ ID NO: 30070 - protein, 204 aa, Diabrotica virgifera
  misc_feature: Coding regions on vcDNA: vcDNA=SeqID_9767; Strand=+; Position=105-716
  misc_feature: Homolog annotation: Hit_ID=XP_392456.1; Match level="QueryCoverage =100%, HitCoverage=31%, E-value=8e-48, Identity=51%"; Hit description= similar to 90-kDa heat shock protein HSP83 [Apis mellifera]
  misc_feature: Gene Ontology Annotation: Molecular function=chaperonin ATPase activity; Cellular component=centrosome; Biological process =regulation of sleep
  misc_feature (83)..(83): Xaa can be any naturally occurring amino acid
  misc_feature (99)..(99): Xaa can be any naturally occurring amino acid
  misc_feature (124)..(124): Xaa can be any naturally occurring amino acid
  misc_feature (147)..(147): Xaa can be any naturally occurring amino acid
  misc_feature (156)..(156): Xaa can be any naturally occurring amino acid
  misc_feature (172)..(172): Xaa can be any naturally occurring amino acid
MPEQTLIAYGETFSFQTEISQLMSLIINTFYSNQEIFLTEMGSNSSDALDNSRYQSLTNPSCVQTAEKYSRITNVPDNRIETXTIMDTGMWDDETVFMXKLDTISQSRTNVFMEALQAGADIKXSGPFGVGFYSTDLDADRGVLVSXNNDAVQHIXESSAGGTFTVIPHDRXPLGRRTTIVLYITEYRTRVLQKNECIEILKKN

SEQ ID NO: 30071 - protein, 76 aa, Diabrotica virgifera
  misc_feature: Coding regions on vcDNA: vcDNA=SeqID_9768; Strand=+; Position=351-578
SSPLWSPLFKMSTYLLREAVDRLLSHLHTRYDIMDASGGDLAEFAQGDLLISYAFDLTAAMMTFPFALHWLRTFLT

SEQ ID NO: 30072 - protein, 296 aa, Diabrotica virgifera
  misc_feature: Coding regions on vcDNA: vcDNA=SeqID_9769; Strand=+; Position=3-889
  misc_feature: Homolog annotation: Hit_ID=XP_392702.1; Match level="QueryCoverage =98%, HitCoverage=14%, E-value=1e-107, Identity=65%"; Hit description= similar to CG30387-PA [Apis mellifera]
  misc_feature: Pfam annotation: Pfam_ID=KAP_NTPase; Match level="Score=47.9, E-value= 3e-11, Copies=1"; Pfam description=KAP family P-loop domain
  misc_feature (265)..(266): Xaa can be any naturally occurring amino acid
  misc_feature (282)..(282): Xaa can be any naturally occurring amino acid
  misc_feature (286)..(286): Xaa can be any naturally occurring amino acid
FFFTDQTRVSSTAGGENSVVQMIGSLYDAIESRYGSVATRLYRAFKPKPVKSASSWTYRKVCCLPYVVFFEVTLLMLLTGTCALTIYLIHVSATTTVTDINEFTLKMILVVAALLLGVACLANMYTWSRMLKALLFSQRRHLQRSISKLETLKSEGFLQTLRQEVNLMKDMVKCLDSLSSQQTRLVVVVDGLDSCEQDKVLLVLDTVHMLFSDANTPFIVILAIDPHVIAKAVEVNTRRLFSENNIGGHNYLSNMVHLPFYLQNXXGLRKVKSAQQTALAHXEQVXNWTENDEKSH

SEQ ID NO: 30073 - protein, 238 aa, Diabrotica virgifera
  misc_feature: Coding regions on vcDNA: vcDNA=SeqID_9770; Strand=+; Position=147-863
  misc_feature: Homolog annotation: Hit_ID=XP_308390.1; Match level="QueryCoverage =89%, HitCoverage=49%, E-value=2e-33, Identity=35%"; Hit description =ENSANGP00000009437 [Anopheles gambiae]
  misc_feature: Gene Ontology Annotation: Molecular function=permease activity; Cellular component=nucleus; Biological process=acrosome formation
  misc_feature (213)..(213): Xaa can be any naturally occurring amino acid
  misc_feature (230)..(230): Xaa can be any naturally occurring amino acid
MTVTPGFTNMFKGTLPQISAVLAGTLCALSDGMHYGWTAPAIPILMSPGSPIPITKHQGEWLENVYVIGAAIGLWPTMYAVDKIGRKKSILLACFVSALVWITIALAPSVEYIFVARGFAGAAGNMAFVATPMYIAEIADQKIRGFLSSLIYLMMLCGILLIYCIAPFFPIYVPCILGAVMVSIELIWFSLVPNSPYYLIIKNQIEAARHSLXRLRQNDSGVEEELKQIXLAVDRQRN

SEQ ID NO: 30074 - protein, 188 aa, Diabrotica virgifera
  misc_feature: Coding regions on vcDNA: vcDNA=SeqID_9771; Strand=+; Position=330-893
  misc_feature: Homolog annotation: Hit_ID=XP_311892.1; Match level="QueryCoverage =77%, HitCoverage=18%, E-value=4e-42, Identity=60%"; Hit description =ENSANGP00000018195 [Anopheles gambiae]
  misc_feature: Gene Ontology Annotation: Molecular function=chaperonin ATPase activity; Cellular component=mitochondrion
  misc_feature: Pfam annotation: Pfam_ID=TFIIS_C; Match level="Score=2.6, E-value =0.063, Copies=1"; Pfam description=Transcription factor S-II (TFIIS)
MGSVRRSLVTAGRYAVAARISKLQHGVLSTIYTPGVPHSKGISTSIIVLKTAGTGEPPSGYNPPPPPSKDGSSGSGKNKNTLSCPKCGDPCTHVETFVSSTRFVKCEKCHHFFVVLSEVDSKKKEGVDAKSGQYKKPPPHPKKIYDYLNKHVVGQEHAKKILSVAVYNHYKKIYNNSPTQSNIRQDMA

SEQ ID NO: 30075 - protein, 86 aa, Diabrotica virgifera
  misc_feature: Coding regions on vcDNA: vcDNA=SeqID_9772; Strand=-; Position=1-258
PGYDMVINVSTRLEWNAQALREKLVHYHAVSTVRMYISVRIYAPIVHYVRKEICFFCIPHIFSRGSSLLLWINIRRCSRKLFCTSL

SEQ ID NO: 30076 - protein, 295 aa, Diabrotica virgifera
  misc_feature: Coding regions on vcDNA: vcDNA=SeqID_9773; Strand=+; Position=35-922
  misc_feature: Homolog annotation: Hit_ID=NP_729945.1; Match level="QueryCoverage =96%, HitCoverage=47%, E-value=1e-68, Identity=46%"; Hit description =CG8783-PB, isoform B [Drosophila melanogaster] ref|NP_648680.2| CG8783-PA, isoform A [Drosophila
  misc_feature: Gene Ontology Annotation: Molecular function=molecular_function unknown; Cellular component=cellular_component unknown; Biological process=biological_process unknown
  misc_feature: Pfam annotation: Pfam_ID=UPF0171; Match level="Score=-59.3, E-value =1e-11, Copies=1"; Pfam description=Uncharacterised protein family (UPF01
  misc_feature (60)..(68): Xaa can be any naturally occurring amino acid
  misc_feature (255)..(260): Xaa can be any naturally occurring amino acid
MEVSPLCIILVKSDSKGDRLLFRYPFQTQHSNEPSGTRRKNPYTLPVVDDLLQRNNQPHXXXXXXXXXGFTDEVLSSLFAVKTELCNRKFELKVNDVRFVSHPTILQLRNKQEKEDESESGMLVNIVFALQALASHSVVKCYHDLSKRMGIVLKYEEKRCGYVTEQTQLMTTAHDDGYTSGPGSAFKIILEKCSLAGNIKKMYDDLCSTGLVSLRINRWIPLSFCLPQKVHQWHMRGKIVEPADIDRCLNALRPXXXXXXLHPLQQMNDFTSLDGSPSLDRMLSQYSSFKKFTKH

SEQ ID NO: 30077 - protein, 232 aa, Diabrotica virgifera
  misc_feature: Coding regions on vcDNA: vcDNA=SeqID_9774; Strand=-; Position=0-695
  misc_feature (2)..(23): Xaa can be any naturally occurring amino acid
  misc_feature (27)..(231): Xaa can be any naturally occurring amino acid
KXXXXXXXXXXXXXXXXXXXXXXPLAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXP

SEQ ID NO: 30078 - protein, 56 aa, Diabrotica virgifera
  misc_feature: Coding regions on vcDNA: vcDNA=SeqID_9775; Strand=-; Position=227-397
PYKISQSPTSTFNHIHIYTTIHPQKLMITYCVIQVIIRYCNLATSLSQTPNTILIY

SEQ ID NO: 30079 - protein, 78 aa, Diabrotica virgifera
  misc_feature: Coding regions on vcDNA: vcDNA=SeqID_9776; Strand=-; Position=53-289
CRRRARRYLPTIGVYSCDIISIGSVSLVIRGTWLWISSAGRLVLAITLRVNTIFLHFFFNLLIGRHVMTLLVSILFHL

SEQ ID NO: 30080 - protein, 32 aa, Diabrotica virgifera
  misc_feature: Coding regions on vcDNA: vcDNA=SeqID_9777; Strand=+; Position=66-164
KCWDSIDGHFFILVLSGYIIIQNINKITSNLN

SEQ ID NO: 30081 - protein, 322 aa, Diabrotica virgifera
  misc_feature: Coding regions on vcDNA: vcDNA=SeqID_9778; Strand=-; Position=1-966
  misc_feature (3)..(247): Xaa can be any naturally occurring amino acid
  misc_feature (250)..(288): Xaa can be any naturally occurring amino acid
  misc_feature (290)..(303): Xaa can be any naturally occurring amino acid
  misc_feature (306)..(322): Xaa can be any naturally occurring amino acid
KKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDFXXXXXXXXXXXXXXXXXXXXXXXXXXXXXXXXXXXXXXXGXXXXXXXXXXXXXXSRXXXXXXXXXXXXXXXXX

SEQ ID NO: 30082 - protein, 61 aa, Diabrotica virgifera
  misc_feature: Coding regions on vcDNA: vcDNA=SeqID_9779; Strand=-; Position=371-556
QSYPVYFSRQVMRAKLICYILGYRFCHSYHKNGTSHISLTVLFGISHCGIVHYQQLSEVDR

SEQ ID NO: 30083 - protein, 289 aa, Diabrotica virgifera
  misc_feature: Coding regions on vcDNA: vcDNA=SeqID_9780; Strand=+; Position=66-932
  misc_feature: Homolog annotation: Hit_ID=NP_610283.1; Match level="QueryCoverage =98%, HitCoverage=70%, E-value=4e-22, Identity=27%"; Hit description =CG11127-PA [Drosophila melanogaster] gb|AAF59250.1| CG11127-PA [Drosophila melanogaster]
  misc_feature (280)..(281): Xaa can be any naturally occurring amino acid
MKKYHRLLLIIVSAISLILFLIYRHEYNRLHYVLEVFNFFGQPCNFSDLQTSDYTLKQYDWGPQPMWQEIDNGYIYSAFLTGKIEVKAIALPLDAKKVPRNCYLWFEDKKKPLTGKFTFSKMLNTNLSSLTPYFFYCTAPTIDNSPYAVSFTYKPKKESEMKKILLVDIQITNHKIPNINTTICVSPTTFSKKKIVEFFSFHRLVGVESFIFYTKDIPYRLSKLLMNLSKRLDAHVAFLPWDFPKNDIDVAQSIIEYDCLFRTYGRSRFIITLKLNEYLXXTTSYTQGT

SEQ ID NO: 30084 - protein, 321 aa, Diabrotica virgifera
  misc_feature: Coding regions on vcDNA: vcDNA=SeqID_9781; Strand=+; Position=2-963
  misc_feature: Homolog annotation: Hit_ID=XP_319170.1; Match level="QueryCoverage =98%, HitCoverage=100%, E-value=1e-115, Identity=50%"; Hit description=ENSANGP00000011845 [Anopheles gambiae]
  misc_feature: Gene Ontology Annotation: Molecular function=protein binding; Cellular component=plasma membrane; Biological process=cell differentiation
  misc_feature: Pfam annotation: Pfam_ID=EGF; Match level="Score=18.0, E-value=0.029, Copies=4"; Pfam description=EGF-like domain
  misc_feature (150)..(159): Xaa can be any naturally occurring amino acid
  misc_feature (166)..(176): Xaa can be any naturally occurring amino acid
  misc_feature (291)..(291): Xaa can be any naturally occurring amino acid
SVIKIVDPVPEKPCQPSPCGPNSQCREVNGQAVCSCLPEYTGSPPGCRPECTVSTECAHNKACVNQKCVDPCPGTCGINAECKVVNHNPICTCTNGNTGDPFTRCYHIPAPKPDITKPANPCIPSPCGPNSQCRDLGGQAMCLCLPEYFXXXXXXXXXXVVNSECXXXXXXXXXXXSDPCPGSCGISATCEVRNHNAICFCPSGYSGDAFRSCFPVPPPKPEPKNPCYPNPCGPNAQCTDGICKCYPEYQGDPYVECRPECLVNQDCPRDKACVNRKCKDPCIGTCGQNAXMTIFNPYPSWTCLDGYSGNPFFICNRIEKP

SEQ ID NO: 30085 - protein, 94 aa, Diabrotica virgifera
  misc_feature: Coding regions on vcDNA: vcDNA=SeqID_9782; Strand=+; Position=179-463
  misc_feature (71)..(84): Xaa can be any naturally occurring amino acid
NHGFGLVTNKLKYFPSFYSLKYFPSFYSLKYYCIRCELVRRGDIYKFSSASSGKSVNVYRKFDINVKVINXXXXXXXXXXXXXXWSKLWYIFLP

SEQ ID NO: 30086 - protein, 233 aa, Diabrotica virgifera
  misc_feature: Coding regions on vcDNA: vcDNA=SeqID_9783; Strand=+; Position=177-878
  misc_feature: Homolog annotation: Hit_ID=NP_650939.2; Match level="QueryCoverage =83%, HitCoverage=52%, E-value=1e-42, Identity=61%"; Hit description =CG3421-PA [Drosophila melanogaster] gb|AAF55845.2| CG3421-PA [Drosophila melanogaster]
  misc_feature: Pfam annotation: Pfam_ID=WW; Match level="Score=21.2, E-value=0.0031, Copies=2"; Pfam description=WW domain
MASNSYNRVEWVEIIEPKTQEHMYANLATGECVWDPPEGVPVKRTDSNQWWELFDQNTARFYYYNATSQRTVWHKPTNCDIIPLAKLQTLKHNTDCTPAATSHQSTQTGHLTERGQVLTLSASTPDLCRSSSFSQRGAEAPLYSNWHDSQLLPLEHFLLNNSRDSDSDHSDSGSESLTGHEPDNEDSDQSEGSYLPHRLSHRPVEYLNLPTAATTEPRDRDVKERPTVPLLNH

SEQ ID NO: 30087 - protein, 88 aa, Diabrotica virgifera
  misc_feature: Coding regions on vcDNA: vcDNA=SeqID_9784; Strand=+; Position=663-929
  misc_feature (14)..(19): Xaa can be any naturally occurring amino acid
  misc_feature (76)..(81): Xaa can be any naturally occurring amino acid
  misc_feature (85)..(85): Xaa can be any naturally occurring amino acid
LYSACETGEAKEGXXXXXXSSGEGRILHEVWGPDLIKQLLKLIQNIMETYRMSQEWEISILIPLIKKGDPEHYRGXXXXXXQSNXNIY

SEQ ID NO: 30088 - protein, 59 aa, Diabrotica virgifera
  misc_feature: Coding regions on vcDNA: vcDNA=SeqID_9785; Strand=-; Position=243-422
  misc_feature (42)..(42): Xaa can be any naturally occurring amino acid
KVEEEYKDLEAEEQAGFRAGRSTTDHLYCVTQLIDKQIAYNXEFHLVYIYLKKASDTVP

SEQ ID NO: 30089 - protein, 310 aa, Diabrotica virgifera
  misc_feature: Coding regions on vcDNA: vcDNA=SeqID_9786; Strand=+; Position=2-934
  misc_feature (115)..(124): Xaa can be any naturally occurring amino acid
  misc_feature (188)..(197): Xaa can be any naturally occurring amino acid
  misc_feature (211)..(221): Xaa can be any naturally occurring amino acid
  misc_feature (274)..(274): Xaa can be any naturally occurring amino acid
  misc_feature (296)..(296): Xaa can be any naturally occurring amino acid
EFKKTERGEWKGDESAKELFYIWRKLKSRCQEEYNEERDNNTRLEDEAISNIYAEEQIEENKTEIHENSGKTENQIYNTETEDKENSNEKELEETEYAQIINLTETTSEQKDETXXXXXXXXXXDVIVQRPVTPVPLRQSQKRNISAAFLDHIFWPEESPEKKVFTRKEKLPYATTSLKWLQYHEEKXXXXXXXXXXKQEKALLRKKKREXXXXXXXXXXXAKKASAKKSKTKVNTEEDTDSSEECDEWQESGSSLDDISEHFSSDTDENEPLXHEVKNLKKDISIGDFYFGAFPXKNVIITMFALYKYL

SEQ ID NO: 30090 - protein, 283 aa, Diabrotica virgifera
  misc_feature: Coding regions on vcDNA: vcDNA=SeqID_9787; Strand=+; Position=2-853
  misc_feature (1)..(128): Xaa can be any naturally occurring amino acid
  misc_feature (132)..(177): Xaa can be any naturally occurring amino acid
  misc_feature (184)..(213): Xaa can be any naturally occurring amino acid
  misc_feature (221)..(228): Xaa can be any naturally occurring amino acid
  misc_feature (231)..(251): Xaa can be any naturally occurring amino acid
  misc_feature (254)..(262): Xaa can be any naturally occurring amino acid
  misc_feature (272)..(278): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFSPXXXXXXXXXXXXXXXXXXXXXXXXXXXXXXXXXXXXXXXXXXXXXXMDETKLXXXXXXXXXXXXXXXXXXXXXXXXXXXXXXLLIRFVRXXXXXXXXIKXXXXXXXXXXXXXXXXXXXXXFFXXXXXXXXXNRGNLLGRSXXXXXXXTSWLD

SEQ ID NO: 30091 - protein, 155 aa, Diabrotica virgifera
  misc_feature: Coding regions on vcDNA: vcDNA=SeqID_9788; Strand=+; Position=85-552
  misc_feature: Homolog annotation: Hit_ID=XP_317807.1; Match level="QueryCoverage =88%, HitCoverage=37%, E-value=8e-46, Identity=64%"; Hit description =ENSANGP00000014912 [Anopheles gambiae]
  misc_feature: Gene Ontology Annotation: Molecular function=UDP-N-acetylglucosamine transporter activity; Cellular component=endoplasmic reticulum; Biological process=amine/polyamine transport
MSAKAAQAIVLTLAGCMLNNVFLEYIIKLDPGAGHLITLCQFLFIAVHGLIFTSKFGTVKPKIPLSGYMTLVVLFFTTSVVNNWAFAFNIPVPLHMIFRAGSLIANMIMGIIVLKNKYSLDKYISVLLITLGIIICTIYSCSQMPIVCVYCELRV

SEQ ID NO: 30092 - protein, 197 aa, Diabrotica virgifera
  misc_feature: Coding regions on vcDNA: vcDNA=SeqID_9789; Strand=-; Position=1-591
  misc_feature (12)..(13): Xaa can be any naturally occurring amino acid
  misc_feature (18)..(48): Xaa can be any naturally occurring amino acid
  misc_feature (51)..(197): Xaa can be any naturally occurring amino acid
GFSSLKKLSFYXXNKFLXXXXXXXXXXXXXXXXXXXXXXXXXXXXXXXTRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30093 - protein, 132 aa, Diabrotica virgifera
  misc_feature: Coding regions on vcDNA: vcDNA=SeqID_9790; Strand=+; Position=1-399
  misc_feature: Homolog annotation: Hit_ID=NP_569983.1; Match level="QueryCoverage =81%, HitCoverage=27%, E-value=1e-23, Identity=55%"; Hit description =CG3630-PA [Drosophila melanogaster] gb|AAF45738.3| CG3630-PA [Drosophila melanogaster]
FHITFICISILFIYSVAFQATIHVSREMLELCEVISQCGERLFSPEEKPNDPRIVISFGELFAIYTAISDKVVGILLRARKYNLVDFEGECLFQRQDDHVPIILVKPISEIRTFLKERIATATKALKETGEM

SEQ ID NO: 30094 - protein, 71 aa, Diabrotica virgifera
  misc_feature: Coding regions on vcDNA: vcDNA=SeqID_9791; Strand=+; Position=477-692
  misc_feature (45)..(45): Xaa can be any naturally occurring amino acid
DAHESDGETIYGQIYEQWGYPLTQLSWTTVRGGSELCSQPRATLXCSATRRIFFLSFLLFSSSGSYCDTPP

SEQ ID NO: 30095 - protein, 213 aa, Diabrotica virgifera
  misc_feature: Coding regions on vcDNA: vcDNA=SeqID_9792; Strand=+; Position=229-870
  misc_feature: Homolog annotation: Hit_ID=AAV91017.1; Match level="QueryCoverage =82%, HitCoverage=36%, E-value=3e-17, Identity=31%"; Hit description =hemolymph proteinase 19 [Manduca sexta]
MGVELTLVLLLFGSVVSQDLVSPCPNWFKYEARKPDEPDRIYGVLTLMSESDLGGIWMRVNFDRPSLQLGNWFGIVKTDDNTMYKIQAPNKKLLANVPTKVRFYIKYDTSQPPPKLVEIRLNAKTVCPEKGATTEAPASTDMYFTSPELNIPSTQRPFERPTRPSRPSRPTVPINPPVSSIDNFYENNNGRPSNSDDDDFFMDFAWLGKPRPK

SEQ ID NO: 30096 - protein, 188 aa, Diabrotica virgifera
  misc_feature: Coding regions on vcDNA: vcDNA=SeqID_9793; Strand=-; Position=2-565
  misc_feature (18)..(25): Xaa can be any naturally occurring amino acid
  misc_feature (28)..(41): Xaa can be any naturally occurring amino acid
  misc_feature (47)..(60): Xaa can be any naturally occurring amino acid
  misc_feature (62)..(185): Xaa can be any naturally occurring amino acid
YINKVKIEANLAHSGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAMG

SEQ ID NO: 30097 - protein, 186 aa, Diabrotica virgifera
  misc_feature: Coding regions on vcDNA: vcDNA=SeqID_9794; Strand=+; Position=3-563
  misc_feature: Homolog annotation: Hit_ID=CAA10770.1; Match level="QueryCoverage =94%, HitCoverage=51%, E-value=1e-26, Identity=31%"; Hit description =reverse transcriptase-like [Bos taurus]
TNINSQWDHSSEIKQRIGKARSAFIMMKSLFRSHDLPLATKISIIRCYVFSTLLYGVEAWTLSEASLRKLEAFEMWCYRRILRISWVDRVTNIEVLRRIGKECEIINIIKERKLEYLGHVMRNEQRYGLLQLILQGKVFGKRGPGRRRISWLQNLRKWFNTSTTGLFRIAASKVRIAMLVANIRNG

SEQ ID NO: 30098 - protein, 239 aa, Diabrotica virgifera
  misc_feature: Coding regions on vcDNA: vcDNA=SeqID_9795; Strand=+; Position=106-826
  misc_feature: Homolog annotation: Hit_ID=XP_393426.1; Match level="QueryCoverage =82%, HitCoverage=82%, E-value=8e-40, Identity=48%"; Hit description =similar to vesicle-associated membrane protein, associated protein B and C; VAMP-associated
  misc_feature: Gene Ontology Annotation: Molecular function=molecular_function unknown; Cellular component=integral to plasma membrane; Biological process=nonselective vesicle transport
  misc_feature: Pfam annotation: Pfam_ID=Motile_Sperm; Match level="Score=87.9, E -value=2.6e-23, Copies=1"; Pfam description=MSP (Major sperm protein) domain
  misc_feature (47)..(52): Xaa can be any naturally occurring amino acid
MSKPEQVLQIEPQHELKFKGPFNEPSGTYMKLTNPTDKRVVYKIKTXXXXXXVRPNSGILEPNSHTEISIFFQPQPLLFDTAEKNKHKFMVQTAFAPESDFNMDQLWKEITPDQLMDSKLKCVFELPPDQTEGTTEDATKFSPKTVAANSAVPDNSNVEWELKKAAQEVQQLREEESQLRQQHLRLKEEILQLKQQLGQSRAAPVNRYAPPVQEQTIPMGYVGFGSTSELHRHHIQFAL

SEQ ID NO: 30099 - protein, 125 aa, Diabrotica virgifera
  misc_feature: Coding regions on vcDNA: vcDNA=SeqID_9796; Strand=+; Position=3-380
  misc_feature (6)..(22): Xaa can be any naturally occurring amino acid
  misc_feature (28)..(45): Xaa can be any naturally occurring amino acid
  misc_feature (49)..(60): Xaa can be any naturally occurring amino acid
  misc_feature (73)..(81): Xaa can be any naturally occurring amino acid
  misc_feature (94)..(105): Xaa can be any naturally occurring amino acid
SNLEEXXXXXXXXXXXXXXXXXCEVLFXXXXXXXXXXXXXXXXXXHIYXXXXXXXXXXXXLGMSLQITFYYNXXXXXXXXXQILISSNMLLFIXXXXXXXXXXXXYHHIHLNVFKFNNDENISIK

SEQ ID NO: 30100 - protein, 112 aa, Diabrotica virgifera
  misc_feature: Coding regions on vcDNA: vcDNA=SeqID_9797; Strand=-; Position=375-713
  misc_feature (45)..(45): Xaa can be any naturally occurring amino acid
  misc_feature (58)..(58): Xaa can be any naturally occurring amino acid
  misc_feature (102)..(102): Xaa can be any naturally occurring amino acid
  misc_feature (106)..(106): Xaa can be any naturally occurring amino acid
IFLLKNNSSHYKIIITTTQIQFIFLITQTPHITILPFNSNKTLPXFFSLFIILTFFNXLFFLTLNFYFYILISIFIFNFFYNISSYNLPPNSIYLNPPYIFXYILXSPSNTI

SEQ ID NO: 30101 - protein, 80 aa, Diabrotica virgifera
  misc_feature: Coding regions on vcDNA: vcDNA=SeqID_9798; Strand=+; Position=480-719
TLTLLWPQHHENGPLTHSPYLPRFLKKHTPLLNWNSKFGKISEKLLEDYSAQNISRGFFVGIFCPKKFVGITCPGFLCLF

SEQ ID NO: 30102 - protein, 79 aa, Diabrotica virgifera
  misc_feature: Coding regions on vcDNA: vcDNA=SeqID_9799; Strand=-; Position=2-238
  misc_feature (2)..(13): Xaa can be any naturally occurring amino acid
  misc_feature (16)..(26): Xaa can be any naturally occurring amino acid
  misc_feature (36)..(43): Xaa can be any naturally occurring amino acid
  misc_feature (46)..(59): Xaa can be any naturally occurring amino acid
  misc_feature (65)..(78): Xaa can be any naturally occurring amino acid
YXXXXXXXXXXXXPFXXXXXXXXXXXTNLAHTGLNXXXXXXXXSNXXXXXXXXXXXXXXPTSRSXXXXXXXXXXXXXXV

SEQ ID NO: 30103 - protein, 60 aa, Diabrotica virgifera
  misc_feature: Coding regions on vcDNA: vcDNA=SeqID_9800; Strand=-; Position=40-222
GWALIITRYRILDRRLIKISNGPLLSLSSSIFIVTYHLYLLGIPYLFTICSLVIKHYTNS

SEQ ID NO: 30104 - protein, 189 aa, Diabrotica virgifera
  misc_feature: Coding regions on vcDNA: vcDNA=SeqID_9801; Strand=-; Position=1-567
  misc_feature (1)..(167): Xaa can be any naturally occurring amino acid
  misc_feature (169)..(189): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXX

SEQ ID NO: 30105 - protein, 94 aa, Diabrotica virgifera
  misc_feature: Coding regions on vcDNA: vcDNA=SeqID_9802; Strand=-; Position=198-482
MNKLYYNGNSENTMFETNPTTICRISGTMYNPRLEIFLGGFMAPMASFSLNSLSSSISCTSFISSSDESLPTGKWSSKTLFSSESSTISGSTAL

SEQ ID NO: 30106 - protein, 71 aa, Diabrotica virgifera
  misc_feature: Coding regions on vcDNA: vcDNA=SeqID_9803; Strand=-; Position=16-231
IKSGTAEELERSRSHGSRSFAIGQECAMPNKYSDLLKTVNNSLIQGVTKIQVTNQTTHSGTKNSPIEPNPP

SEQ ID NO: 30107 - protein, 210 aa, Diabrotica virgifera
  misc_feature: Coding regions on vcDNA: vcDNA=SeqID_9804; Strand=+; Position=137-769
  misc_feature: Pfam annotation: Pfam_ID=DUF1397; Match level="Score=-120.7, E-value =0.043, Copies=1"; Pfam description=Protein of unknown function (DUF1397)
  misc_feature (203)..(203): Xaa can be any naturally occurring amino acid
SRSNLILSSDTKMDGFAFYFLMGLVHSMYIFDGVNFNGNCSFDVLRDISGHINTCLIKDPDALKLYFSHAQEHLPLPEFIENRCSINSNLTDCVEKPMDNLKPCFESDFWQALKKWKVIDEQVLSKLCEDNGQKAARIFKFEGEKCWDQGLRTVSNECSKFITNLPNTLAPCRNFNRFKQCFVSHLSEYCSTEATNFLQPILXILSDDIC

SEQ ID NO: 30108 - protein, 62 aa, Diabrotica virgifera
  misc_feature: Coding regions on vcDNA: vcDNA=SeqID_9805; Strand=-; Position=2-187
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(61): Xaa can be any naturally occurring amino acid
FXXXXXXXXXXXNQPGSHRFKXXXXXXXXXEXXXXXXXXXXXXXXSNIEVAXXXXXXXXXXK

SEQ ID NO: 30109 - protein, 123 aa, Diabrotica virgifera
  misc_feature: Coding regions on vcDNA: vcDNA=SeqID_9806; Strand=+; Position=3-374
  misc_feature (12)..(17): Xaa can be any naturally occurring amino acid
  misc_feature (68)..(76): Xaa can be any naturally occurring amino acid
  misc_feature (107)..(113): Xaa can be any naturally occurring amino acid
YLIFKIIKSLSXXXXXXVKISLSSTDKLNLSIRRDESLSLLLKEKSHFSYLAYPGISSINQSIITHYXXXXXXXXXLKIFHRKINTLNQFFRNETLLVFQIIISIFXXXXXXXLTNNIILSIK

SEQ ID NO: 30110 - protein, 17 aa, Diabrotica virgifera
  misc_feature: Coding regions on vcDNA: vcDNA=SeqID_9807; Strand=-; Position=1-51
  misc_feature (1)..(16): Xaa can be any naturally occurring amino acid
XXXXXXXXXXXXXXXXL

SEQ ID NO: 30111 - protein, 74 aa, Diabrotica virgifera
  misc_feature: Coding regions on vcDNA: vcDNA=SeqID_9808; Strand=+; Position=1-225
KFRCNFIAYVFFYSKSKQYSFVHRILRNLSVDRPHVPIFSIKSAFSKCREVKLIEIYRIVISHLPDNMNTKVFS

SEQ ID NO: 30112 - protein, 304 aa, Diabrotica virgifera
  misc_feature: Coding regions on vcDNA: vcDNA=SeqID_9809; Strand=-; Position=1-912
  misc_feature (4)..(304): Xaa can be any naturally occurring amino acid
KKLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30113 - protein, 83 aa, Diabrotica virgifera
  misc_feature: Coding regions on vcDNA: vcDNA=SeqID_9810; Strand=+; Position=1-252
  misc_feature (40)..(46): Xaa can be any naturally occurring amino acid
  misc_feature (58)..(64): Xaa can be any naturally occurring amino acid
EKFIPLFPFKRYYQDYKARLTSFQKHRLRTTSSLRRSYIXXXXXXXIVQGKTIIANLXXXXXXXSLRRSNTQSRFSNESESLF

SEQ ID NO: 30114 - protein, 259 aa, Diabrotica virgifera
  misc_feature: Coding regions on vcDNA: vcDNA=SeqID_9811; Strand=-; Position=1-777
  misc_feature (4)..(196): Xaa can be any naturally occurring amino acid
  misc_feature (199)..(236): Xaa can be any naturally occurring amino acid
  misc_feature (239)..(259): Xaa can be any naturally occurring amino acid
LLVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFXXXXXXXXXXXXXXXXXXXXXXXXXXXXXXXXXXXXXXEVXXXXXXXXXXXXXXXXXXXXX

SEQ ID NO: 30115 - protein, 184 aa, Diabrotica virgifera
  misc_feature: Coding regions on vcDNA: vcDNA=SeqID_9812; Strand=-; Position=1-552
  misc_feature (1)..(184): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30116 - protein, 138 aa, Diabrotica virgifera
  misc_feature: Coding regions on vcDNA: vcDNA=SeqID_9813; Strand=+; Position=160-576
  misc_feature: Homolog annotation: Hit_ID=XP_320445.1; Match level="QueryCoverage =97%, HitCoverage=60%, E-value=2e-59, Identity=86%"; Hit description =ENSANGP00000016863 [Anopheles gambiae]
  misc_feature: Gene Ontology Annotation: Molecular function=transporter activity; Cellular component=proton-transporting ATP synthase, catalytic core (sensu Eukarya); Biological process=energy pathways
  misc_feature: Pfam annotation: Pfam_ID=ATP-synt_ab_C; Match level="Score=147.0, E -value=4.2e-41, Copies=1"; Pfam description=ATP synthase alpha/beta chain, C term
  misc_feature (88)..(93): Xaa can be any naturally occurring amino acid
  misc_feature (115)..(115): Xaa can be any naturally occurring amino acid
PVLGIYPAVDPLDSTSRIMDPNIIGAEHYKVARDVQKILQDYKSLQDIIAILGMDELSEDDKLTVSRARKIQRFLSQPFQVAEVFTGXXXXXXPLEETIKGFQKILAGELDHLPXVAFYMLGPIEEVVQKAEQLAEST

SEQ ID NO: 30117 - protein, 26 aa, Diabrotica virgifera
  misc_feature: Coding regions on vcDNA: vcDNA=SeqID_9814; Strand=+; Position=2-79
  misc_feature (2)..(20): Xaa can be any naturally occurring amino acid
MXXXXXXXXXXXXXXXXXXXWDERVD

SEQ ID NO: 30118 - protein, 97 aa, Diabrotica virgifera
  misc_feature: Coding regions on vcDNA: vcDNA=SeqID_9815; Strand=+; Position=19-312
  misc_feature (40)..(48): Xaa can be any naturally occurring amino acid
  misc_feature (50)..(58): Xaa can be any naturally occurring amino acid
  misc_feature (68)..(80): Xaa can be any naturally occurring amino acid
FSIRERITSPYKRKISPFVPPCIQGFIINNLSSLHHPRIXXXXXXXXXHXXXXXXXXXFRNEIVTRFXXXXXXXXXXXXXTSLNNNILSIQITFNTN

SEQ ID NO: 30119 - protein, 167 aa, Diabrotica virgifera
  misc_feature: Coding regions on vcDNA: vcDNA=SeqID_9816; Strand=-; Position=1-501
  misc_feature (9)..(16): Xaa can be any naturally occurring amino acid
  misc_feature (18)..(167): Xaa can be any naturally occurring amino acid
TVYIFNKDXXXXXXXXHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30120 - protein, 85 aa, Diabrotica virgifera
  misc_feature: Coding regions on vcDNA: vcDNA=SeqID_9817; Strand=-; Position=77-334
  misc_feature (55)..(64): Xaa can be any naturally occurring amino acid
NQLQPCLNIVYNNNIELYHRVIQGVPENSAFLQDMDTIHNVEQKSPITFFSKAYXXXXXXXXXXCSPYYKRTFIFLKLTNLASLY

SEQ ID NO: 30121 - protein, 100 aa, Diabrotica virgifera
  misc_feature: Coding regions on vcDNA: vcDNA=SeqID_9818; Strand=+; Position=332-634
MTVVPTIATSEYTDEYDINQENDEEEEDGKQQIIHQREDNQFVITYGKAYQRATEIPSDNNSYELIYVHIVQDPLDIKEGDQTDIDQDMTEDDFDDAEDE

SEQ ID NO: 30122 - protein, 41 aa, Diabrotica virgifera
  misc_feature: Coding regions on vcDNA: vcDNA=SeqID_9819; Strand=-; Position=18-143
FKSRPGLINSCSPIITLIHHRGRNLYYRFELSNKSTLLCLR

SEQ ID NO: 30123 - protein, 59 aa, Diabrotica virgifera
  misc_feature: Coding regions on vcDNA: vcDNA=SeqID_9820; Strand=-; Position=140-319
  misc_feature (3)..(14): Xaa can be any naturally occurring amino acid
  misc_feature (47)..(53): Xaa can be any naturally occurring amino acid
ICXXXXXXXXXXXXQIYSKPNNTSLHKNYINYLFFTKNNKASALLNXXXXXXXLLINNP

SEQ ID NO: 30124 - protein, 285 aa, Diabrotica virgifera
  misc_feature: Coding regions on vcDNA: vcDNA=SeqID_9821; Strand=-; Position=48-907
  misc_feature: Homolog annotation: Hit_ID=NP_503166.1; Match level="QueryCoverage =96%, HitCoverage=36%, E-value=5e-33, Identity=33%"; Hit description =predicted CDS, reverse transcriptase family member (5A739) [Caenorhabditis elegans]
  misc_feature (21)..(21): Xaa can be any naturally occurring amino acid
  misc_feature (25)..(25): Xaa can be any naturally occurring amino acid
  misc_feature (38)..(38): Xaa can be any naturally occurring amino acid
  misc_feature (50)..(56): Xaa can be any naturally occurring amino acid
  misc_feature (88)..(88): Xaa can be any naturally occurring amino acid
  misc_feature (104)..(104): Xaa can be any naturally occurring amino acid
  misc_feature (171)..(171): Xaa can be any naturally occurring amino acid
  misc_feature (233)..(233): Xaa can be any naturally occurring amino acid
ALVDYEKAFNSAEILIWAIEXALNXSRTDSRYRQLLHXIYKTATMTVEWXXXXXXXNPIEMRRGVRQGDVISPKLFTLALGDVFKTEXEDMGININGKNLNHLXYCDDVVLITANQEELATMLTQLAHTSEKIGLKLNMSKTKIITNTNDRKNVNINNVNIEVVDEYMYIXGQIIKANKENQTIEVQRRMRLALAAFGKLRWILKSRKIQQYLKTRVFDQCILPVLTYGSETXTLTKTNINKIEITQRKMERFMLGIKLQERKSNKWIREETKVKNITEHITALK

SEQ ID NO: 30125 - protein, 66 aa, Diabrotica virgifera; identical to SEQ ID NO: 26808
  misc_feature: Coding regions on vcDNA: vcDNA=SeqID_9822; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 30126 - protein, 105 aa, Diabrotica virgifera
  misc_feature: Coding regions on vcDNA: vcDNA=SeqID_9823; Strand=-; Position=2-316
  misc_feature (2)..(11): Xaa can be any naturally occurring amino acid
  misc_feature (13)..(92): Xaa can be any naturally occurring amino acid
  misc_feature (94)..(104): Xaa can be any naturally occurring amino acid
RXXXXXXXXXXDXXXXXXXXXXXXXXXXXXXXXXXXXXXXXXXXXXXXXXXXXXXXXXXXXXXXXXXXXXXXXXXXXXXXXXXXXXXXXXXXTXXXXXXXXXXXI

SEQ ID NO: 30127 - protein, 263 aa, Diabrotica virgifera
  misc_feature: Coding regions on vcDNA: vcDNA=SeqID_9824; Strand=+; Position=2-790
  misc_feature (6)..(33): Xaa can be any naturally occurring amino acid
  misc_feature (35)..(67): Xaa can be any naturally occurring amino acid
  misc_feature (71)..(78): Xaa can be any naturally occurring amino acid
  misc_feature (81)..(197): Xaa can be any naturally occurring amino acid
  misc_feature (199)..(212): Xaa can be any naturally occurring amino acid
  misc_feature (218)..(231): Xaa can be any naturally occurring amino acid
  misc_feature (244)..(244): Xaa can be any naturally occurring amino acid
  misc_feature (251)..(262): Xaa can be any naturally occurring amino acid
FSILIXXXXXXXXXXXXXXXXXXXXXXXXXXXXDXXXXXXXXXXXXXXXXXXXXXXXXXXXXXXXXXVFFXXXXXXXXPTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXRPRCWXXXXXXXXXXXXXXVRLLKFYIDLSLXRCEPGWXXXXXXXXXXXXK

SEQ ID NO: 30128 - protein, 82 aa, Diabrotica virgifera
  misc_feature: Coding regions on vcDNA: vcDNA=SeqID_9825; Strand=+; Position=1-249
ATESDSSHISDNFNRIVLEYGNTTTRNIGTATLKTAHYALPLNEANQIGFFFYPETQFPIDANEMFQQYVVKGMSYTVFPPP

SEQ ID NO: 30129 - protein, 74 aa, Diabrotica virgifera
  misc_feature: Coding regions on vcDNA: vcDNA=SeqID_9826; Strand=+; Position=3-227
  misc_feature: Homolog annotation: Hit_ID=XP_314270.1; Match level="QueryCoverage =87%, HitCoverage=10%, E-value=6e-17, Identity=61%"; Hit description =ENSANGP00000018675 [Anopheles gambiae]
VPTGHFPDKLTSSGQSRLAARDDVRVRYQYYKDPGYSRDLTSDDYVKREERWYKYQDRLANERHYEHRLGDSRW

SEQ ID NO: 30130 - protein, 37 aa, Diabrotica virgifera
  misc_feature: Coding regions on vcDNA: vcDNA=SeqID_9827; Strand=-; Position=1-111
  misc_feature (1)..(36): Xaa can be any naturally occurring amino acid
XXXXXXXXXXXXXXXXXXXXXXXXXXXXXXXXXXXXF

SEQ ID NO: 30131 - protein, 153 aa, Diabrotica virgifera
  misc_feature: Coding regions on vcDNA: vcDNA=SeqID_9828; Strand=+; Position=277-738
  misc_feature (22)..(29): Xaa can be any naturally occurring amino acid
  misc_feature (74)..(80): Xaa can be any naturally occurring amino acid
KTFRPSRYNTSCGFPFGYLFRXXXXXXXXCSSFCNFQNSPFISVRLASVIFSEHLLLQEIQDGFTRCLAIVAVXXXXXXXIARLSLNFFRLRISPVLVKLSFSALSTDTYIYQDVLNKMETVFLIFFFTFGIRFFRNNICSSQSYITNNLHFI

SEQ ID NO: 30132 - protein, 158 aa, Diabrotica virgifera
  misc_feature: Coding regions on vcDNA: vcDNA=SeqID_9829; Strand=-; Position=475-951
  misc_feature: Homolog annotation: Hit_ID=S13329; Match level="QueryCoverage=98%, HitCoverage=16%, E-value=3e-31, Identity=43%"; Hit description =hypothetical protein 2 - fruit fly (Drosophila melanogaster)
  misc_feature (55)..(61): Xaa can be any naturally occurring amino acid
  misc_feature (73)..(73): Xaa can be any naturally occurring amino acid
  misc_feature (88)..(88): Xaa can be any naturally occurring amino acid
  misc_feature (158)..(158): Xaa can be any naturally occurring amino acid
KSVQVTSTKFRGTVPPVTVNGQDLPQSDSVKYLGMHLDKGLTGRKHIFNKRKQLXXXXXXXYWLLGRQSKLSXKNKLLVYKVALKPIXTYGIQLRGTAANSNIEILERFQSKVLRTVTNTPWFIPNREIRDGLQVVTVKEIVSEYSSRYLVKLENHPX

SEQ ID NO: 30133 - protein, 61 aa, Diabrotica virgifera
  misc_feature: Coding regions on vcDNA: vcDNA=SeqID_9830; Strand=+; Position=262-447
GTTIMQPRRRGHNWTREKSRAHLSANHKVVADKTAPITKRRVPLIARINIAACFTLLKPYH

SEQ ID NO: 30134 - protein, 107 aa, Diabrotica virgifera
  misc_feature: Coding regions on vcDNA: vcDNA=SeqID_9831; Strand=-; Position=468-791
QIINLEMNILGESLSSENVIECSKPSCQGHIQSKNLVTMSLEFLEQWPYHTEYTGSPPITKVKQCRVQLNLGWETGLEPRMLLASFALTLPVSTSTLLANTHPILHK

SEQ ID NO: 30135 - protein, 66 aa, Diabrotica virgifera; identical to SEQ ID NO: 26808
  misc_feature: Coding regions on vcDNA: vcDNA=SeqID_9832; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 30136 - protein, 249 aa, Diabrotica virgifera
  misc_feature: Coding regions on vcDNA: vcDNA=SeqID_9833; Strand=-; Position=1-747
  misc_feature (5)..(69): Xaa can be any naturally occurring amino acid
  misc_feature (72)..(249): Xaa can be any naturally occurring amino acid
NLLIXXXXXXXXXXXXXXXXXXXXXXXXXXXXXXXXXXXXXXXXXXXXXXXXXXXXXXXXXXXXXXXXXQWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30137 - protein, 70 aa, Diabrotica virgifera
  misc_feature: Coding regions on vcDNA: vcDNA=SeqID_9834; Strand=+; Position=3-215
  misc_feature (1)..(8): Xaa can be any naturally occurring amino acid
  misc_feature (45)..(52): Xaa can be any naturally occurring amino acid
XXXXXXXXEWPDYSERGNMLKPFKELGTGSNQNYWVCTFKLCFRXXXXXXXXLPIIKIPNFTCGNYKIVY

SEQ ID NO: 30138 - protein, 270 aa, Diabrotica virgifera
  misc_feature: Coding regions on vcDNA: vcDNA=SeqID_9835; Strand=+; Position=7-819
  misc_feature: Homolog annotation: Hit_ID=EAL33004.1; Match level="QueryCoverage =80%, HitCoverage=86%, E-value=4e-78, Identity=62%"; Hit description =GA21389-PA [Drosophila pseudoobscura]
  misc_feature: Gene Ontology Annotation: Molecular function=molecular_function unknown; Cellular component=mitochondrion; Biological process=energy pathways
  misc_feature: Pfam annotation: Pfam_ID=SCO1-SenC; Match level="Score=195.1, E-value= 1.4e-55, Copies=1"; Pfam description=SCO1/SenC
  misc_feature (79)..(88): Xaa can be any naturally occurring amino acid
MSCYNVIKSLNGQLLRRSSIYFQSAEVALPSRIHQNARKYSNNTPFPKPKPPGRGIGPITWKNLGITAVLGGGLLAFMXXXXXXXXXXQMKERQRMLGKAAIGGSFELVDSTGKIRNSDEFLGKWLLIYFGFTHCPDICPDELEKMAGVIDILDKAEDMPKIQPLFISVDPNRDTPEVVGKYCKEFSPRLLGLTGSEQQVGQACKAYRVYFSAGPKDSDSDYIVDHTIIMYLVNPEGGFVDYYGQNRTASEISTSIRVHVLKHTTSKSWL

SEQ ID NO: 30139 - protein, 250 aa, Diabrotica virgifera
  misc_feature: Coding regions on vcDNA: vcDNA=SeqID_9836; Strand=-; Position=3-752
  misc_feature (13)..(20): Xaa can be any naturally occurring amino acid
  misc_feature (23)..(36): Xaa can be any naturally occurring amino acid
  misc_feature (42)..(55): Xaa can be any naturally occurring amino acid
  misc_feature (57)..(250): Xaa can be any naturally occurring amino acid
KIETNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30140 - protein, 56 aa, Diabrotica virgifera
  misc_feature: Coding regions on vcDNA: vcDNA=SeqID_9837; Strand=-; Position=1-168
  misc_feature (1)..(56): Xaa can be any naturally occurring amino acid
XXXXXXXXXXXXXXXXXXXXXXXXXXXXXXXXXXXXXXXXXXXXXXXXXXXXXXXX

SEQ ID NO: 30141 - protein, 87 aa, Diabrotica virgifera
  misc_feature: Coding regions on vcDNA: vcDNA=SeqID_9838; Strand=+; Position=135-398
  misc_feature (62)..(82): Xaa can be any naturally occurring amino acid
YLCTSMRRTTGLSAHHTSSLFWNITDTKTPRSLFDRSLSPKEYFGPNWNTHGQRSTIMKRYXXXXXXXXXXXXXXXXXXXXXVYATR

SEQ ID NO: 30142 - protein, 92 aa, Diabrotica virgifera
  misc_feature: Coding regions on vcDNA: vcDNA=SeqID_9839; Strand=+; Position=245-523
  misc_feature (57)..(64): Xaa can be any naturally occurring amino acid
  misc_feature (76)..(84): Xaa can be any naturally occurring amino acid
CIIFRNIHNKDEKIKLRRHRFIIIFLLATILFLLTTIIFFLLSVTVFFYIRTYVDMXXXXXXXXYHHFSSHFLDWXXXXXXXXXYNDEGCQY

SEQ ID NO: 30143 - protein, 214 aa, Diabrotica virgifera
  misc_feature: Coding regions on vcDNA: vcDNA=SeqID_9840; Strand=-; Position=109-752
  misc_feature: Homolog annotation: Hit_ID=BAC57914.1; Match level="QueryCoverage =79%, HitCoverage=16%, E-value=1e-24, Identity=35%"; Hit description =reverse transcriptase [Anopheles gambiae]
  misc_feature (99)..(99): Xaa can be any naturally occurring amino acid
ILDADSFLYQVVQNWIEKNDLQLAVDKIEIIISRGPRQRDDTVFRYQGSEIRPQRSVKYLGITMDDRLTFGQHVIEACRKAEERTTTLNKLMPNIGGPXSQKRLVMLQSILSIILYGAPLWHEVLRMKNYKDMLLRAQRKPLIRVCRAYRNVSTIALQVVAGSVPVHILARERVQMYRRDMKENHFCAFDCSAHSEERTNQSRPWSTYLSAYDL

SEQ ID NO: 30144 - protein, 95 aa, Diabrotica virgifera
  misc_feature: Coding regions on vcDNA: vcDNA=SeqID_9841; Strand=-; Position=0-284
  misc_feature (41)..(94): Xaa can be any naturally occurring amino acid
GCFPPNFKKLLIPNPGGVPNSFLFEFEPLPIKNYAVFSLRXXXXXXXXXXXXXXXXXXXXXXXXXXXXXXXXXXXXXXXXXXXXXXXXXXXXXXL

SEQ ID NO: 30145 - protein, 76 aa, Diabrotica virgifera
  misc_feature: Coding regions on vcDNA: vcDNA=SeqID_9842; Strand=-; Position=1-228
  misc_feature (5)..(15): Xaa can be any naturally occurring amino acid
  misc_feature (27)..(35): Xaa can be any naturally occurring amino acid
  misc_feature (38)..(50): Xaa can be any naturally occurring amino acid
  misc_feature (57)..(69): Xaa can be any naturally occurring amino acid
GPFWXXXXXXXXXXXENQPGFPPGLNXXXXXXXXXRTXXXXXXXXXXXXXFNIEVAXXXXXXXXXXXXXCYPKGNL

SEQ ID NO: 30146 - protein, 34 aa, Diabrotica virgifera; identical to SEQ ID NO: 27603
  misc_feature: Coding regions on vcDNA: vcDNA=SeqID_9843; Strand=-; Position=80-184

SEQ ID NO: 30147 - protein, 97 aa, Diabrotica virgifera
  misc_feature: Coding regions on vcDNA: vcDNA=SeqID_9844; Strand=-; Position=1-291
  misc_feature (2)..(2): Xaa can be any naturally occurring amino acid
  misc_feature (6)..(6): Xaa can be any naturally occurring amino acid
  misc_feature (9)..(96): Xaa can be any naturally occurring amino acid
NXIIYXNKXXXXXXXXXXXXXXXXXXXXXXXXXXXXXXXXXXXXXXXXXXXXXXXXXXXXXXXXXXXXXXXXXXXXXXXXXXXXXXXXXXXXXXXXN

SEQ ID NO: 30148 - protein, 81 aa, Diabrotica virgifera
  misc_feature: Coding regions on vcDNA: vcDNA=SeqID_9845; Strand=+; Position=259-504
  misc_feature (7)..(14): Xaa can be any naturally occurring amino acid
  misc_feature (20)..(25): Xaa can be any naturally occurring amino acid
  misc_feature (28)..(34): Xaa can be any naturally occurring amino acid
  misc_feature (40)..(47): Xaa can be any naturally occurring amino acid
  misc_feature (58)..(81): Xaa can be any naturally occurring amino acid
YLIFYKXXXXXXXXTYLLYXXXXXXELXXXXXXXSYKTVXXXXXXXXIRMKTFHILQXXXXXXXXXXXXXXXXXXXXXXXX

SEQ ID NO: 30149 - protein, 66 aa, Diabrotica virgifera
  misc_feature: Coding regions on vcDNA: vcDNA=SeqID_9846; Strand=-; Position=49-249
  misc_feature (29)..(35): Xaa can be any naturally occurring amino acid
RQSSPENFHNYCNVSGKIGIILLRFLEIXXXXXXXYIGRHAGCDGYFVLCFWDNCLLSLSVILSRH

SEQ ID NO: 30150 - protein, 85 aa, Diabrotica virgifera
  misc_feature: Coding regions on vcDNA: vcDNA=SeqID_9847; Strand=+; Position=3-260
  misc_feature (5)..(11): Xaa can be any naturally occurring amino acid
  misc_feature (15)..(66): Xaa can be any naturally occurring amino acid
SGAGXXXXXXXEYPXXXXXXXXXXXXXXXXXXXXXXXXXXXXXXXXXXXXXXXXXXXXXXXXXXXXGMCSEFNRLRYGRHDVSLS

SEQ ID NO: 30151 - protein, 266 aa, Diabrotica virgifera
  misc_feature: Coding regions on vcDNA: vcDNA=SeqID_9848; Strand=-; Position=1-798
  misc_feature (2)..(69): Xaa can be any naturally occurring amino acid
  misc_feature (74)..(83): Xaa can be any naturally occurring amino acid
  misc_feature (88)..(249): Xaa can be any naturally occurring amino acid
  misc_feature (252)..(266): Xaa can be any naturally occurring amino acid
KXXXXXXXXXXXXXXXXXXXXXXXXXXXXXXXXXXXXXXXXXXXXXXXXXXXXXXXXXXXXXXXXXXXXNPWAXXXXXXXXXXLFLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 30152 - protein, 233 aa, Diabrotica virgifera
  misc_feature: Coding regions on vcDNA: vcDNA=SeqID_9849; Strand=-; Position=1-699
  misc_feature (3)..(3): Xaa can be any naturally occurring amino acid
  misc_feature (6)..(17): Xaa can be any naturally occurring amino acid
  misc_feature (27)..(34): Xaa can be any naturally occurring amino acid
  misc_feature (37)..(50): Xaa can be any naturally occurring amino acid
  misc_feature (56)..(69): Xaa can be any naturally occurring amino acid
  misc_feature (71)..(233): Xaa can be any naturally occurring amino acid
YIXGPXXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30153 - protein, 218 aa, Diabrotica virgifera
  misc_feature: Coding regions on vcDNA: vcDNA=SeqID_9850; Strand=+; Position=77-728
  misc_feature: Homolog annotation: Hit_ID=XP_391945.1; Match level="QueryCoverage =96%, HitCoverage=49%, E-value=7e-47, Identity=49%"; Hit description =similar to CG10149-PB [Apis mellifera]
  misc_feature: Gene Ontology Annotation: Molecular function=proteasome endopeptidase activity; Cellular component=proteasome regulatory particle (sensu Eukarya); Biological process=proteolysis and peptidolysis
  misc_feature (76)..(76): Xaa can be any naturally occurring amino acid
  misc_feature (121)..(121): Xaa can be any naturally occurring amino acid
  misc_feature (163)..(163): Xaa can be any naturally occurring amino acid
  misc_feature (210)..(210): Xaa can be any naturally occurring amino acid
IIPLGNIQQHILYSCVIKSTQGGLRHSELHQAYPGHQVFFGKLSKTQAAMSSRALVDYFLYSEAGVGITPRCCQKXLQWAWAESQSFLRQDLETWLSGRYFKTGMHRAPLRLRSSLLREIXRSMTKVMVVEVLLLDSETYHAYMNLPNARSALSSAGTAASAXIYCPPEKQALLDLPCGVLHAADDKDLRTAYSYCYECFAWYDSGESPXVLTALKYM

SEQ ID NO: 30154 - protein, 268 aa, Diabrotica virgifera
  misc_feature: Coding regions on vcDNA: vcDNA=SeqID_9851; Strand=-; Position=2-805
  misc_feature (4)..(41): Xaa can be any naturally occurring amino acid
  misc_feature (43)..(268): Xaa can be any naturally occurring amino acid
IIYXXXXXXXXXXXXXXXXXXXXXXXXXXXXXXXXXXXXXXHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30155 - protein, 182 aa, Diabrotica virgifera
  misc_feature: Coding regions on vcDNA: vcDNA=SeqID_9852; Strand=+; Position=2-550
  misc_feature (1)..(15): Xaa can be any naturally occurring amino acid
  misc_feature (18)..(27): Xaa can be any naturally occurring amino acid
  misc_feature (31)..(54): Xaa can be any naturally occurring amino acid
  misc_feature (59)..(118): Xaa can be any naturally occurring amino acid
  misc_feature (136)..(180): Xaa can be any naturally occurring amino acid
XXXXXXXXXXXXXXXYLXXXXXXXXXXTFTXXXXXXXXXXXXXXXXXXXXXXXXVTKRXXXXXXXXXXXXXXXXXXXXXXXXXXXXXXXXXXXXXXXXXXXXXXXXXXXXXXXXXXXXILKYVINLTFIYYYFHFXXXXXXXXXXXXXXXXXXXXXXXXXXXXXXXXXXXXXXXXXXXXXRF

SEQ ID NO: 30156 - protein, 189 aa, Diabrotica virgifera
  misc_feature: Coding regions on vcDNA: vcDNA=SeqID_9853; Strand=+; Position=314-880
  misc_feature: Homolog annotation: Hit_ID=BAC98835.1; Match level="QueryCoverage =87%, HitCoverage=60%, E-value=2e-15, Identity=27%"; Hit description =juvenile hormone acid methyltransferase [Bombyx mori]
  misc_feature (123)..(129): Xaa can be any naturally occurring amino acid
MGAMVLPKLYSNINISKVTCQKLVEKYKHLISWRKNESILEIGIGDGSNSQNTIRPLLPKDYKEYIASDVSVNMLKHVKETYSIPNAQFRNFDISGEPPEDFKDRFDHIFSLFTLHMVPNPSXXXXXXXTMLKEGGQMFHVFFDEMPSDPVFEFLHNHPKWSKYRHNRMLSPYQAIGGSYITMTYKKQV

SEQ ID NO: 30157 - protein, 256 aa, Diabrotica virgifera
  misc_feature: Coding regions on vcDNA: vcDNA=SeqID_9854; Strand=+; Position=7-774
  misc_feature (5)..(12): Xaa can be any naturally occurring amino acid
  misc_feature (37)..(45): Xaa can be any naturally occurring amino acid
  misc_feature (47)..(57): Xaa can be any naturally occurring amino acid
  misc_feature (67)..(78): Xaa can be any naturally occurring amino acid
  misc_feature (93)..(101): Xaa can be any naturally occurring amino acid
  misc_feature (103)..(124): Xaa can be any naturally occurring amino acid
  misc_feature (151)..(160): Xaa can be any naturally occurring amino acid
  misc_feature (162)..(190): Xaa can be any naturally occurring amino acid
  misc_feature (199)..(205): Xaa can be any naturally occurring amino acid
  misc_feature (208)..(253): Xaa can be any naturally occurring amino acid
EKYLXXXXXXXXFFVPRVSGISQLIISSSFSSFESSXXXXXXXXXSXXXXXXXXXXXTKRYLVFQIXXXXXXXXXXXXSSNNIIYQLNIFIIXXXXXXXXXSXXXXXXXXXXXXXXXXXXXXXXFKISLSHYLYHHLSTFHFLSNFLSKIXXXXXXXXXXRXXXXXXXXXXXXXXXXXXXXXXXXXXXXXVIKNTSFWXXXXXXXAHXXXXXXXXXXXXXXXXXXXXXXXXXXXXXXXXXXXXXXXXXXXXXXLKS

SEQ ID NO: 30158 - protein, 292 aa, Diabrotica virgifera
  misc_feature: Coding regions on vcDNA: vcDNA=SeqID_9855; Strand=-; Position=1-876
  misc_feature (1)..(38): Xaa can be any naturally occurring amino acid
  misc_feature (40)..(292): Xaa can be any naturally occurring amino acid
XXXXXXXXXXXXXXXXXXXXXXXXXXXXXXXXXXXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30159 - protein, 90 aa, Diabrotica virgifera
  misc_feature: Coding regions on vcDNA: vcDNA=SeqID_9856; Strand=+; Position=48-320
HFFVFSVHVACGHCFGFPHLESFSLELCCVLHFFIVLEGEMFFRNHMKCLRSKGVLWCLKFVFHCTGCAAVTFLRVLCPSSIQLFRFASS

SEQ ID NO: 30160 - protein, 114 aa, Diabrotica virgifera
  misc_feature: Coding regions on vcDNA: vcDNA=SeqID_9857; Strand=-; Position=234-578
  misc_feature: Homolog annotation: Hit_ID=XP_314419.1; Match level="QueryCoverage =79%, HitCoverage=65%, E-value=1e-08, Identity=36%"; Hit description =ENSANGP00000024044 [Anopheles gambiae]
MHFNYESETRISPFSLILTIKTILNNEFGSSIVLPTHNEVDNLLAYVYIYVCIYMCVYIYMYIYVYIYVCIYICGLTLFFLSIHIFLLRYFKSTYKYVSSIYFYVIFDKGIFWE

SEQ ID NO: 30161 - protein, 94 aa, Diabrotica virgifera
  misc_feature: Coding regions on vcDNA: vcDNA=SeqID_9858; Strand=+; Position=123-404
RLLKSPPDDYSTRREASSEHQYIGCGEGGQAAYCRDWLLKRCLFALSIKARLTTDAFEGPRHFDRARVAPSSMCLVRAGMKVRRIITQAPLNPI

SEQ ID NO: 30162 - protein, 159 aa, Diabrotica virgifera
  misc_feature: Coding regions on vcDNA: vcDNA=SeqID_9859; Strand=+; Position=70-549
  misc_feature (6)..(18): Xaa can be any naturally occurring amino acid
  misc_feature (20)..(26): Xaa can be any naturally occurring amino acid
  misc_feature (28)..(38): Xaa can be any naturally occurring amino acid
  misc_feature (42)..(60): Xaa can be any naturally occurring amino acid
  misc_feature (74)..(122): Xaa can be any naturally occurring amino acid
  misc_feature (125)..(158): Xaa can be any naturally occurring amino acid
IYRDRXXXXXXXXXXXXXCXXXXXXXKXXXXXXXXXXXRELXXXXXXXXXXXXXXXXXXXCYTILKISNFLGHXXXXXXXXXXXXXXXXXXXXXXXXXXXXXXXXXXXXXXXXXXXXXXXXXIIXXXXXXXXXXXXXXXXXXXXXXXXXXXXXXXXXXH

SEQ ID NO: 30163 - protein, 81 aa, Diabrotica virgifera
  misc_feature: Coding regions on vcDNA: vcDNA=SeqID_9860; Strand=+; Position=3-245
  misc_feature (2)..(14): Xaa can be any naturally occurring amino acid
  misc_feature (22)..(22): Xaa can be any naturally occurring amino acid
  misc_feature (31)..(31): Xaa can be any naturally occurring amino acid
  misc_feature (47)..(47): Xaa can be any naturally occurring amino acid
  misc_feature (57)..(66): Xaa can be any naturally occurring amino acid
  misc_feature (71)..(81): Xaa can be any naturally occurring amino acid
TXXXXXXXXXXXXXCDLDVGLXFIIGVAAIXIKSVRLLKFYMDLSLXPCETPGWFPXXXXXXXXXXTKRTXXXXXXXXXXX

SEQ ID NO: 30164 - protein, 284 aa, Diabrotica virgifera
  misc_feature: Coding regions on vcDNA: vcDNA=SeqID_9861; Strand=-; Position=1-852
  misc_feature (1)..(33): Xaa can be any naturally occurring amino acid
  misc_feature (35)..(284): Xaa can be any naturally occurring amino acid
XXXXXXXXXXXXXXXXXXXXXXXXXXXXXXXXXAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30165 - protein, 70 aa, Diabrotica virgifera
  misc_feature: Coding regions on vcDNA: vcDNA=SeqID_9862; Strand=+; Position=182-394
HVCSTKVLEYSWKHPVGIKLWSHLCMSLINIVLLWLLFSNGVTIFNLLGSYILVFYLLRDKYVLVIFMLF

SEQ ID NO: 30166 - protein, 65 aa, Diabrotica virgifera
  misc_feature: Coding regions on vcDNA: vcDNA=SeqID_9863; Strand=+; Position=38-232
  misc_feature (1)..(1): Xaa can be any naturally occurring amino acid
  misc_feature (14)..(20): Xaa can be any naturally occurring amino acid
  misc_feature (24)..(31): Xaa can be any naturally occurring amino acid
  misc_feature (41)..(41): Xaa can be any naturally occurring amino acid
  misc_feature (43)..(51): Xaa can be any naturally occurring amino acid
  misc_feature (54)..(64): Xaa can be any naturally occurring amino acid
XRLRPRCWIKFIIXXXXXXXKSVXXXXXXXXSLNRVSPGGXYXXXXXXXXXKGXXXXXXXXXXXY

SEQ ID NO: 30167 - protein, 68 aa, Diabrotica virgifera
  misc_feature: Coding regions on vcDNA: vcDNA=SeqID_9864; Strand=-; Position=184-390
  misc_feature (5)..(13): Xaa can be any naturally occurring amino acid
  misc_feature (15)..(25): Xaa can be any naturally occurring amino acid
  misc_feature (42)..(56): Xaa can be any naturally occurring amino acid
NLIFXXXXXXXXXLXXXXXXXXXXXIVNKYHLSIQQLDIYKXXXXXXXXXXXXXXXFSIEILISSFLN

SEQ ID NO: 30168 - protein, 64 aa, Diabrotica virgifera
  misc_feature: Coding regions on vcDNA: vcDNA=SeqID_9865; Strand=-; Position=297-491
  misc_feature (13)..(19): Xaa can be any naturally occurring amino acid
  misc_feature (27)..(33): Xaa can be any naturally occurring amino acid
LSTIILIPSNNSXXXXXXXGRYGGYSXXXXXXXDLWELRPFSQQHFLKSTPHHTPDAQKDKIKY

SEQ ID NO: 30169 - protein, 231 aa, Diabrotica virgifera
  misc_feature: Coding regions on vcDNA: vcDNA=SeqID_9866; Strand=+; Position=2-694
  misc_feature (10)..(16): Xaa can be any naturally occurring amino acid
  misc_feature (20)..(30): Xaa can be any naturally occurring amino acid
  misc_feature (35)..(46): Xaa can be any naturally occurring amino acid
  misc_feature (48)..(58): Xaa can be any naturally occurring amino acid
  misc_feature (62)..(126): Xaa can be any naturally occurring amino acid
  misc_feature (132)..(213): Xaa can be any naturally occurring amino acid
  misc_feature (215)..(225): Xaa can be any naturally occurring amino acid
RIVRETLSPXXXXXXXFRTXXXXXXXXXXXILTTXXXXXXXXXXXXFXXXXXXXXXXXNETXXXXXXXXXXXXXXXXXXXXXXXXXXXXXXXXXXXXXXXXXXXXXXXXXXXXXXXXXXXXXXXXXLLIHFXXXXXXXXXXXXXXXXXXXXXXXXXXXXXXXXXXXXXXXXXXXXXXXXXXXXXXXXXXXXXXXXXXXXXXXXXXXXXXXXXXAXXXXXXXXXXXGMEGWM

SEQ ID NO: 30170 - protein, 88 aa, Diabrotica virgifera
  misc_feature: Coding regions on vcDNA: vcDNA=SeqID_9867; Strand=-; Position=635-901
  misc_feature (25)..(25): Xaa can be any naturally occurring amino acid
  misc_feature (70)..(79): Xaa can be any naturally occurring amino acid
RHLPLLRHLLRLLENLRPFISPSKXNYYKYNRSKDTRGRGNFWLALYRAPFPGQISREISKKMEIQISRXXXXXXXXXXAEILVTHNY

SEQ ID NO: 30171 - protein, 70 aa, Diabrotica virgifera
  misc_feature: Coding regions on vcDNA: vcDNA=SeqID_9868; Strand=+; Position=612-824
  misc_feature (14)..(25): Xaa can be any naturally occurring amino acid
  misc_feature (45)..(52): Xaa can be any naturally occurring amino acid
  misc_feature (55)..(62): Xaa can be any naturally occurring amino acid
VYANFKQPTNFCFXXXXXXXXXXXXARPTFLYSLRFFVSLILFKXXXXXXXXFFXXXXXXXXYKTKFSQK

SEQ ID NO: 30172 - protein, 92 aa, Diabrotica virgifera
  misc_feature: Coding regions on vcDNA: vcDNA=SeqID_9869; Strand=+; Position=257-535
  misc_feature (42)..(49): Xaa can be any naturally occurring amino acid
VAHAMFQTYNIHIRSFVAGVLCAPLIFTGFSGFLFLYQEFFXXXXXXXXYEVECNFSRLHVKLYKWSPLSHYLPNDLVSIECTLGYFLFEID

SEQ ID NO: 30173 - protein, 144 aa, Diabrotica virgifera
  misc_feature: Coding regions on vcDNA: vcDNA=SeqID_9870; Strand=+; Position=57-491
  misc_feature: Homolog annotation: Hit_ID=NP_723959.1; Match level="QueryCoverage =99%, HitCoverage=99%, E-value=2e-62, Identity=76%"; Hit description =CG5855-PA, isoform A [Drosophila melanogaster] ref|NP_477068.1| CG5855-PB, isoform B [Drosophila
  misc_feature: Gene Ontology Annotation: Molecular function=molecular_function unknown; Cellular component=endoplasmic reticulum membrane; Biological process=signal transduction
  misc_feature: Pfam annotation: Pfam_ID=Cornichon; Match level="Score=262.1, E-value= 9.7e-76, Copies=1"; Pfam description=Cornichon protein
MAFNFPAFSYIIALIVDAFLIFFSLFHVIAFDELKTDYKNPIDQCNSLNPLVLPEYLLHLLFNILFAASGEWFSLCLNIPLIAYHINRYRTRPVMSGYGIYDPTSIMNADVLTRCQREGWVKLAFYLLSFFYYLYGMIYVLISN

SEQ ID NO: 30174 - protein, 50 aa, Diabrotica virgifera
  misc_feature: Coding regions on vcDNA: vcDNA=SeqID_9871; Strand=+; Position=116-268
  misc_feature: Homolog annotation: Hit_ID=EAL39212.1; Match level="QueryCoverage =94%, HitCoverage=24%, E-value=9e-10, Identity=59%"; Hit description =ENSANGP00000028376 [Anopheles gambiae str. PEST] ref|XP_553696.1| ENSANGP00000028376 [Anopheles gambiae st
  misc_feature: Pfam annotation: Pfam_ID=Ank; Match level="Score=22.8, E-value=0.001, Copies=1"; Pfam description=Ankyrin repeat
MCNTALMYAAKGNHPHTCQELLLNGINFSLENLNGDNAHTIAVENNSTLG

SEQ ID NO: 30175 - protein, 215 aa, Diabrotica virgifera
  misc_feature: Coding regions on vcDNA: vcDNA=SeqID_9872; Strand=+; Position=2-649
  misc_feature: Homolog annotation: Hit_ID=XP_312449.1; Match level="QueryCoverage =98%, HitCoverage=15%, E-value=8e-72, Identity=58%"; Hit description =ENSANGP00000021890 [Anopheles gambiae]
  misc_feature: Gene Ontology Annotation: Molecular function=electron transporter activity; Cellular component=nuclear chromosome; Biological process =electron transport
  misc_feature: Pfam annotation: Pfam_ID=SNF2_N; Match level="Score=68.9, E-value =1.4e-17, Copies=1"; Pfam description=SNF2 family N-terminal domain
SLERIKNSTGSGCILAHCMGLGKTLQVISLTHTLLNHSKKTKVDKVMVVAPINTVLNWKAEYKKWMPSNSAVEVYELATSKKNYERAYTIETWHQDGGVLIIGYNLFRLLSNPANKKLSKKMREKFQEGLVDPGPDLVICDEGHLLKNEKTNLSIAMNRIKTSKRIVLTGTPLQNNLKEYWCMVQFIKPNLMGTYKEYMNRFAHPYHKRDYMYYT

SEQ ID NO: 30176 - protein, 144 aa, Diabrotica virgifera
  misc_feature: Coding regions on vcDNA: vcDNA=SeqID_9873; Strand=+; Position=2-436
  misc_feature: Homolog annotation: Hit_ID=XP_225379.2; Match level="QueryCoverage =75%, HitCoverage=12%, E-value=1e-09, Identity=32%"; Hit description =similar to zinc finger protein 184 (Kruppel-like) [Rattus norvegicus]
  misc_feature: Pfam annotation: Pfam_ID=zf-C2H2; Match level="Score=47.1, E-value=5e- 11, Copies=3"; Pfam description=Zinc finger, C2H2 type
DEVIPLDSNTNLYTPRTNNRSCPICTKEYSSYKNMMRHYKTHRPEEIEEHRQQQQFDYDSQDMQDMDLEDEESMYSCPDCGGMFKSLEWKIHLTEQHQQKPCGECGKFFQFQTELDQHRTTHLNLKGLENTIIHEYYDKSWRRR

SEQ ID NO: 30177 - protein, 144 aa, Diabrotica virgifera
  misc_feature: Coding regions on vcDNA: vcDNA=SeqID_9874; Strand=+; Position=132-563
ICELMNFNIMYLYKVVILAAILVAVSCQSYRAGIVIYKPVSILGPADTNLKINANISARLIKSYKDQADIFVLPEYGLTNIPPKSLTSVYQYSTTINEVGYDVCGSKEKEDIQLRDLACAAKDSNAYVIANLFESIRDNANYLT

SEQ ID NO: 30178 - protein, 135 aa, Diabrotica virgifera
  misc_feature: Coding regions on vcDNA: vcDNA=SeqID_9875; Strand=+; Position=290-697
  misc_feature (74)..(81): Xaa can be any naturally occurring amino acid
ISTFTSNSSNIIVVTIVLLRLIFVNLTVSKSLFKFNAQGRYIVLKGVLVRYGQNRWPIFKLTFNSSLNRWQHVXXXXXXXXFSERHRIDAMYCNLGSAHLDLNRTLYLQTTVVNPFFTCLGKFSLIDTKRSFIWI

SEQ ID NO: 30179 - protein, 26 aa, Diabrotica virgifera
  misc_feature: Coding regions on vcDNA: vcDNA=SeqID_9876; Strand=-; Position=2-79
MKSFCACARRDIVIILTMNRAEGGGG

SEQ ID NO: 30180 - protein, 39 aa, Diabrotica virgifera
  misc_feature: Coding regions on vcDNA: vcDNA=SeqID_9877; Strand=-; Position=1-117
  misc_feature (1)..(14): Xaa can be any naturally occurring amino acid
  misc_feature (16)..(28): Xaa can be any naturally occurring amino acid
  misc_feature (33)..(33): Xaa can be any naturally occurring amino acid
  misc_feature (37)..(37): Xaa can be any naturally occurring amino acid
XXXXXXXXXXXXXXHXXXXXXXXXXXXXILKNXINNXIN

SEQ ID NO: 30181 - protein, 157 aa, Diabrotica virgifera
  misc_feature: Coding regions on vcDNA: vcDNA=SeqID_9878; Strand=+; Position=2-475
CKTTKIPRPYPDFSNPERCSPRDSPHPEIRTEAHFSSATFYLRRCHHFSISFYCVRRRSFHYYGLKRFFGYLMAGSLFYQHHTLACTFSQYTTNATKVQYYPTPACIFLDRPGSLLVGTAYKPMDWWPYPATRRHVLYSGYRIILCIDVEIIFKDFY

SEQ ID NO: 30182 - protein, 40 aa, Diabrotica virgifera
  misc_feature: Coding regions on vcDNA: vcDNA=SeqID_9879; Strand=-; Position=23-145
  misc_feature (14)..(20): Xaa can be any naturally occurring amino acid
  misc_feature (23)..(33): Xaa can be any naturally occurring amino acid
GLRMGEEPLRIINXXXXXXXLIXXXXXXXXXXXDNVIQQG

SEQ ID NO: 30183 - protein, 257 aa, Diabrotica virgifera
  misc_feature: Coding regions on vcDNA: vcDNA=SeqID_9880; Strand=-; Position=1-771
  misc_feature (1)..(13): Xaa can be any naturally occurring amino acid
  misc_feature (15)..(240): Xaa can be any naturally occurring amino acid
  misc_feature (242)..(257): Xaa can be any naturally occurring amino acid
XXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXX

SEQ ID NO: 30184 - protein, 37 aa, Diabrotica virgifera
  misc_feature: Coding regions on vcDNA: vcDNA=SeqID_9881; Strand=-; Position=3-113
  misc_feature (18)..(37): Xaa can be any naturally occurring amino acid
SNKISNDYVALARSKFRXXXXXXXXXXXXXXXXXXXX

SEQ ID NO: 30185 - protein, 68 aa, Diabrotica virgifera
  misc_feature: Coding regions on vcDNA: vcDNA=SeqID_9882; Strand=-; Position=132-338
LVCDKATSLFTKPIPVDYLLILKLKRAFQNQLKKKPMDSKITKLVFSTIETMSEMYIHQKGSLLKGIM

SEQ ID NO: 30186 - protein, 208 aa, Diabrotica virgifera
  misc_feature: Coding regions on vcDNA: vcDNA=SeqID_9883; Strand=-; Position=2-625
  misc_feature (1)..(13): Xaa can be any naturally occurring amino acid
  misc_feature (16)..(26): Xaa can be any naturally occurring amino acid
  misc_feature (36)..(43): Xaa can be any naturally occurring amino acid
  misc_feature (46)..(59): Xaa can be any naturally occurring amino acid
  misc_feature (65)..(78): Xaa can be any naturally occurring amino acid
  misc_feature (80)..(208): Xaa can be any naturally occurring amino acid
XXXXXXXXXXXXXPFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30187 - protein, 68 aa, Diabrotica virgifera
  misc_feature: Coding regions on vcDNA: vcDNA=SeqID_9884; Strand=-; Position=34-240
  misc_feature (15)..(29): Xaa can be any naturally occurring amino acid
NSFTIYYCWKGNNLXXXXXXXXXXXXXXXDLICNCAMASTNNVLCFNIGVTSDKTVSFKEAKLKLQGS

SEQ ID NO: 30188 - protein, 333 aa, Diabrotica virgifera
  misc_feature: Coding regions on vcDNA: vcDNA=SeqID_9885; Strand=+; Position=2-1000
  misc_feature (2)..(256): Xaa can be any naturally occurring amino acid
  misc_feature (258)..(271): Xaa can be any naturally occurring amino acid
  misc_feature (282)..(290): Xaa can be any naturally occurring amino acid
  misc_feature (292)..(299): Xaa can be any naturally occurring amino acid
  misc_feature (301)..(301): Xaa can be any naturally occurring amino acid
  misc_feature (314)..(316): Xaa can be any naturally occurring amino acid
  misc_feature (323)..(331): Xaa can be any naturally occurring amino acid
MXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXRPRCWIKFIIXXXXXXXXXVXXXXXXXXSXNRCEPGWVLSLIXXXYLVRKDXXXXXXXXXLI

SEQ ID NO: 30189 - protein, 66 aa, Diabrotica virgifera; identical to SEQ ID NO: 26808
  misc_feature: Coding regions on vcDNA: vcDNA=SeqID_9886; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 30190 - protein, 88 aa, Diabrotica virgifera
  misc_feature: Coding regions on vcDNA: vcDNA=SeqID_9887; Strand=+; Position=1-267
  misc_feature (2)..(14): Xaa can be any naturally occurring amino acid
  misc_feature (27)..(34): Xaa can be any naturally occurring amino acid
  misc_feature (37)..(44): Xaa can be any naturally occurring amino acid
  misc_feature (54)..(65): Xaa can be any naturally occurring amino acid
  misc_feature (67)..(81): Xaa can be any naturally occurring amino acid
TXXXXXXXXXXXXXCDLDAWIKVYNSXXXXXXXXCSXXXXXXXXSLNRCEPGWXXXXXXXXXXXXKXXXXXXXXXXXXXXXEDKKTKR

SEQ ID NO: 30191 - protein, 20 aa, Diabrotica virgifera
  misc_feature: Coding regions on vcDNA: vcDNA=SeqID_9888; Strand=-; Position=4-66
SNNVNHHLLTLNNINLYYYL

SEQ ID NO: 30192 - protein, 204 aa, Diabrotica virgifera
  misc_feature: Coding regions on vcDNA: vcDNA=SeqID_9889; Strand=+; Position=3-617
  misc_feature: Homolog annotation: Hit_ID=BAD86655.1; Match level="QueryCoverage =95%, HitCoverage=13%, E-value=2e-45, Identity=43%"; Hit description =reverse transcriptase [Bombyx mori]
  misc_feature: Pfam annotation: Pfam_ID=rve; Match level="Score=138.3, E-value=1.8e -38, Copies=1"; Pfam description=Integrase core domain
PGLDGDIELFVKSCEACLKNTTTPRKAPLIKFQEGAHVFDRIHIDFLGPYHGKNYLVITDAYSKWPEVYEMSKTDSEHTIGKLRDCFARFGLPNQIISDNGPQFNSEEFQRFCKNNGIIHKTSAPYHPATNGAAENSVKTLKYAINKMLTGSPSKSISELISKYLFSYRTTPHSVTFQTPAYLMFGRKIKTRFDFLTFNDDIES

SEQ ID NO: 30193 - protein, 71 aa, Diabrotica virgifera
  misc_feature: Coding regions on vcDNA: vcDNA=SeqID_9890; Strand=+; Position=2-214
  misc_feature (7)..(15): Xaa can be any naturally occurring amino acid
  misc_feature (27)..(39): Xaa can be any naturally occurring amino acid
  misc_feature (42)..(49): Xaa can be any naturally occurring amino acid
  misc_feature (59)..(70): Xaa can be any naturally occurring amino acid
NYLRDNXXXXXXXXXLIIKIATSMLDXXXXXXXXXXXXXCSXXXXXXXXSLNRCEPGWXXXXXXXXXXXXK

SEQ ID NO: 30194 - protein, 78 aa, Diabrotica virgifera
  misc_feature: Coding regions on vcDNA: vcDNA=SeqID_9891; Strand=-; Position=217-453
TNKLLITNYLTGFQTGTVEKMESTYQKTNQKPSPKVPKGAILLGVRGMILRGGGVTISNCLDLSANLFQLLDNRCLSV

SEQ ID NO: 30195 - protein, 263 aa, Diabrotica virgifera
  misc_feature: Coding regions on vcDNA: vcDNA=SeqID_9892; Strand=+; Position=1-789
  misc_feature (1)..(15): Xaa can be any naturally occurring amino acid
  misc_feature (18)..(55): Xaa can be any naturally occurring amino acid
  misc_feature (58)..(260): Xaa can be any naturally occurring amino acid
  misc_feature (262)..(262): Xaa can be any naturally occurring amino acid
XXXXXXXXXXXXXXXYLXXXXXXXXXXXXXXXXXXXXXXXXXXXXXXXXXXXXXXEIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXN

SEQ ID NO: 30196 - protein, 145 aa, Diabrotica virgifera
  misc_feature: Coding regions on vcDNA: vcDNA=SeqID_9893; Strand=+; Position=3-440
  misc_feature: Homolog annotation: Hit_ID=XP_395406.1; Match level="QueryCoverage =99%, HitCoverage=22%, E-value=3e-60, Identity=81%"; Hit description =similar to pantothenate kinase 1 isoform gamma; pantothenic acid kinase [Apis mellifera]
  misc_feature: Gene Ontology Annotation: Molecular function=molecular_function unknown; Cellular component=plasma membrane; Biological process =membrane organization and biogenesis
  misc_feature: Pfam annotation: Pfam_ID=Fumble; Match level="Score=24.8, E-value =1.4e-15, Copies=1"; Pfam description=Fumble
AIGLAAEGDNRNVDKLVRDIYGGDYARFGLPGDLVASSFSALCSFGQMNSRERRSNVTKQDLARATLVTITNNIGSIARMCAIQEKIERVVFIGNFLRVNPIAMKLLAYAMDYWSDGTMKALFLEHEGYFGAVGCLLQFHEELKS

SEQ ID NO: 30197 - protein, 79 aa, Diabrotica virgifera
  misc_feature: Coding regions on vcDNA: vcDNA=SeqID_9894; Strand=-; Position=2-238
  misc_feature (1)..(13): Xaa can be any naturally occurring amino acid
  misc_feature (15)..(79): Xaa can be any naturally occurring amino acid
XXXXXXXXXXXXXKXXXXXXXXXXXXXXXXXXXXXXXXXXXXXXXXXXXXXXXXXXXXXXXXXXXXXXXXXXXXXXXXX

SEQ ID NO: 30198 - protein, 260 aa, Diabrotica virgifera
  misc_feature: Coding regions on vcDNA: vcDNA=SeqID_9895; Strand=+; Position=122-900
  misc_feature: Homolog annotation: Hit_ID=XP_395449.1; Match level="QueryCoverage =97%, HitCoverage=49%, E-value=6e-65, Identity=44%"; Hit description =similar to ENSANGP00000014036 [Apis mellifera]
  misc_feature (99)..(99): Xaa can be any naturally occurring amino acid
  misc_feature (230)..(230): Xaa can be any naturally occurring amino acid
MATTNEQRLSHPPGGDITIEEEKESEICKFYKDKTVLITGATGYLGKLVMEKLLRSCDVKKIFIIIREKKGKDPQKRFDEIFDEPCFEPIKRKNPTFKXKIQVLIGDAQFPNFGLSDEDIETLKAECQVVFHYAATVRFDEKIRTATYINIRAVRDLINITKEMKHLKAFLHCSTAYFNCIHPVIEEKFYDPPIDPETLINLVDTLDENTLQAITPGLLGKYPNTYTFTXCIAEAIVRKEANNIPAALFRPSIVIATARN

SEQ ID NO: 30199 - protein, 184 aa, Diabrotica virgifera
  misc_feature: Coding regions on vcDNA: vcDNA=SeqID_9896; Strand=+; Position=3-557
  misc_feature (8)..(20): Xaa can be any naturally occurring amino acid
  misc_feature (27)..(59): Xaa can be any naturally occurring amino acid
  misc_feature (63)..(99): Xaa can be any naturally occurring amino acid
  misc_feature (102)..(154): Xaa can be any naturally occurring amino acid
  misc_feature (165)..(171): Xaa can be any naturally occurring amino acid
KVIKNGEXXXXXXXXXXXXXDPGESGXXXXXXXXXXXXXXXXXXXXXXXXXXXXXXXXXNGKXXXXXXXXXXXXXXXXXXXXXXXXXXXXXXXXXXXXXKEXXXXXXXXXXXXXXXXXXXXXXXXXXXXXXXXXXXXXXXXXXXXXXXXXXXXXMVDIIRIKNWXXXXXXXGLLREFGTFFFPG

SEQ ID NO: 30200 - protein, 78 aa, Diabrotica virgifera; identical to SEQ ID NO: 29528
  misc_feature: Coding regions on vcDNA: vcDNA=SeqID_9897; Strand=-; Position=2-235
  misc_feature (1)..(12): Xaa can be any naturally occurring amino acid
  misc_feature (15)..(25): Xaa can be any naturally occurring amino acid
  misc_feature (35)..(42): Xaa can be any naturally occurring amino acid
  misc_feature (45)..(58): Xaa can be any naturally occurring amino acid
  misc_feature (64)..(77): Xaa can be any naturally occurring amino acid

SEQ ID NO: 30201 - protein, 93 aa, Diabrotica virgifera
  misc_feature: Coding regions on vcDNA: vcDNA=SeqID_9898; Strand=-; Position=74-355
GSWLINKNAGGCGVILHFGCIGGVLPNPCRRRGMVVIEKAFRHQISKKSFQAIIMKSLSSNAIKTYTEMMTSREVKCCGSIIIFRSDIRVRDI

SEQ ID NO: 30202 - protein, 27 aa, Diabrotica virgifera
  misc_feature: Coding regions on vcDNA: vcDNA=SeqID_9899; Strand=-; Position=2-82
  misc_feature (3)..(13): Xaa can be any naturally occurring amino acid
PFXXXXXXXXXXXTNLAHTGLNSDHVK

SEQ ID NO: 30203 - protein, 192 aa, Diabrotica virgifera
  misc_feature: Coding regions on vcDNA: vcDNA=SeqID_9900; Strand=+; Position=265-840
  misc_feature (15)..(130): Xaa can be any naturally occurring amino acid
  misc_feature (132)..(147): Xaa can be any naturally occurring amino acid
  misc_feature (151)..(192): Xaa can be any naturally occurring amino acid
IIFSNRNVISFLNHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTXXXXXXXXXXXXXXXXPPIXXXXXXXXXXXXXXXXXXXXXXXXXXXXXXXXXXXXXXXXXX

SEQ ID NO: 30204 - protein, 103 aa, Diabrotica virgifera
  misc_feature: Coding regions on vcDNA: vcDNA=SeqID_9901; Strand=+; Position=202-513
  misc_feature (13)..(19): Xaa can be any naturally occurring amino acid
  misc_feature (92)..(98): Xaa can be any naturally occurring amino acid
LRNHTFYCRLHIXXXXXXXNCYSSFYISNYSRHKLTLFITYILIPYIFLSYYHSIFCGMSFNTKSSQNLILRYYSSALHLSYFTICYYSFLXXXXXXXLSIFH

SEQ ID NO: 30205 - protein, 230 aa, Diabrotica virgifera
  misc_feature: Coding regions on vcDNA: vcDNA=SeqID_9902; Strand=-; Position=2-691
  misc_feature (17)..(22): Xaa can be any naturally occurring amino acid
  misc_feature (48)..(71): Xaa can be any naturally occurring amino acid
  misc_feature (77)..(110): Xaa can be any naturally occurring amino acid
  misc_feature (114)..(130): Xaa can be any naturally occurring amino acid
  misc_feature (133)..(166): Xaa can be any naturally occurring amino acid
  misc_feature (171)..(205): Xaa can be any naturally occurring amino acid
  misc_feature (211)..(226): Xaa can be any naturally occurring amino acid
SNPSFQLSIKKLMVMLXXXXXXSAALPIYQWAGGALYLIPKGLFLINXXXXXXXXXXXXXXXXXXXXXXXXLYYPPXXXXXXXXXXXXXXXXXXXXXXXXXXXXXXXXXXNFLXXXXXXXXXXXXXXXXXPPXXXXXXXXXXXXXXXXXXXXXXXXXXXXXXXXXXGLPFXXXXXXXXXXXXXXXXXXXXXXXXXXXXXXXXXXXLIPQVXXXXXXXXXXXXXXXXLIYY

SEQ ID NO: 30206 - protein, 31 aa, Diabrotica virgifera
  misc_feature: Coding regions on vcDNA: vcDNA=SeqID_9903; Strand=+; Position=1-93
  misc_feature (5)..(30): Xaa can be any naturally occurring amino acid
LDEKXXXXXXXXXXXXXXXXXXXXXXXXXXA

SEQ ID NO: 30207 - protein, 111 aa, Diabrotica virgifera
  misc_feature: Coding regions on vcDNA: vcDNA=SeqID_9904; Strand=-; Position=2-334
  misc_feature (13)..(20): Xaa can be any naturally occurring amino acid
  misc_feature (22)..(46): Xaa can be any naturally occurring amino acid
  misc_feature (53)..(70): Xaa can be any naturally occurring amino acid
  misc_feature (75)..(92): Xaa can be any naturally occurring amino acid
  misc_feature (95)..(111): Xaa can be any naturally occurring amino acid
IDTQTSSKPNPSXXXXXXXXLXXXXXXXXXXXXXXXXXXXXXXXXXPLIYSSXXXXXXXXXXXXXXXXXXDIQSXXXXXXXXXXXXXXXXXXITXXXXXXXXXXXXXXXXX

SEQ ID NO: 30208 - protein, 44 aa, Diabrotica virgifera
  misc_feature: Coding regions on vcDNA: vcDNA=SeqID_9905; Strand=+; Position=3-137
KEVSASVSSRSSLKYIYIWIMNIILNTRYLRYCTKNEDRMHRQA

SEQ ID NO: 30209 - protein, 195 aa, Diabrotica virgifera
  misc_feature: Coding regions on vcDNA: vcDNA=SeqID_9906; Strand=+; Position=312-896
  misc_feature: Homolog annotation: Hit_ID=AAK61382.1; Match level="QueryCoverage =93%, HitCoverage=88%, E-value=2e-18, Identity=33%"; Hit description =basic proline-rich protein [Sus scrofa]
  misc_feature: Gene Ontology Annotation: Molecular function=actin binding; Cellular component=extracellular space; Biological process=regulation of protein activity, epigenetic
  misc_feature (58)..(58): Xaa can be any naturally occurring amino acid
  misc_feature (71)..(86): Xaa can be any naturally occurring amino acid
  misc_feature (127)..(137): Xaa can be any naturally occurring amino acid
  misc_feature (146)..(156): Xaa can be any naturally occurring amino acid
  misc_feature (186)..(186): Xaa can be any naturally occurring amino acid
PQHALSLLTIGTPHLPSYRGPPIPHGRPRPTPPAPGPVGAGPSVSPSGPLNPISLRPXSSAPPPGPPPPAXXXXXXXXXXXXXXXXADPTKTPPRRTPPPNISPPPHGHREQHPLTPPPTHPPPFEXXXXXXXXXXXTPQNPRPRXXXXXXXXXXXSPHPGPRGAPARARPGRGGGPSPPPTRPPXPPTRRPPPP

SEQ ID NO: 30210 - protein, 86 aa, Diabrotica virgifera
  misc_feature: Coding regions on vcDNA: vcDNA=SeqID_9907; Strand=-; Position=2-259
  misc_feature (3)..(19): Xaa can be any naturally occurring amino acid
SMXXXXXXXXXXXXXXXXXIQLINLNKKDNPKNIGTHLRQWYVENKVQPLVVSILKPPANIQRWRWAGHLIRTDKGWATHIRNGLV

SEQ ID NO: 30211 - protein, 276 aa, Diabrotica virgifera
  misc_feature: Coding regions on vcDNA: vcDNA=SeqID_9908; Strand=+; Position=3-833
  misc_feature (1)..(255): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNSVILFGRVKSIIKIATSMLD

SEQ ID NO: 30212 - protein, 250 aa, Diabrotica virgifera
  misc_feature: Coding regions on vcDNA: vcDNA=SeqID_9909; Strand=+; Position=148-897
  misc_feature: Homolog annotation: Hit_ID=NP_732949.1; Match level="QueryCoverage =78%, HitCoverage=44%, E-value=1e-43, Identity=45%"; Hit description =CG5991-PC, isoform C [Drosophila melanogaster] ref|NP_732948.1| CG5991-PB, isoform B [Drosophila
  misc_feature: Gene Ontology Annotation: Molecular function=phosphatidylserine decarboxylase activity; Cellular component=mitochondrial inner membrane; Biological process=lipid metabolism
  misc_feature (159)..(159): Xaa can be any naturally occurring amino acid
  misc_feature (209)..(209): Xaa can be any naturally occurring amino acid
  misc_feature (216)..(216): Xaa can be any naturally occurring amino acid
  misc_feature (219)..(219): Xaa can be any naturally occurring amino acid
  misc_feature (221)..(221): Xaa can be any naturally occurring amino acid
  misc_feature (242)..(242): Xaa can be any naturally occurring amino acid
MSILIQKSRMFYRLIPLRSFMLVPQKTTTLSSRFFLTSAVNRNVSTKQKSSRGSEWQMIITRFLPVGICLVAVMQWRALRKRQKEGIASKWEINCYCLLPLRTVSRCWGYIADVTLPEVLRPPVYKMYSNAFGVNIAEAENEDLTSYPSLADFFARSLXSGVRQVDESSCLVSPCDGTVLHFGTVDTEQVEQVKGVTYSLKDFFGENTXKSSKYNXDFXTXLLHKPHEGNVLYHMRIYLAPXDYHRFHSH

SEQ ID NO: 30213 - protein, 131 aa, Diabrotica virgifera
  misc_feature: Coding regions on vcDNA: vcDNA=SeqID_9910; Strand=+; Position=2-397
LFLINEMSVCLFSSPSFSLPVLFLSSSLLVFCYSLPSLFSLLSSLSFPLLLITLVLDPIYSFSSTSRLQLFSPRISSLSPPLLSSAFIVFFFVPFFFPRDGSCCSVQWVSAPLPLQGYFPLGLAISLRHRL

SEQ ID NO: 30214 - protein, 307 aa, Diabrotica virgifera
  misc_feature: Coding regions on vcDNA: vcDNA=SeqID_9911; Strand=-; Position=2-922
  misc_feature (7)..(7): Xaa can be any naturally occurring amino acid
  misc_feature (34)..(307): Xaa can be any naturally occurring amino acid
YTAHQLXTLSSDRGRNLIYRFELCNKITLLSVRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30215 - protein, 25 aa, Diabrotica virgifera
  misc_feature: Coding regions on vcDNA: vcDNA=SeqID_9912; Strand=+; Position=2-79
  misc_feature (1)..(14): Xaa can be any naturally occurring amino acid
XXXXXXXXXXXXXXIYYDIVYFILL

SEQ ID NO: 30216 - protein, 118 aa, Diabrotica virgifera
  misc_feature: Coding regions on vcDNA: vcDNA=SeqID_9913; Strand=+; Position=187-543
  misc_feature (14)..(20): Xaa can be any naturally occurring amino acid
  misc_feature (49)..(60): Xaa can be any naturally occurring amino acid
  misc_feature (70)..(83): Xaa can be any naturally occurring amino acid
  misc_feature (89)..(104): Xaa can be any naturally occurring amino acid
IRNILLLISKFKQXXXXXXXWKNKHFKYLLRKETAIPSPNISNFSRTKXXXXXXXXXXXXYLYIITIKHXXXXXXXXXXXXXXLLNKNXXXXXXXXXXXXXXXXHNIHFNLHKFFILI

SEQ ID NO: 30217 - protein, 93 aa, Diabrotica virgifera
  misc_feature: Coding regions on vcDNA: vcDNA=SeqID_9914; Strand=+; Position=287-568
  misc_feature (58)..(64): Xaa can be any naturally occurring amino acid
HSKVKNRSFYNDPDYLLKNVQQLYQYLTSSEVDNGFQELFKLANLFLIMPATIASDEXXXXXXXRINTCLRNTELQDRMWSFSYNTIDARLLK

SEQ ID NO: 30218 - protein, 287 aa, Diabrotica virgifera
  misc_feature: Coding regions on vcDNA: vcDNA=SeqID_9915; Strand=+; Position=108-968
  misc_feature: Homolog annotation: Hit_ID=XP_312265.1; Match level="QueryCoverage =98%, HitCoverage=67%, E-value=6e-60, Identity=46%"; Hit description =ENSANGP00000021041 [Anopheles gambiae]
  misc_feature: Gene Ontology Annotation: Molecular function=bile acid:sodium symporter activity; Cellular component=integral to membrane; Biological process=sodium ion transport
  misc_feature: Pfam annotation: Pfam_ID=SBF; Match level="Score=56.6, E-value=7.2e -14, Copies=1"; Pfam description=Sodium Bile acid symporter family
MCPISGLVQFLIVLVTVLLVCHAVIVKSCKVTFKPNSTKIHMYDSVQVAYNVDKDQGGEYILFSEDDNIASLDKEYLISTIYDNWKGSFNITGNFLGKTRVSCRKKIEGTKTPNSSMDVIVIRKKRFIDKMFTGSVATLISILYINFGCALDWKELKTILKRPIGPAIGLFGHFVIMPLLSYTLGVLLFPTSPEMQLGLFFTGVSPAGGASNVWAVLLEGNISLSITMTAASTIAAFAFMPLWIFTLGRVIFQNANLKVPYVEIMTYVVALVVPLAIGYLIQRYLKK

SEQ ID NO: 30219 - protein, 87 aa, Diabrotica virgifera
  misc_feature: Coding regions on vcDNA: vcDNA=SeqID_9916; Strand=+; Position=3-266
  misc_feature (78)..(85): Xaa can be any naturally occurring amino acid
TISGSDYLFNRNYILFAKFSIFRNFRQIKVLLNKYSHFNHFFEELSYQFYQFIFATTFLFVLLLFNLIQFFIKYVIMXXXXXXXXIK

SEQ ID NO: 30220 - protein, 66 aa, Diabrotica virgifera
  misc_feature: Coding regions on vcDNA: vcDNA=SeqID_9917; Strand=-; Position=468-668
RFSPPILLHLHRFARKPVTSQSIPQETKLTWCHVHFSPGGEYHSFPRVKTIPLKITPQIDRGTNLK

SEQ ID NO: 30221 - protein, 66 aa, Diabrotica virgifera
  misc_feature: Coding regions on vcDNA: vcDNA=SeqID_9918; Strand=+; Position=274-474
RVCNGQILAPPVYYDPVAACLYVSMAAIATVWPASLNEDIDGRIAALLCWDLLFHTESLLCYVSTN

SEQ ID NO: 30222 - protein, 38 aa, Diabrotica virgifera
  misc_feature: Coding regions on vcDNA: vcDNA=SeqID_9919; Strand=-; Position=2-115
QSRPKKLYMSQGIDKSAQSVIDFNISETKEILEKRIKK

SEQ ID NO: 30223 - protein, 100 aa, Diabrotica virgifera
  misc_feature: Coding regions on vcDNA: vcDNA=SeqID_9920; Strand=-; Position=2-301
  misc_feature (2)..(34): Xaa can be any naturally occurring amino acid
  misc_feature (37)..(47): Xaa can be any naturally occurring amino acid
  misc_feature (57)..(64): Xaa can be any naturally occurring amino acid
  misc_feature (67)..(80): Xaa can be any naturally occurring amino acid
  misc_feature (86)..(99): Xaa can be any naturally occurring amino acid
AXXXXXXXXXXXXXXXXXXXXXXXXXXXXXXXXXPFXXXXXXXXXXXTNLAHTGLNXXXXXXXXSNXXXXXXXXXXXXXXPTSRSXXXXXXXXXXXXXXV

SEQ ID NO: 30224 - protein, 154 aa, Diabrotica virgifera
  misc_feature: Coding regions on vcDNA: vcDNA=SeqID_9921; Strand=+; Position=302-763
  misc_feature: Homolog annotation: Hit_ID=NP_036172.1; Match level="QueryCoverage =90%, HitCoverage=18%, E-value=7e-36, Identity=52%"; Hit description =cullin 1 [Mus musculus] gb|AAH29260.1| Cullin 1 [Mus musculus] gb|AAD16038.1| SCF complex
  misc_feature: Gene Ontology Annotation: Molecular function=protein binding; Cellular component=SCF ubiquitin ligase complex; Biological process =apoptosis
  misc_feature (26)..(32): Xaa can be any naturally occurring amino acid
  misc_feature (99)..(99): Xaa can be any naturally occurring amino acid
  misc_feature (103)..(103): Xaa can be any naturally occurring amino acid
MTIYPPIHRKCRCMSSLSINTSVFKXXXXXXXWGDILDGIQQVYDREATHNSRYIQLYTHVYNYCTSVHQQNNGRSSAIANTKGETNQIGGGALLVGIXFIRXLRDFLTNYLVTLLIDGLHRMDEDVLKFYTNQGEDYQFRSKVLDGVCAYLNR

SEQ ID NO: 30225 - protein, 73 aa, Diabrotica virgifera
  misc_feature: Coding regions on vcDNA: vcDNA=SeqID_9922; Strand=-; Position=32-253
  misc_feature (32)..(36): Xaa can be any naturally occurring amino acid
QLTMPFINTRCFQTSATNFKGQLILHEKTMTXXXXXICPQMPCLRGTGCRISSYKLTIQLLLQNWLRHTNETW

SEQ ID NO: 30226 - protein, 308 aa, Diabrotica virgifera
  misc_feature: Coding regions on vcDNA: vcDNA=SeqID_9923; Strand=+; Position=231-1154
  misc_feature: Homolog annotation: Hit_ID=XP_395683.1; Match level="QueryCoverage =62%, HitCoverage=52%, E-value=7e-73, Identity=69%"; Hit description =similar to CG10576-PA [Apis mellifera]
  misc_feature: Gene Ontology Annotation: Biological process=cell cycle
  misc_feature: Pfam annotation: Pfam_ID=Peptidase_M24; Match level="Score=4.8, E -value=9.4e-09, Copies=1"; Pfam description=metallopeptidase family M24
  misc_feature (48)..(48): Xaa can be any naturally occurring amino acid
LQLLLQHLPVIYTSVFKECGLYFLGELQIHGLITQVSHTIVVGTSNHXKVTGRKADVILAAHYASQAALRLLKPGNETYAITEAVQKVAESYKCKPVEGMLSHQLKQFKIDGEKTIIQNPNDAQKKEHEKFELDKHEVYAMDVLISTGEGVGKEADTRVSVYMKTDEIYQLKLKASRMFYTEVRTKYGNMPFHLRNFQMRQSKNGSGEWVKNRLLEPFQVYMKNKENLWHPSNSPFCLWQTGPLKIQGTALGTLNCPNQNIHISTPKLNPSLKVLPPPKVSPPPPTQGKSKRAGLERGSHQEKKVNFF

SEQ ID NO: 30227 - protein, 316 aa, Diabrotica virgifera
  misc_feature: Coding regions on vcDNA: vcDNA=SeqID_9924; Strand=+; Position=2-952
  misc_feature (13)..(21): Xaa can be any naturally occurring amino acid
  misc_feature (23)..(61): Xaa can be any naturally occurring amino acid
  misc_feature (64)..(249): Xaa can be any naturally occurring amino acid
  misc_feature (251)..(282): Xaa can be any naturally occurring amino acid
  misc_feature (284)..(310): Xaa can be any naturally occurring amino acid
IVNSYRERNLFIXXXXXXXXXTXXXXXXXXXXXXXXXXXXXXXXXXXXXXXXXXXXXXXXXETXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXXXXXXXXXXXXXXXXXXXXXXXXXXXXXXXXIXXXXXXXXXXXXXXXXXXXXXXXXXXXDKLTYG

SEQ ID NO: 30228 - protein, 142 aa, Diabrotica virgifera
  misc_feature: Coding regions on vcDNA: vcDNA=SeqID_9925; Strand=-; Position=1-426
  misc_feature (3)..(3): Xaa can be any naturally occurring amino acid
  misc_feature (6)..(142): Xaa can be any naturally occurring amino acid
KKXDQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30229 - protein, 99 aa, Diabrotica virgifera
  misc_feature: Coding regions on vcDNA: vcDNA=SeqID_9926; Strand=+; Position=169-468
YIMYTLTDKINRPPCISLNLQKLSNLDQEDLLLNKLYQGMLGKSAMFKNLEENSDKQDFGNHSLIKKMSINNGCSVSGPYDFFEPIRQSIHDIRLEDTY

SEQ ID NO: 30230 - protein, 262 aa, Diabrotica virgifera
  misc_feature: Coding regions on vcDNA: vcDNA=SeqID_9927; Strand=-; Position=1-786
  misc_feature (5)..(245): Xaa can be any naturally occurring amino acid
  misc_feature (248)..(262): Xaa can be any naturally occurring amino acid
LIIYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 30231 - protein, 100 aa, Diabrotica virgifera
  misc_feature: Coding regions on vcDNA: vcDNA=SeqID_9928; Strand=+; Position=316-618
IDLCIQTGQTNFLSSTMTINFSATINMRISCNKTLNADAQTLREIDTNELLLNYHSTAIRNFNDMSFKIPIIRHGELQSTLPDGYFYPFSYDGKLCLGGI

SEQ ID NO: 30232 - protein, 209 aa, Diabrotica virgifera
  misc_feature: Coding regions on vcDNA: vcDNA=SeqID_9929; Strand=+; Position=132-758
  misc_feature: Homolog annotation: Hit_ID=XP_314676.1; Match level="QueryCoverage =96%, HitCoverage=60%, E-value=1e-47, Identity=48%"; Hit description =ENSANGP00000013086 [Anopheles gambiae]
  misc_feature: Gene Ontology Annotation: Molecular function=ketoreductase activity; Cellular component=integral to membrane; Biological process=fatty acid elongation
  misc_feature: Pfam annotation: Pfam_ID=adh_short; Match level="Score=-73.9, E-value= 0.036, Copies=1"; Pfam description=short chain dehydrogenase
  misc_feature (31)..(37): Xaa can be any naturally occurring amino acid
  misc_feature (85)..(93): Xaa can be any naturally occurring amino acid
  misc_feature (185)..(192): Xaa can be any naturally occurring amino acid
MWDFYTLPLAAIGLIVLISFMLDSIWNILQXXXXXXXPLFISTEETSLAKKFGPWALITGSTDGIGKAYAFELAKRGINIVLVSXXXXXXXXXAEDIEAKYFVKTKIIAADFSQGKKAVDIVKEKVGILPINILVNNVGKQYDYPMYLSEVPEKDLFDMININVGAVTLLCRAFIEDMKQRGRGXXXXXXXXSELQPCPLMAVYAATKA

SEQ ID NO: 30233 - protein, 237 aa, Diabrotica virgifera
  misc_feature: Coding regions on vcDNA: vcDNA=SeqID_9930; Strand=+; Position=97-810
  misc_feature: Homolog annotation: Hit_ID=XP_486434.1; Match level="QueryCoverage =80%, HitCoverage=76%, E-value=3e-14, Identity=30%"; Hit description =similar to hypothetical protein FLJ14345 [Mus musculus]
  misc_feature: Gene Ontology Annotation: Molecular function=ATP binding; Cellular component=nucleus; Biological process=regulation of transcription, DNA-dependent
  misc_feature: Pfam annotation: Pfam_ID=zf-C2H2; Match level="Score=24.0, E-value =0.00046, Copies=2"; Pfam description=Zinc finger, C2H2 type
  misc_feature (123)..(133): Xaa can be any naturally occurring amino acid
  misc_feature (172)..(183): Xaa can be any naturally occurring amino acid
  misc_feature (207)..(214): Xaa can be any naturally occurring amino acid
MEVKQEFNEETCKIETEDNDLDDALLDGFKCEIKEESNIQSTPGTYDYLEEIPTNTEIHQDPNKLNPLEENQTSEKGFTQEENKMKIMETFCEHSSRKQHYTSQSAKGKTGNKNIKVQTRPKXXXXXXXXXXXSKTDQLKHLRTHSGEKPHKCEICFKQFSQAGQLRKHLRXXXXXXXXXXXXCFKQFSETSDLKVHLRVHTGEKPXXXXXXXXQFSLTGILKNILKVTLERKPPKW

SEQ ID NO: 30234 - protein, 66 aa, Diabrotica virgifera
  misc_feature: Coding regions on vcDNA: vcDNA=SeqID_9931; Strand=-; Position=46-246
STLMTSSSIMICNIHSRNLYTYIDWLLNNSTSFGNTYIYLIKNNISIQNVYLYIQCAIKIVSSLHL

SEQ ID NO: 30235 - protein, 53 aa, Diabrotica virgifera
  misc_feature: Coding regions on vcDNA: vcDNA=SeqID_9932; Strand=+; Position=219-378
  misc_feature (31)..(31): Xaa can be any naturally occurring amino acid
TGSLGKLRLYKLLLACNDLYSIIRLLQNDTXQSRPTRREEIFGDDSIDNMRAE

SEQ ID NO: 30236 - protein, 64 aa, Diabrotica virgifera
  misc_feature: Coding regions on vcDNA: vcDNA=SeqID_9933; Strand=+; Position=1-195
IQTISAVPAPNPQWGGGGNGGVGVNVGVGKDSGVNVGVDVGKPGVGVKVGVNPNLFNLGIRVGQ

SEQ ID NO: 30237 - protein, 89 aa, Diabrotica virgifera
  misc_feature: Coding regions on vcDNA: vcDNA=SeqID_9934; Strand=-; Position=430-699
  misc_feature (8)..(14): Xaa can be any naturally occurring amino acid
  misc_feature (41)..(47): Xaa can be any naturally occurring amino acid
  misc_feature (53)..(59): Xaa can be any naturally occurring amino acid
  misc_feature (73)..(81): Xaa can be any naturally occurring amino acid
LLKTSKLXXXXXXXYRDYIKTVGESFSLSFQPAIKDVMSMXXXXXXXLAHTRXXXXXXXDEIFKSNRHVCNNXXXXXXXXXVISHIYLY

SEQ ID NO: 30238 - protein, 50 aa, Diabrotica virgifera
  misc_feature: Coding regions on vcDNA: vcDNA=SeqID_9935; Strand=+; Position=4-156
  misc_feature (4)..(16): Xaa can be any naturally occurring amino acid
  misc_feature (20)..(27): Xaa can be any naturally occurring amino acid
RAVXXXXXXXXXXXXXSFRXXXXXXXXDRNQPGSHRFKLRSCKILKVEQT

SEQ ID NO: 30239 - protein, 81 aa, Diabrotica virgifera
  misc_feature: Coding regions on vcDNA: vcDNA=SeqID_9936; Strand=-; Position=0-242
  misc_feature (2)..(2): Xaa can be any naturally occurring amino acid
  misc_feature (15)..(16): Xaa can be any naturally occurring amino acid
  misc_feature (22)..(23): Xaa can be any naturally occurring amino acid
  misc_feature (33)..(40): Xaa can be any naturally occurring amino acid
  misc_feature (43)..(49): Xaa can be any naturally occurring amino acid
  misc_feature (53)..(53): Xaa can be any naturally occurring amino acid
  misc_feature (58)..(62): Xaa can be any naturally occurring amino acid
  misc_feature (67)..(72): Xaa can be any naturally occurring amino acid
  misc_feature (74)..(74): Xaa can be any naturally occurring amino acid
SXGCFLLLWGVLPFXXLFCPVXXFVFRFSLLVXXXXXXXXEFXXXXXXXCPVXVLLSXXXXXSSSKXXXXXXAXAWAPLKG

SEQ ID NO: 30240 - protein, 200 aa, Diabrotica virgifera
  misc_feature: Coding regions on vcDNA: vcDNA=SeqID_9937; Strand=-; Position=2-601
  misc_feature (15)..(200): Xaa can be any naturally occurring amino acid
KERKNFLNLNVLTIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30241 - protein, 266 aa, Diabrotica virgifera
  misc_feature: Coding regions on vcDNA: vcDNA=SeqID_9938; Strand=+; Position=3-800
FELKDGSAKRIIAFEDSEQTKESVERAQDSDTKNIAIDENAAQVAIVTDDNTVQPIKISEQIAKAVHDETKEPVEYTQDNSTNNIAIEENAAQIAIVTDNDTVQAIKISEQVAKAVHDETKERVEYTQDNTTKDIAIEENAAQIAIVTNNNTVQPIEISEQITKAVHDVFHDERDENDSLTNVGTVEDQEKVTSNLEAQTVKHTEPERNIRDSSSNALNTNISASSVSEHIVAEDDSVGQFAELVENVPDIINIIQEHPRRQHDSY

SEQ ID NO: 30242 - protein, 42 aa, Diabrotica virgifera
  misc_feature: Coding regions on vcDNA: vcDNA=SeqID_9939; Strand=-; Position=1-126
  misc_feature (1)..(42): Xaa can be any naturally occurring amino acid
XXXXXXXXXXXXXXXXXXXXXXXXXXXXXXXXXXXXXXXXXX

SEQ ID NO: 30243 - protein, 34 aa, Diabrotica virgifera
  misc_feature: Coding regions on vcDNA: vcDNA=SeqID_9940; Strand=-; Position=1-102
  misc_feature (24)..(31): Xaa can be any naturally occurring amino acid
YWYSSYEVVLHQRIFLGKGMHRLXXXXXXXXKGG

SEQ ID NO: 30244 - protein, 88 aa, Diabrotica virgifera
  misc_feature: Coding regions on vcDNA: vcDNA=SeqID_9941; Strand=+; Position=509-775
RIIINRILSKKCKYLQDLHELSVLDLTHRYWRTKKSIPLVESYLSTVKYSEVIYKSPIPPYYSAMTKTLFSNKGKTCYFKLTFTAKYC

SEQ ID NO: 30245 - protein, 129 aa, Diabrotica virgifera
  misc_feature: Coding regions on vcDNA: vcDNA=SeqID_9942; Strand=-; Position=679-1068
  misc_feature (11)..(22): Xaa can be any naturally occurring amino acid
  misc_feature (26)..(36): Xaa can be any naturally occurring amino acid
  misc_feature (39)..(68): Xaa can be any naturally occurring amino acid
  misc_feature (72)..(99): Xaa can be any naturally occurring amino acid
PNIKFGVVFPXXXXXXXXXXXXGDRXXXXXXXXXXXKGXXXXXXXXXXXXXXXXXXXXXXXXXXXXXXTIKXXXXXXXXXXXXXXXXXXXXXXXXXXXXSRTSITQNSMTMQYSTAFTWRHEFIYSKKS

SEQ ID NO: 30246 - protein, 68 aa, Diabrotica virgifera
  misc_feature: Coding regions on vcDNA: vcDNA=SeqID_9943; Strand=+; Position=541-747
CILKCLHKLQKQQTFSVPNKNLCLSLLIKCILCYNNILYLCLMFQISNTVFTLGTNIFNNVFCYPIYM

SEQ ID NO: 30247 - protein, 188 aa, Diabrotica virgifera
  misc_feature: Coding regions on vcDNA: vcDNA=SeqID_9944; Strand=+; Position=48-614
  misc_feature: Homolog annotation: Hit_ID=NP_728587.1; Match level="QueryCoverage =67%, HitCoverage=69%, E-value=6e-16, Identity=35%"; Hit description =CG9134-PC, isoform C [Drosophila melanogaster] ref|NP_728586.1| CG9134-PA, isoform A [Drosophila
  misc_feature: Pfam annotation: Pfam_ID=Lectin_C; Match level="Score=25.9, E-value =2.4e-06, Copies=1"; Pfam description=Lectin C-type domain
MVLLTILFKLKMNSAGSINYAITKDTGIARSIVPELWVEKDGNTLYYFGYTFTGSWIQALEHCKALNMDLVSIETSEENEYLYDQMKGFFGGRDQYSFWTSGTTLAYGKWAWMGTGRPILYNNWSAKPSGTKDTFCLEAKYEPNNKGLQWNENKQDASLHAICEAKITEDLVNIIPELCSFKDFLSID

SEQ ID NO: 30248 - protein, 38 aa, Diabrotica virgifera
  misc_feature: Coding regions on vcDNA: vcDNA=SeqID_9945; Strand=+; Position=3-119
RGGAGRECPGGPPPLRYILIVIKKLKESFLGEQIGECY

SEQ ID NO: 30249 - protein, 39 aa, Diabrotica virgifera
  misc_feature: Coding regions on vcDNA: vcDNA=SeqID_9946; Strand=-; Position=41-160
  misc_feature (5)..(33): Xaa can be any naturally occurring amino acid
KVLNXXXXXXXXXXXXXXXXXXXXXXXXXXXXXLRVRLP

SEQ ID NO: 30250 - protein, 128 aa, Diabrotica virgifera
  misc_feature: Coding regions on vcDNA: vcDNA=SeqID_9947; Strand=+; Position=1-384
  misc_feature (4)..(63): Xaa can be any naturally occurring amino acid
  misc_feature (68)..(90): Xaa can be any naturally occurring amino acid
  misc_feature (122)..(128): Xaa can be any naturally occurring amino acid
LSPXXXXXXXXXXXXXXXXXXXXXXXXXXXXXXXXXXXXXXXXXXXXXXXXXXXXXXXXXXXXNFNEXXXXXXXXXXXXXXXXXXXXXXXCLNISNCLKNKLKLLISKIFIRIYFYRTNMIXXXXXXX

SEQ ID NO: 30251 - protein, 129 aa, Diabrotica virgifera
  misc_feature: Coding regions on vcDNA: vcDNA=SeqID_9948; Strand=+; Position=276-665
  misc_feature (81)..(94): Xaa can be any naturally occurring amino acid
CFFTTVFSFLVLSFPRYFVSLLVEHIGTYYFSVCGLGMIFSKFHCVEKFILVRFLLIIHHPNFYVLPVYIHNMYIIKLLRXXXXXXXXXXXXXXYVDSYCKLFQTTKPNSHLSLVIYQPKVSIAFYLAS

SEQ ID NO: 30252 - protein, 215 aa, Diabrotica virgifera
  misc_feature: Coding regions on vcDNA: vcDNA=SeqID_9949; Strand=+; Position=1-648
  misc_feature: Homolog annotation: Hit_ID=XP_394575.1; Match level="QueryCoverage =86%, HitCoverage=34%, E-value=9e-40, Identity=47%"; Hit description =similar to A-kinase anchor protein 10 precursor; dual-specificity A -kinase anchoring
  misc_feature: Gene Ontology Annotation: Molecular function=protein kinase A anchoring activity; Cellular component=mitochondrion; Biological process=protein localization
VVLYDKYFSLQATCPLGFSDKVRFAVEQSICGENGLMPDCFHLPLKIVETVLEKNYLKPFLTSQLFYKYLSDLINTVQVNDFANFERYPNAASDCSSERSFSQSTFLAFEIPPSAIKRGDKSADMTIDTRELYDPDSLWKRKKCYRLSLGRVSEIGKYEADFEPEPDRKQFRFKSIFKKVVNNDEEDRKREEMAWQVAEMIVKDITNVTLGQSDK

SEQ ID NO: 30253 - protein, 87 aa, Diabrotica virgifera
  misc_feature: Coding regions on vcDNA: vcDNA=SeqID_9950; Strand=+; Position=722-985
  misc_feature (64)..(79): Xaa can be any naturally occurring amino acid
YNISIMNIYCILYYTEYTPGNKAEKSLESQKITGIFSYLKPFLPWGNIFTKKKSVGLSTFKEIXXXXXXXXXXXXXXXXISYYPSLY

SEQ ID NO: 30254 - protein, 91 aa, Diabrotica virgifera
  misc_feature: Coding regions on vcDNA: vcDNA=SeqID_9951; Strand=+; Position=256-531
  misc_feature (42)..(47): Xaa can be any naturally occurring amino acid
CFVCRFLMAQVAKTESHGSGTTFTHHLIEDLMCFIHEGTEVXXXXXXIVSLLAMYIQQVFTRYFSYNFFLNSLYPEIYTGLTTLGMCFFGN

SEQ ID NO: 30255 - protein, 283 aa, Diabrotica virgifera
  misc_feature: Coding regions on vcDNA: vcDNA=SeqID_9952; Strand=+; Position=49-900
  misc_feature: Homolog annotation: Hit_ID=NP_075386.1; Match level="QueryCoverage =94%, HitCoverage=56%, E-value=5e-45, Identity=37%"; Hit description =UPF3 regulator of nonsense transcripts homolog B isoform 2 [Homo sapiens] gb|AAG48511.1|
  misc_feature: Gene Ontology Annotation: Molecular function=nucleocytoplasmic transporter activity; Cellular component=nucleus; Biological process= mRNA catabolism, nonsense-mediated
  misc_feature: Pfam annotation: Pfam_ID=Smg4_UPF3; Match level="Score=149.2, E-value= 9.3e-42, Copies=1"; Pfam description=Smg-4/UPF3 family
MALSETEKKSDKKEKPLTKVIIRRLPPTIEQETFIKQVSPIPDYSYIYTVNGDFSLGENAFSRVYINFVHHDDVYSFKERFDNYVFLDAKGSEYPCVVEFAPFQKIPKKRGKTRMDPKAGSIESDPYYLDFLENLQKPQEVDEKPEYTLQLTSSSENKNDVTTPLLEYIKSKRAQRMRIREVRREERKRREFDKRREHFDDRDRDSRDKKKISEEKSPTKKSHSKSENPKAEKTEPEASAVEKPEKEERYYKSYQNKDRRYDDRRFEDRRKEPKPRYPRRYPD

SEQ ID NO: 30256 - protein, 64 aa, Diabrotica virgifera
  misc_feature: Coding regions on vcDNA: vcDNA=SeqID_9953; Strand=+; Position=249-443
HTRIIRKKMFPMPPRTSAAYWEKSGNTALHINSPALLSNYFRLAVLLSVGLAAFEDGGRSHSYR

SEQ ID NO: 30257 - protein, 24 aa, Diabrotica virgifera
  misc_feature: Coding regions on vcDNA: vcDNA=SeqID_9954; Strand=-; Position=0-71
  misc_feature (3)..(17): Xaa can be any naturally occurring amino acid
KVXXXXXXXXXXXXXXXEYLINYR

SEQ ID NO: 30258 - protein, 55 aa, Diabrotica virgifera
  misc_feature: Coding regions on vcDNA: vcDNA=SeqID_9955; Strand=-; Position=1-165
  misc_feature (37)..(44): Xaa can be any naturally occurring amino acid
  misc_feature (50)..(55): Xaa can be any naturally occurring amino acid
ANNILLYCFRHIRIANLNKRHYHHLHILKVRSATQSXXXXXXXXEHIFNXXXXXX

SEQ ID NO: 30259 - protein, 306 aa, Diabrotica virgifera
  misc_feature: Coding regions on vcDNA: vcDNA=SeqID_9956; Strand=+; Position=3-918
  misc_feature: Homolog annotation: Hit_ID=XP_314865.1; Match level="QueryCoverage =100%, HitCoverage=42%, E-value=1e-144, Identity=76%"; Hit description=ENSANGP00000005173 [Anopheles gambiae] gb|EAA10107.1| ENSANGP00000005173 [Anopheles gambiae
  misc_feature: Gene Ontology Annotation: Molecular function=carbohydrate binding; Cellular component=integral to endoplasmic reticulum membrane; Biological process=ER-associated protein catabolism
  misc_feature: Pfam annotation: Pfam_ID=Glyco_hydro_47; Match level="Score=186.8, E -value=4.6e-53, Copies=1"; Pfam description=Glycosyl hydrolase family 47
  misc_feature (273)..(273): Xaa can be any naturally occurring amino acid
  misc_feature (294)..(294): Xaa can be any naturally occurring amino acid
PNRGDIDDSLGNFSLTLIDTLDTLAIFGDLEEFEHAVKLVIKDVNFDNDVVVSVFETNIRVVGGLLSAHILSEYLQQRDGIMPWYKGELLNMAKDVGYRLLPAFNTTTGIPHSRVNMKYGLKSDRLESARETCTACAGSMILEMAALSRLTGEPIFEMKAQKAMDELWKMRHRSSDLMGTVLNVHSGDWVRRDSGVGAGIDSYYEYCLKAYILLGDNKYLNRFNRHYNAVMKYISQGPMLLDVHMHRPHTNSRNYMDALLAFWPGLSVLKGDXQPAVETHEMLYQVMQRHKSFXRSFTTDFQVHWG

SEQ ID NO: 30260 - protein, 90 aa, Diabrotica virgifera
  misc_feature: Coding regions on vcDNA: vcDNA=SeqID_9957; Strand=+; Position=162-431
  misc_feature (39)..(83): Xaa can be any naturally occurring amino acid
VFADCLGFERLYTIYCQICIIITFIVMNCCSIIHISNCXXXXXXXXXXXXXXXXXXXXXXXXXXXXXXXXXXXXXXXXXXXXXRLYNFLI

SEQ ID NO: 30261 - protein, 75 aa, Diabrotica virgifera
  misc_feature: Coding regions on vcDNA: vcDNA=SeqID_9958; Strand=-; Position=75-302
  misc_feature (36)..(43): Xaa can be any naturally occurring amino acid
  misc_feature (52)..(58): Xaa can be any naturally occurring amino acid
KKTFEVEVSDRPCEGGFDPKTFRRLPSITAVFFSCXXXXXXXXRNSITFAIXXXXXXXKYHKLFEFSIIHFIMTL

SEQ ID NO: 30262 - protein, 172 aa, Diabrotica virgifera
  misc_feature: Coding regions on vcDNA: vcDNA=SeqID_9959; Strand=-; Position=1-516
  misc_feature (8)..(165): Xaa can be any naturally occurring amino acid
  misc_feature (167)..(167): Xaa can be any naturally occurring amino acid
HWEVLINXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXKKYFI

SEQ ID NO: 30263 - protein, 297 aa, Diabrotica virgifera
  misc_feature: Coding regions on vcDNA: vcDNA=SeqID_9960; Strand=+; Position=1-891
  misc_feature (1)..(263): Xaa can be any naturally occurring amino acid
  misc_feature (265)..(276): Xaa can be any naturally occurring amino acid
  misc_feature (280)..(280): Xaa can be any naturally occurring amino acid
  misc_feature (284)..(293): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXXXXXXXXXXXIIYXIIYXXXXXXXXXXFILL

SEQ ID NO: 30264 - protein, 91 aa, Diabrotica virgifera
  misc_feature: Coding regions on vcDNA: vcDNA=SeqID_9961; Strand=-; Position=150-425
  misc_feature (28)..(34): Xaa can be any naturally occurring amino acid
  misc_feature (67)..(78): Xaa can be any naturally occurring amino acid
LFSSSKFHLIYSCHLLLFLTIRMADGTXXXXXXXVDMYFTILVFWIRSPSSLWELQKSLSPAMTLRXXXXXXXXXXXXSSIQHPNTTPSRP

SEQ ID NO: 30265 - protein, 258 aa, Diabrotica virgifera
  misc_feature: Coding regions on vcDNA: vcDNA=SeqID_9962; Strand=-; Position=1-774
  misc_feature (3)..(16): Xaa can be any naturally occurring amino acid
  misc_feature (19)..(258): Xaa can be any naturally occurring amino acid
LYXXXXXXXXXXXXXXINXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30266 - protein, 132 aa, Diabrotica virgifera
  misc_feature: Coding regions on vcDNA: vcDNA=SeqID_9963; Strand=-; Position=473-871
  misc_feature (15)..(15): Xaa can be any naturally occurring amino acid
  misc_feature (20)..(27): Xaa can be any naturally occurring amino acid
  misc_feature (90)..(97): Xaa can be any naturally occurring amino acid
CSICSKKFVFPSIFXVRFTXXXXXXXXHFFFERPLLFSSHLLRSVLFKHFSKHLAVWARMFAVIIVFPEYILIISLFVGLLQIFFAVSIXXXXXXXXNFLFQYFFFCSCCWFINHLLSLLISFCVMYLFASS

SEQ ID NO: 30267 - protein, 154 aa, Diabrotica virgifera
  misc_feature: Coding regions on vcDNA: vcDNA=SeqID_9964; Strand=+; Position=38-499
  misc_feature: Homolog annotation: Hit_ID=AAP57194.1; Match level="QueryCoverage =70%, HitCoverage=50%, E-value=2e-13, Identity=41%"; Hit description =ferritin [Leptinotarsa decemlineata]
  misc_feature (19)..(19): Xaa can be any naturally occurring amino acid
  misc_feature (21)..(31): Xaa can be any naturally occurring amino acid
  misc_feature (33)..(37): Xaa can be any naturally occurring amino acid
  misc_feature (39)..(39): Xaa can be any naturally occurring amino acid
  misc_feature (41)..(41): Xaa can be any naturally occurring amino acid
  misc_feature (46)..(46): Xaa can be any naturally occurring amino acid
  misc_feature (48)..(50): Xaa can be any naturally occurring amino acid
  misc_feature (53)..(55): Xaa can be any naturally occurring amino acid
  misc_feature (59)..(60): Xaa can be any naturally occurring amino acid
  misc_feature (63)..(63): Xaa can be any naturally occurring amino acid
  misc_feature (65)..(65): Xaa can be any naturally occurring amino acid
  misc_feature (67)..(67): Xaa can be any naturally occurring amino acid
  misc_feature (71)..(71): Xaa can be any naturally occurring amino acid
  misc_feature (73)..(74): Xaa can be any naturally occurring amino acid
  misc_feature (81)..(81): Xaa can be any naturally occurring amino acid
  misc_feature (83)..(85): Xaa can be any naturally occurring amino acid
  misc_feature (89)..(89): Xaa can be any naturally occurring amino acid
  misc_feature (93)..(95): Xaa can be any naturally occurring amino acid
  misc_feature (97)..(101): Xaa can be any naturally occurring amino acid
  misc_feature (108)..(108): Xaa can be any naturally occurring amino acid
  misc_feature (110)..(110): Xaa can be any naturally occurring amino acid
  misc_feature (112)..(118): Xaa can be any naturally occurring amino acid
  misc_feature (122)..(122): Xaa can be any naturally occurring amino acid
  misc_feature (130)..(130): Xaa can be any naturally occurring amino acid
  misc_feature (133)..(133): Xaa can be any naturally occurring amino acid
  misc_feature (135)..(137): Xaa can be any naturally occurring amino acid
QGRRPTNKTPLLGTENNNXKXXXXXXXXXXXAXXXXXQXKXAHQEXNXXXEGXXXHKEXXHKXRXQXEEEXKXXRQNRARXAXXXKDTXNRPXXXDXXXXXASEEREXAXKXXXXXXXRGEXTSNPSELXKRXLXXXSTTWDNGVSALKTSSSA

SEQ ID NO: 30268 - protein, 141 aa, Diabrotica virgifera
  misc_feature: Coding regions on vcDNA: vcDNA=SeqID_9965; Strand=+; Position=143-565
  misc_feature: Homolog annotation: Hit_ID=EAA12926.2; Match level="QueryCoverage =84%, HitCoverage=52%, E-value=4e-14, Identity=31%"; Hit description =ENSANGP00000018103 [Anopheles gambiae str. PEST] ref|XP_554892.1| ENSANGP00000018103 [Anopheles gambiae st
  misc_feature: Gene Ontology Annotation: Biological process=glycolysis
MSAENSSPALSVEKSIGILLDVAGTTTSNTFLKDTLYSYVTKQAETFLKESWEEQEVKDAVKLIKDDLDQEAAIPLIKELTEKNSDNEGLKKVQGLIYKKGYKNGELKAHVFPECVPALEALGPIPVKRYIFHWGAKNPKT

SEQ ID NO: 30269 - protein, 66 aa, Diabrotica virgifera; identical to SEQ ID NO: 26808
  misc_feature: Coding regions on vcDNA: vcDNA=SeqID_9966; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 30270 - protein, 57 aa, Diabrotica virgifera
  misc_feature: Coding regions on vcDNA: vcDNA=SeqID_9967; Strand=+; Position=202-375
  misc_feature (24)..(31): Xaa can be any naturally occurring amino acid
FSNTIYIIKHFYNTNNNRSLSITXXXXXXXXSNFSHHITYQNSLSLKYDIIYFYISY

SEQ ID NO: 30271 - protein, 106 aa, Diabrotica virgifera
  misc_feature: Coding regions on vcDNA: vcDNA=SeqID_9968; Strand=-; Position=0-317
  misc_feature (8)..(102): Xaa can be any naturally occurring amino acid
ILIKLYLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXALKG

SEQ ID NO: 30272 - protein, 184 aa, Diabrotica virgifera
  misc_feature: Coding regions on vcDNA: vcDNA=SeqID_9969; Strand=+; Position=56-610
  misc_feature: Homolog annotation: Hit_ID=XP_311283.1; Match level="QueryCoverage =98%, HitCoverage=87%, E-value=4e-77, Identity=74%"; Hit description =ENSANGP00000017568 [Anopheles gambiae]
  misc_feature: Gene Ontology Annotation: Molecular function=actin binding; Cellular component=intercellular junction; Biological process=cytoskeleton organization and biogenesis
  misc_feature: Pfam annotation: Pfam_ID=CH; Match level="Score=38.2, E-value=2.4e -08, Copies=1"; Pfam description=Calponin homology (CH) domain
  misc_feature (49)..(61): Xaa can be any naturally occurring amino acid
MPGPSRPLWQVAGKRDPEQEREAQAWIEAVTGMRFPPGVPYEDCLRDGXXXXXXXXXXXXXIIQKINTSGGDYKMMDNLNQFQKACVKYGVPDVDLFQTTDLWDRKNIVLVTTTIFALGRTCYKHPEWRGPFLGPRPSEENRRDFSDEQLRAGEAIIGLQAGQNRGATQAGQNFGASRKIILGK

SEQ ID NO: 30273 - protein, 44 aa, Diabrotica virgifera
  misc_feature: Coding regions on vcDNA: vcDNA=SeqID_9970; Strand=-; Position=0-131
  misc_feature (1)..(41): Xaa can be any naturally occurring amino acid
XXXXXXXXXXXXXXXXXXXXXXXXXXXXXXXXXXXXXXXXXDCR

SEQ ID NO: 30274 - protein, 51 aa, Diabrotica virgifera
  misc_feature: Coding regions on vcDNA: vcDNA=SeqID_9971; Strand=+; Position=52-207
  misc_feature (40)..(46): Xaa can be any naturally occurring amino acid
DIDMISMSWLLSISNSNIYIFILKKFYFYYPEHEALVTKXXXXXXXLFSNI

SEQ ID NO: 30275 - protein, 103 aa, Diabrotica virgifera
  misc_feature: Coding regions on vcDNA: vcDNA=SeqID_9972; Strand=-; Position=1-309
  misc_feature (6)..(6): Xaa can be any naturally occurring amino acid
  misc_feature (8)..(21): Xaa can be any naturally occurring amino acid
  misc_feature (23)..(58): Xaa can be any naturally occurring amino acid
  misc_feature (60)..(103): Xaa can be any naturally occurring amino acid
KMDQKXYXXXXXXXXXXXXXXSXXXXXXXXXXXXXXXXXXXXXXXXXXXXXXXXXXXXFXXXXXXXXXXXXXXXXXXXXXXXXXXXXXXXXXXXXXXXXXXXX

SEQ ID NO: 30276 - protein, 29 aa, Diabrotica virgifera
  misc_feature: Coding regions on vcDNA: vcDNA=SeqID_9973; Strand=-; Position=1-87
  misc_feature (1)..(25): Xaa can be any naturally occurring amino acid
XXXXXXXXXXXXXXXXXXXXXXXXXVSRL

SEQ ID NO: 30277 - protein, 87 aa, Diabrotica virgifera
  misc_feature: Coding regions on vcDNA: vcDNA=SeqID_9974; Strand=-; Position=23-286
  misc_feature: Homolog annotation: Hit_ID=CAH04319.1; Match level="QueryCoverage =100%, HitCoverage=45%, E-value=7e-41, Identity=96%"; Hit description= S7e ribosomal protein [Timarcha balearica]
  misc_feature: Gene Ontology Annotation: Molecular function=structural constituent of ribosome; Cellular component=cytosolic ribosome (sensu Eukarya); Biological process=morphogenesis
  misc_feature: Pfam annotation: Pfam_ID=Ribosomal_S7e; Match level="Score=79.3, E -value=1e-20, Copies=1"; Pfam description=Ribosomal protein S7e
TRADIKQKRPRSRTLTSVYDAILEDLVFPAEIVGKRIRVRLDGSQLIKVHLDKNQQTTIEHKVDTFASVYKKLTGREVTFEFPEPYL

SEQ ID NO: 30278 - protein, 183 aa, Diabrotica virgifera
  misc_feature: Coding regions on vcDNA: vcDNA=SeqID_9975; Strand=-; Position=2-550
  misc_feature (10)..(16): Xaa can be any naturally occurring amino acid
  misc_feature (33)..(65): Xaa can be any naturally occurring amino acid
  misc_feature (68)..(85): Xaa can be any naturally occurring amino acid
  misc_feature (90)..(142): Xaa can be any naturally occurring amino acid
  misc_feature (145)..(183): Xaa can be any naturally occurring amino acid
LFYSQTLGGXXXXXXXDVNFPQKKITPVFPLRXXXXXXXXXXXXXXXXXXXXXXXXXXXXXXXXXPPXXXXXXXXXXXXXXXXXXDRLKXXXXXXXXXXXXXXXXXXXXXXXXXXXXXXXXXXXXXXXXXXXXXXXXXXXXXPRXXXXXXXXXXXXXXXXXXXXXXXXXXXXXXXXXXXXXXX

SEQ ID NO: 30279 - protein, 55 aa, Diabrotica virgifera
  misc_feature: Coding regions on vcDNA: vcDNA=SeqID_9976; Strand=+; Position=3-170
VKGVFLTQECIFRHMFNIQSQLVGKMVSRLFRESTLLNKNHTLNFQKQMFWTKFY

SEQ ID NO: 30280 - protein, 121 aa, Diabrotica virgifera
  misc_feature: Coding regions on vcDNA: vcDNA=SeqID_9977; Strand=+; Position=13-378
  misc_feature: Homolog annotation: Hit_ID=NP_776330.1; Match level="QueryCoverage =83%, HitCoverage=21%, E-value=2e-33, Identity=70%"; Hit description =component of branched chain keto acid dehydrogenase complex; maple syrup urine disease] [Bos
  misc_feature: Gene Ontology Annotation: Cellular component=alpha-ketoglutarate dehydrogenase complex (sensu Eukarya)
  misc_feature: Pfam annotation: Pfam_ID=Biotin_lipoyl; Match level="Score=94.2, E -value=3.4e-25, Copies=1"; Pfam description=Biotin-requiring enzyme
MLAVNTFKQTCVNQAKYLHIYRNLLRKVSFKLSDIGEGIKEVTVKEWYVKEGDKVSQFDNICEVQSDKASVTITSRYDGVISKLYYNVDDTALVGKPLIDVEVEGSEHIEKKSEEESLREI

SEQ ID NO: 30281 - protein, 256 aa, Diabrotica virgifera
  misc_feature: Coding regions on vcDNA: vcDNA=SeqID_9978; Strand=+; Position=170-940
  misc_feature (212)..(212): Xaa can be any naturally occurring amino acid
MATRNLCLCMLIWMPLFEGIVGDVAFGIAQIPGGKATVEDLKKGKYLLNMEENNHGGVIPTPLFTITGVDNTDCPNLNVEFTQGMKFKFSINESCIFYAEQTFDYESNERSYNFRISKSVNDEIDIAFSIKNIDDEPPQLGTFKCNFNEQLDYSLDDTPCNTTLHDPDGWLAQEKILIFIDTKDEDIFAIDLRKPLPNDTETDTYVFMYLLXQLNYEDTNFYQFTVQANDSGGNLSPTRSAVGNVHIRSRPPNGQK

SEQ ID NO: 30282 - protein, 125 aa, Diabrotica virgifera
  misc_feature: Coding regions on vcDNA: vcDNA=SeqID_9979; Strand=+; Position=49-426
DYSDGYSSSEYMTNSYKTPEGYKVNTYKYESYQAPPQQTYSSSSEKYYTSAPAVISPISPRDKKTFETFKNGADSQYSTQYATNVEYINKPIIYLVRFRLVYLSSQTDSVICFGFRLLHQGFMMY

SEQ ID NO: 30283 - protein, 64 aa, Diabrotica virgifera
  misc_feature: Coding regions on vcDNA: vcDNA=SeqID_9980; Strand=-; Position=479-673
QKHCSWFVSRSHEGLSQSVFRSIVEWVQWTVSNASEDVVHLCHFSKTILVRVVFLAGFQLAWHL

SEQ ID NO: 30284 - protein, 229 aa, Diabrotica virgifera
  misc_feature: Coding regions on vcDNA: vcDNA=SeqID_9981; Strand=-; Position=0-686
  misc_feature (35)..(136): Xaa can be any naturally occurring amino acid
  misc_feature (138)..(179): Xaa can be any naturally occurring amino acid
  misc_feature (182)..(225): Xaa can be any naturally occurring amino acid
SAGRRAVIFNTKRHVLNNQEQKNVAEFLYYTYIIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXXXXXXXXXXXXXXXXXXXXXXXXXXXXXXXXXXXXXXXXXXARXXXXXXXXXXXXXXXXXXXXXXXXXXXXXXXXXXXXXXXXXXXXPFVL

SEQ ID NO: 30285 - protein, 230 aa, Diabrotica virgifera
  misc_feature: Coding regions on vcDNA: vcDNA=SeqID_9982; Strand=+; Position=1-690
  misc_feature (1)..(15): Xaa can be any naturally occurring amino acid
  misc_feature (18)..(55): Xaa can be any naturally occurring amino acid
  misc_feature (58)..(227): Xaa can be any naturally occurring amino acid
XXXXXXXXXXXXXXXYLXXXXXXXXXXXXXXXXXXXXXXXXXXXXXXXXXXXXXXETXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKKL

SEQ ID NO: 30286 - protein, 72 aa, Diabrotica virgifera
  misc_feature: Coding regions on vcDNA: vcDNA=SeqID_9983; Strand=+; Position=705-923
  misc_feature (46)..(46): Xaa can be any naturally occurring amino acid
VSSTTKLNDADTRNILNSFSAHTDSVSARGSHQTCRRRTSVGGGTXVLNKPLQAWAPSVRSNVDSERICYHT

SEQ ID NO: 30287 - protein, 52 aa, Diabrotica virgifera
  misc_feature: Coding regions on vcDNA: vcDNA=SeqID_9984; Strand=-; Position=154-312
  misc_feature (27)..(37): Xaa can be any naturally occurring amino acid
  misc_feature (42)..(49): Xaa can be any naturally occurring amino acid
VIYPSILYTKHLDISNPNTIPNDILTXXXXXXXXXXXLSSVXXXXXXXXLIN

SEQ ID NO: 30288 - protein, 236 aa, Diabrotica virgifera
  misc_feature: Coding regions on vcDNA: vcDNA=SeqID_9985; Strand=+; Position=2-709
  misc_feature (2)..(18): Xaa can be any naturally occurring amino acid
  misc_feature (22)..(56): Xaa can be any naturally occurring amino acid
  misc_feature (59)..(236): Xaa can be any naturally occurring amino acid
MXXXXXXXXXXXXXXXXXGIRXXXXXXXXXXXXXXXXXXXXXXXXXXXXXXXXXXXKGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30289 - protein, 198 aa, Diabrotica virgifera
  misc_feature: Coding regions on vcDNA: vcDNA=SeqID_9986; Strand=+; Position=1-594
  misc_feature (1)..(15): Xaa can be any naturally occurring amino acid
  misc_feature (18)..(56): Xaa can be any naturally occurring amino acid
  misc_feature (59)..(180): Xaa can be any naturally occurring amino acid
  misc_feature (186)..(195): Xaa can be any naturally occurring amino acid
XXXXXXXXXXXXXXXVPXXXXXXXXXXXXXXXXXXXXXXXXXXXXXXXXXXXXXXXRNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVIKNTXXXXXXXXXXRPP

SEQ ID NO: 30290 - protein, 116 aa, Diabrotica virgifera
  misc_feature: Coding regions on vcDNA: vcDNA=SeqID_9987; Strand=+; Position=338-685
LIPHTFASITARPPPPLFDEPTPQWFLNGRAVSRRSNYDFLTSHFTLTNPFPHSPRTAHHHHTLIPPHTRHPPLYFSRDYCPSPIQFQKSAPPVTSIFKPPLICYKQHHPPPSSTP

SEQ ID NO: 30291 - protein, 166 aa, Diabrotica virgifera
  misc_feature: Coding regions on vcDNA: vcDNA=SeqID_9988; Strand=+; Position=2-502
  misc_feature: Homolog annotation: Hit_ID=AAR89978.1; Match level="QueryCoverage =90%, HitCoverage=32%, E-value=5e-42, Identity=60%"; Hit description =putative elongation factor 1-alpha [Homalodisca coagulata] gb|AAS60203.1| putative elongation factor 1-alp
  misc_feature: Pfam annotation: Pfam_ID=GTP_EFTU_D3; Match level="Score=59.2, E -value=1.2e-14, Copies=1"; Pfam description=Elongation factor Tu C -terminal domain
PRVLSDEMLHEALHEAKAGDNVDNDAENDSVKELRPGYTTEDPTKNPPKLAAHFTALDLALNHPDQISHGYTCVLDCLACHIACIFDEIEQQADRSSDKTTEDNPSGIESVDAFIATLALTEHMCVESFPQFPPLGRYVVRDVTQTVVVRVIFRDAPIWTPLLKEL

SEQ ID NO: 30292 - protein, 26 aa, Diabrotica virgifera
  misc_feature: Coding regions on vcDNA: vcDNA=SeqID_9989; Strand=-; Position=1-78
  misc_feature (6)..(13): Xaa can be any naturally occurring amino acid
  misc_feature (16)..(24): Xaa can be any naturally occurring amino acid
FRRHLXXXXXXXXGQXXXXXXXXXFS

SEQ ID NO: 30293 - protein, 64 aa, Diabrotica virgifera
  misc_feature: Coding regions on vcDNA: vcDNA=SeqID_9990; Strand=+; Position=117-311
DLQSRRLILAPQYPGIHVNTSSSSTLQQRADTIIKTPVVRAVDLLDSVAIPKGYAVRGWSRLKR

SEQ ID NO: 30294 - protein, 67 aa, Diabrotica virgifera
  misc_feature: Coding regions on vcDNA: vcDNA=SeqID_9991; Strand=-; Position=3-203
  misc_feature (4)..(14): Xaa can be any naturally occurring amino acid
  misc_feature (34)..(47): Xaa can be any naturally occurring amino acid
  misc_feature (54)..(66): Xaa can be any naturally occurring amino acid
WSFXXXXXXXXXXXNQPGSHRFKLRSCKIVKVEXXXXXXXXXXXXXXSNIEVAXXXXXXXXXXXXXC

SEQ ID NO: 30295 - protein, 101 aa, Diabrotica virgifera
  misc_feature: Coding regions on vcDNA: vcDNA=SeqID_9992; Strand=-; Position=2-304
  misc_feature (4)..(12): Xaa can be any naturally occurring amino acid
  misc_feature (20)..(20): Xaa can be any naturally occurring amino acid
  misc_feature (22)..(30): Xaa can be any naturally occurring amino acid
  misc_feature (34)..(101): Xaa can be any naturally occurring amino acid
RVNXXXXXXXXXLKGLINNXIXXXXXXXXXKKMXXXXXXXXXXXXXXXXXXXXXXXXXXXXXXXXXXXXXXXXXXXXXXXXXXXXXXXXXXXXXXXXXXXX

SEQ ID NO: 30296 - protein, 219 aa, Diabrotica virgifera
  misc_feature: Coding regions on vcDNA: vcDNA=SeqID_9993; Strand=+; Position=51-707
  misc_feature: Homolog annotation: Hit_ID=XP_392215.1; Match level="QueryCoverage =81%, HitCoverage=4%, E-value=4e-21, Identity=34%"; Hit description =similar to ENSANGP00000022213 [Apis mellifera]
DDTATKKDVKTVQKSHTDVATDTKTLQNGNVTTTIKTTTVTTKGAQEASQHSERHLKQTNVNEIQKSSSQTHIHKTNIHKSSQIFNDQVDHAHSTTNKEISNKTSHHKKSSVTSEEINNQILHRKGIHTSSEALHATSSSALDMRKSVCNIHDQGRTVVNTERHSLSSMHRSNQETNNLNRRSHQQQTTYQVVERPEKIVRRDNLSVGGHFYGQSEAKS

SEQ ID NO: 30297 - protein, 65 aa, Diabrotica virgifera
  misc_feature: Coding regions on vcDNA: vcDNA=SeqID_9994; Strand=+; Position=448-646
  misc_feature (30)..(30): Xaa can be any naturally occurring amino acid
  misc_feature (44)..(44): Xaa can be any naturally occurring amino acid
GRLSHCRVHTETGLQCYIANCILPILLLTXVNRYLLELQLDSVXLYQTFGQIGENVNIIYCLLQT

SEQ ID NO: 30298 - protein, 134 aa, Diabrotica virgifera
  misc_feature: Coding regions on vcDNA: vcDNA=SeqID_9995; Strand=+; Position=373-777
  misc_feature (118)..(129): Xaa can be any naturally occurring amino acid
IYPLVYDLTSAPLLSISSFLDIFILLPLHIFMDELLYKILLKFYFSTTPKIMNIHMLHYVIIHPDILLFLLFIKYSLSYKCTLFPFSNDAHIYLRLFVIYIKYIGDNQAIRQHLFHLXXXXXXXXXXXXRSPAR

SEQ ID NO: 30299 - protein, 154 aa, Diabrotica virgifera
  misc_feature: Coding regions on vcDNA: vcDNA=SeqID_9996; Strand=-; Position=1-462
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(154): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30300 - protein, 57 aa, Diabrotica virgifera
  misc_feature: Coding regions on vcDNA: vcDNA=SeqID_9997; Strand=-; Position=1-171
  misc_feature (3)..(40): Xaa can be any naturally occurring amino acid
  misc_feature (43)..(57): Xaa can be any naturally occurring amino acid
VSXXXXXXXXXXXXXXXXXXXXXXXXXXXXXXXXXXXXXXEVXXXXXXXXXXXXXXX

SEQ ID NO: 30301 - protein, 199 aa, Diabrotica virgifera
  misc_feature: Coding regions on vcDNA: vcDNA=SeqID_9998; Strand=-; Position=1-600
  misc_feature (2)..(12): Xaa can be any naturally occurring amino acid
  misc_feature (14)..(199): Xaa can be any naturally occurring amino acid
QXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30302 - protein, 298 aa, Diabrotica virgifera
  misc_feature: Coding regions on vcDNA: vcDNA=SeqID_9999; Strand=-; Position=1-894
  misc_feature (1)..(12): Xaa can be any naturally occurring amino acid
  misc_feature (14)..(14): Xaa can be any naturally occurring amino acid
  misc_feature (17)..(39): Xaa can be any naturally occurring amino acid
  misc_feature (42)..(235): Xaa can be any naturally occurring amino acid
  misc_feature (238)..(276): Xaa can be any naturally occurring amino acid
  misc_feature (278)..(298): Xaa can be any naturally occurring amino acid
XXXXXXXXXXXXKXNNXXXXXXXXXXXXXXXXXXXXXXXLVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFXXXXXXXXXXXXXXXXXXXXXXXXXXXXXXXXXXXXXXXGXXXXXXXXXXXXXXXXXXXXX

SEQ ID NO: 30303 - protein, 188 aa, Diabrotica virgifera
  misc_feature: Coding regions on vcDNA: vcDNA=SeqID_10000; Strand=-; Position=700 -1266
  misc_feature (15)..(25): Xaa can be any naturally occurring amino acid
  misc_feature (28)..(34): Xaa can be any naturally occurring amino acid
  misc_feature (40)..(46): Xaa can be any naturally occurring amino acid
  misc_feature (49)..(59): Xaa can be any naturally occurring amino acid
  misc_feature (64)..(70): Xaa can be any naturally occurring amino acid
  misc_feature (77)..(111): Xaa can be any naturally occurring amino acid
  misc_feature (113)..(137): Xaa can be any naturally occurring amino acid
  misc_feature (145)..(173): Xaa can be any naturally occurring amino acid
  misc_feature (177)..(185): Xaa can be any naturally occurring amino acid
TPTRGPPPPGLLKSXXXXXXXXXXXGDXXXXXXXGVAPPXXXXXXXSHXXXXXXXXXXXVLEPXXXXXXXGFCSLKXXXXXXXXXXXXXXXXXXXXXXXXXXXXXXXXXXXPXXXXXXXXXXXXXXXXXXXXXXXXXPLIGFFFXXXXXXXXXXXXXXXXXXXXXXXXXXXXXHSVXXXXXXXXXMIH

SEQ ID NO: 30304 - protein, 162 aa, Diabrotica virgifera
  misc_feature: Coding regions on vcDNA: vcDNA=SeqID_10001; Strand=+; Position=1-489
  misc_feature: Homolog annotation: Hit_ID=AAC37266.1; Match level="QueryCoverage =96%, HitCoverage=17%, E-value=4e-13, Identity=28%"; Hit description =blackjack [Schistocerca americana] pir||T28657 blackjack protein, microtubule associated - American bird g
LTEDSKEPLDMVEDNATEKSEVFTEEPEDLLNEVKDDAIEKPEVLTEASKDPLYVVEDDAIQKSEAVTEEPKDPLNVVKDDAEKSEMLTEDSKDPFDVVEDDAIQKSEAVTEEPKGPLNLVEDSAIEKSEAVIEDPKDSLNEVEDDATEKSKAFTEEPNNSS

SEQ ID NO: 30305 - protein, 86 aa, Diabrotica virgifera
  misc_feature: Coding regions on vcDNA: vcDNA=SeqID_10002; Strand=-; Position=171-431
GWVEQLPPNADPLTGGPPYRALIVNDTTRVELGTYGRTEEGYLRSPREAEQSSVRGLDRCRTVLMNYQDASLRTNSLRFQHHVCLR

SEQ ID NO: 30306 - protein, 73 aa, Diabrotica virgifera
  misc_feature: Coding regions on vcDNA: vcDNA=SeqID_10003; Strand=+; Position=53-274
LAHILDSIGGYPDRYHVEDVGLDLDIHEIINLPPRIPLDLNHHYIVMRHLHVMNNFHRCSTIDMHAAEQIPAI

SEQ ID NO: 30307 - protein, 99 aa, Diabrotica virgifera
  misc_feature: Coding regions on vcDNA: vcDNA=SeqID_10004; Strand=+; Position=332-631
  misc_feature: Homolog annotation: Hit_ID=NP_524780.1; Match level="QueryCoverage =67%, HitCoverage=6%, E-value=3e-10, Identity=41%"; Hit description =CG7935-PA [Drosophila melanogaster] gb|AAF50487.1| CG7935-PA [Drosophila melanogaster]
  misc_feature: Gene Ontology Annotation: Molecular function=small GTPase regulatory/interacting protein activity; Cellular component=nucleus; Biological process=EGF receptor signaling pathway
TLPSIPFALHDLDRALIRDSIMNAVIHAPYLLTAQLCTRVHHLCQHDSSTTWTQIVHQINDYLSNPDTDSYLSHFPMPLSTTKELLIYNSCINMPSPCR

SEQ ID NO: 30308 - protein, 52 aa, Diabrotica virgifera
  misc_feature: Coding regions on vcDNA: vcDNA=SeqID_10005; Strand=+; Position=3-158
  misc_feature (22)..(36): Xaa can be any naturally occurring amino acid
  misc_feature (45)..(52): Xaa can be any naturally occurring amino acid
LSVVCFLYNSNEHIRKGVLICXXXXXXXXXXXXXXXLYHHATQKXXXXXXXX

SEQ ID NO: 30309 - protein, 100 aa, Diabrotica virgifera
  misc_feature: Coding regions on vcDNA: vcDNA=SeqID_10006; Strand=+; Position=2-304
GRVGGRANFKIWINSNIYCQSTCTTLALLEIIACKCTKGCTKKCGCRKIGISCSIFCKGCMCMGTNCGHSKITEVSEEDIEGNANEEMDFDFEDFLNVNV

SEQ ID NO: 30310 - protein, 237 aa, Diabrotica virgifera
  misc_feature: Coding regions on vcDNA: vcDNA=SeqID_10007; Strand=+; Position=78-788
  misc_feature: Homolog annotation: Hit_ID=EAL34154.1; Match level="QueryCoverage =84%, HitCoverage=43%, E-value=2e-92, Identity=80%"; Hit description =GA11518-PA [Drosophila pseudoobscura]
  misc_feature: Gene Ontology Annotation: Cellular component=mitochondrial matrix; Biological process=sulfur amino acid metabolism
  misc_feature: Pfam annotation: Pfam_ID=Aminotran_5; Match level="Score=6.5, E-value= 3.1e-08, Copies=1"; Pfam description=Aminotransferase class-V
MYRQLSRFRKAVSVLFNEKTGFIRIQPLSSYPEEGDFEGRPLYLDVQATTPLDPRVLDVMLPYLTNYYGNPHSRTHAYGWETEEAVEEARKHVADVIGADSREIIFTSGATESNNIAVKGVARFYKEKKNHIITTQTEHKCVLDSCKALESEGFRVTYLPVNPNGIISLEEIEQAMTPQTSLVSIMTVNNEIGVKTPMDAIGALCKQKKIFFHTDAAQAVGKIPLDVNAMNIDLMSI

SEQ ID NO: 30311 - protein, 58 aa, Diabrotica virgifera; identical to SEQ ID NO: 29202
  misc_feature: Coding regions on vcDNA: vcDNA=SeqID_10008; Strand=-; Position=1-174
  misc_feature (1)..(58): Xaa can be any naturally occurring amino acid

SEQ ID NO: 30312 - protein, 272 aa, Diabrotica virgifera
  misc_feature: Coding regions on vcDNA: vcDNA=SeqID_10009; Strand=-; Position=1-816
  misc_feature (4)..(272): Xaa can be any naturally occurring amino acid
INNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30313 - protein, 57 aa, Diabrotica virgifera
  misc_feature: Coding regions on vcDNA: vcDNA=SeqID_10010; Strand=-; Position=1-171
  misc_feature (1)..(24): Xaa can be any naturally occurring amino acid
  misc_feature (26)..(55): Xaa can be any naturally occurring amino acid
XXXXXXXXXXXXXXXXXXXXXXXXPXXXXXXXXXXXXXXXXXXXXXXXXXXXXXXRL

SEQ ID NO: 30314 - protein, 69 aa, Diabrotica virgifera
  misc_feature: Coding regions on vcDNA: vcDNA=SeqID_10011; Strand=-; Position=1-207
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PFXXXXXXXXXXXTNLAHTGLNXXXXXXXXSNXXXXXXXXXXXXXXPTSRSXXXXXXXXXXXXXXADEE

SEQ ID NO: 30315 - protein, 77 aa, Diabrotica virgifera
  misc_feature: Coding regions on vcDNA: vcDNA=SeqID_10012; Strand=+; Position=269-499
RENYGYVFCYYSTKARSFDFNRPIHENLLERSTIIYTDLKRFLTKYRPDGTCTDVPPSGLNTLLNSTTTSSTANTIK

SEQ ID NO: 30316 - protein, 240 aa, Diabrotica virgifera
  misc_feature: Coding regions on vcDNA: vcDNA=SeqID_10013; Strand=+; Position=3-722
  misc_feature: Homolog annotation: Hit_ID=EAA00302.2; Match level="QueryCoverage =100%, HitCoverage=30%, E-value=8e-70, Identity=53%"; Hit description= ENSANGP00000009085 [Anopheles gambiae str. PEST] ref|XP_551950.1| ENSANGP00000009085 [Anopheles gambiae s
  misc_feature: Gene Ontology Annotation: Molecular function=cysteine-type endopeptidase activity; Biological process=protein modification
  misc_feature: Pfam annotation: Pfam_ID=UBA; Match level="Score=93.4, E-value=5.8e -25, Copies=2"; Pfam description=UBA/TS-N domain
DAIVRPKIWFISCLESFSEPELINNFYSSAVQENVTARKTTRLSSFPDYLVIHLKKFMLREDWVPIKLDVSIEMPDVLDVSSLRGDGPQPTEELLPELQVPPPAPSMDEGVISQLMEMGFPIDACKRAIFQSGNAGVEPATAWIMEHIADADFTDPFVPPGTENTKFVPNPDALATIASMGFTPEQATKALKATENNVERAMDWIFSHQEELDNIKSPPPPTFRDGEGKYKLAGFISHMG

SEQ ID NO: 30317 - protein, 184 aa, Diabrotica virgifera
  misc_feature: Coding regions on vcDNA: vcDNA=SeqID_10014; Strand=-; Position=2-553
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(184): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30318 - protein, 310 aa, Diabrotica virgifera
  misc_feature: Coding regions on vcDNA: vcDNA=SeqID_10015; Strand=-; Position=0-929
  misc_feature (11)..(294): Xaa can be any naturally occurring amino acid
  misc_feature (296)..(306): Xaa can be any naturally occurring amino acid
IKITLLSLRVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXTREG

SEQ ID NO: 30319 - protein, 33 aa, Diabrotica virgifera
  misc_feature: Coding regions on vcDNA: vcDNA=SeqID_10016; Strand=+; Position=1-102
RSDCPVSPSHKPRVQNHRFQYAIDEFWSLFFLS

SEQ ID NO: 30320 - protein, 258 aa, Diabrotica virgifera
  misc_feature: Coding regions on vcDNA: vcDNA=SeqID_10017; Strand=+; Position=1-774
  misc_feature (6)..(16): Xaa can be any naturally occurring amino acid
  misc_feature (19)..(231): Xaa can be any naturally occurring amino acid
INKLIXXXXXXXXXXXSSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKDNSVILFGELKSIIKDCEPPCWIKS

SEQ ID NO: 30321 - protein, 190 aa, Diabrotica virgifera
  misc_feature: Coding regions on vcDNA: vcDNA=SeqID_10018; Strand=+; Position=53-625
  misc_feature: Homolog annotation: Hit_ID=EAL40365.1; Match level="QueryCoverage =99%, HitCoverage=79%, E-value=3e-56, Identity=60%"; Hit description =ENSANGP00000026839 [Anopheles gambiae str. PEST] ref|XP_558141.1| ENSANGP00000026839 [Anopheles gambiae st
  misc_feature: Gene Ontology Annotation: Molecular function=neurotransmitter transporter activity; Cellular component=clathrin coat of coated pit; Biological process=synaptic vesicle coating
  misc_feature: Pfam annotation: Pfam_ID=Clathrin_lg_ch; Match level="Score=73.8, E -value=4.8e-19, Copies=1"; Pfam description=Clathrin light chain
  misc_feature (94)..(101): Xaa can be any naturally occurring amino acid
  misc_feature (161)..(161): Xaa can be any naturally occurring amino acid
MSGFGDNFGVADEDPAAEFLAREQDELAGLEDEVKPAAVIAPVLNGDIPADFDPDKEYRERVSPLTIRQEDRVEPEKIRLWREEQIKRLEEKDXXXXXXXXELREVAKKELEDWYKNHEEAIAKTKAANRNAEKQFVAEDDELEPGTEWERIAKLCDFNPXAKQGSKDVSRMRSIVLQMKQNPVPIKNKA

SEQ ID NO: 30322 - protein, 176 aa, Diabrotica virgifera
  misc_feature: Coding regions on vcDNA: vcDNA=SeqID_10019; Strand=-; Position=1-528
  misc_feature (6)..(16): Xaa can be any naturally occurring amino acid
  misc_feature (26)..(33): Xaa can be any naturally occurring amino acid
  misc_feature (36)..(49): Xaa can be any naturally occurring amino acid
  misc_feature (55)..(68): Xaa can be any naturally occurring amino acid
  misc_feature (70)..(176): Xaa can be any naturally occurring amino acid
IFGPFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30323 - protein, 137 aa, Diabrotica virgifera
  misc_feature: Coding regions on vcDNA: vcDNA=SeqID_10020; Strand=-; Position=1-411
  misc_feature (1)..(40): Xaa can be any naturally occurring amino acid
  misc_feature (43)..(137): Xaa can be any naturally occurring amino acid
XXXXXXXXXXXXXXXXXXXXXXXXXXXXXXXXXXXXXXXXINXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30324 - protein, 290 aa, Diabrotica virgifera
  misc_feature: Coding regions on vcDNA: vcDNA=SeqID_10021; Strand=+; Position=1-870
  misc_feature (152)..(157): Xaa can be any naturally occurring amino acid
RETPEAQNPEKVARKSKPKGDKESGGIFGIFKRKSESIEKDFKDETQQIKQDLKESGEIVKTKVTTTIKKISPEETKPKLSETKLKEIDDSNNFLNLEIEKYHDVKPLPQKDSSKTITIISAPLLEQKVIEKDQSQTITEEISTSTTDKLLXXXXXXTPKRTVTTTITKEEIPHGERVTKVKSEVVTGTIQLTSDVLTDIEKLEKEINEKLQDLGKETDPSKDISTEIVKESAQEYQKVTEVDMPAVKMDIAIPKEASKLSESVIENIDKSNKFLDTRIDYHDVRPIIMT

SEQ ID NO: 30325 - protein, 169 aa, Diabrotica virgifera
  misc_feature: Coding regions on vcDNA: vcDNA=SeqID_10022; Strand=-; Position=33-542
YFSVQINIGQLLSITYMFMVHVLFFILILSFLLLLQYYVSYFVIDFFRLSLSNLFIYIIIYDNLFIVVHIFLFYLSDVYILSCLSHPFPDIIFIWFLSIMSVEFVVIVLSTILNILFLFDIPWLPRYNDKIIPFFKRNVSPISTFLTLHIAFSLQRGAWCLCSLRAIPA

SEQ ID NO: 30326 - protein, 256 aa, Diabrotica virgifera
  misc_feature: Coding regions on vcDNA: vcDNA=SeqID_10023; Strand=-; Position=1-768
  misc_feature (1)..(252): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTRR

SEQ ID NO: 30327 - protein, 108 aa, Diabrotica virgifera
  misc_feature: Coding regions on vcDNA: vcDNA=SeqID_10024; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(92): Xaa can be any naturally occurring amino acid
  misc_feature (98)..(105): Xaa can be any naturally occurring amino acid
NYAVIPKVIYSYXXXXXXXXXXXXXXXXXXXXXXXXXPXXXXXXXXXXXXXXXXXXXXXXSIGSSXXXXXXXLFXXXXXXXXXXXXXXXXXXNPSFQXXXXXXXXMLP

SEQ ID NO: 30328 - protein, 65 aa, Diabrotica virgifera
  misc_feature: Coding regions on vcDNA: vcDNA=SeqID_10025; Strand=-; Position=3-197
  misc_feature (2)..(12): Xaa can be any naturally occurring amino acid
  misc_feature (32)..(45): Xaa can be any naturally occurring amino acid
  misc_feature (52)..(64): Xaa can be any naturally occurring amino acid
FXXXXXXXXXXXNQPGSHRFKLRSCKILKVEXXXXXXXXXXXXXXSNIEVAXXXXXXXXXXXXXC

SEQ ID NO: 30329 - protein, 77 aa, Diabrotica virgifera
  misc_feature: Coding regions on vcDNA: vcDNA=SeqID_10026; Strand=-; Position=484-717
  misc_feature (33)..(40): Xaa can be any naturally occurring amino acid
DYRRDSGQNPRLVTTCDNTQRKRIRIIHIIKKXXXXXXXXRKKRHASFYRKHEPSSNNIIPTPGFKELAQYPLITSV

SEQ ID NO: 30330 - protein, 66 aa, Diabrotica virgifera
  misc_feature: Coding regions on vcDNA: vcDNA=SeqID_10027; Strand=-; Position=2-199
  misc_feature (5)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PFVLXXXXXXXXXTNLAHTGLNXXXXXXXXSNXXXXXXXXXXXXXXPTSRSXXXXXXXXXXXXXXV

SEQ ID NO: 30331 - protein, 58 aa, Diabrotica virgifera
  misc_feature: Coding regions on vcDNA: vcDNA=SeqID_10028; Strand=-; Position=20-196
  misc_feature (27)..(55): Xaa can be any naturally occurring amino acid
TLIQHRGRNLYYRFELFNKISLLSLRXXXXXXXXXXXXXXXXXXXXXXXXXXXXXQAN

SEQ ID NO: 30332 - protein, 331 aa, Diabrotica virgifera
  misc_feature: Coding regions on vcDNA: vcDNA=SeqID_10029; Strand=+; Position=3-998
  misc_feature (3)..(305): Xaa can be any naturally occurring amino acid
  misc_feature (313)..(321): Xaa can be any naturally occurring amino acid
LSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKITLGITXXXXXXXXXDNKNATSMLD

SEQ ID NO: 30333 - protein, 228 aa, Diabrotica virgifera
  misc_feature: Coding regions on vcDNA: vcDNA=SeqID_10030; Strand=-; Position=0-683
  misc_feature (2)..(226): Xaa can be any naturally occurring amino acid
SXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKG

SEQ ID NO: 30334 - protein, 66 aa, Diabrotica virgifera
  misc_feature: Coding regions on vcDNA: vcDNA=SeqID_10031; Strand=-; Position=2-199
  misc_feature (3)..(10): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PFXXXXXXXXKIETNLAHTGLNXXXXXXXXSNXXXXXXXXXXXXXXPTSRSXXXXXXXXXXXXXXV

SEQ ID NO: 30335 - protein, 81 aa, Diabrotica virgifera
  misc_feature: Coding regions on vcDNA: vcDNA=SeqID_10032; Strand=-; Position=39-284
  misc_feature (31)..(40): Xaa can be any naturally occurring amino acid
SLPVHGSARSAPMIDSRIMVFFTLRWTAFPXXXXXXXXXXIESVIVSAHTWRCAGGLLSIGLVCCSLFPHKYPSMNVCENL

SEQ ID NO: 30336 - protein, 58 aa, Diabrotica virgifera; identical to SEQ ID NO: 29331
  misc_feature: Coding regions on vcDNA: vcDNA=SeqID_10033; Strand=+; Position=1-174
  misc_feature (1)..(15): Xaa can be any naturally occurring amino acid
  misc_feature (18)..(57): Xaa can be any naturally occurring amino acid

SEQ ID NO: 30337 - protein, 32 aa, Diabrotica virgifera
  misc_feature: Coding regions on vcDNA: vcDNA=SeqID_10034; Strand=+; Position=20-115
  misc_feature (6)..(6): Xaa can be any naturally occurring amino acid
  misc_feature (8)..(8): Xaa can be any naturally occurring amino acid
  misc_feature (26)..(31): Xaa can be any naturally occurring amino acid
QRNFIXEXQSINKIATLDVDLSYNWXXXXXXK

SEQ ID NO: 30338 - protein, 288 aa, Diabrotica virgifera
  misc_feature: Coding regions on vcDNA: vcDNA=SeqID_10035; Strand=+; Position=3-866
  misc_feature: Homolog annotation: Hit_ID=XP_318162.1; Match level="QueryCoverage =97%, HitCoverage=35%, E-value=5e-30, Identity=31%"; Hit description =ENSANGP00000020700 [Anopheles gambiae]
  misc_feature (20)..(27): Xaa can be any naturally occurring amino acid
  misc_feature (270)..(270): Xaa can be any naturally occurring amino acid
  misc_feature (273)..(273): Xaa can be any naturally occurring amino acid
LNYLLKNDVVFRWSKDQTAXXXXXXXXLINAPCLSYFDPTKKVIVSGDSSSFGLGAALMQINENNETEIVAYASRTLSPTECRYAQIERECLSLTWACEKFQEYITGISVILETDHKPLLQILQTKNLDDLTPRLQRFRLRLMRYNYTVLFTRGTDLKVADALSRNPLQVSHNSEELTSEVDAHVRLIIQNLPIKNHFLNKILNEQELDPICRNLKQYCISGWPDKKHILPEMCPYFQYRYEISLNENFLTKNSRLIVPPALQLQTLEYXSSXHQGIVKCRKGQKCLS

SEQ ID NO: 30339 - protein, 99 aa, Diabrotica virgifera
  misc_feature: Coding regions on vcDNA: vcDNA=SeqID_10036; Strand=+; Position=66-365
  misc_feature: Homolog annotation: Hit_ID=XP_317136.1; Match level="QueryCoverage =97%, HitCoverage=24%, E-value=4e-34, Identity=67%"; Hit description =ENSANGP00000018254 [Anopheles gambiae]
  misc_feature: Pfam annotation: Pfam_ID=DnaJ_C; Match level="Score=-37.0, E-value =0.0011, Copies=1"; Pfam description=DnaJ C terminal region
TNGYICIQVISPSFTMEIPHLDGHKVSIVRDKITWPGARIRKKGEGMPNYDNNNLHGILFITFDVEFPKQELTEEDKEALKKILNQSSNNKVYNGLRGY

SEQ ID NO: 30340 - protein, 303 aa, Diabrotica virgifera
  misc_feature: Coding regions on vcDNA: vcDNA=SeqID_10037; Strand=-; Position=1-909
  misc_feature (7)..(246): Xaa can be any naturally occurring amino acid
  misc_feature (249)..(286): Xaa can be any naturally occurring amino acid
  misc_feature (289)..(303): Xaa can be any naturally occurring amino acid
KMGSKIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSXXXXXXXXXXXXXXXXXXXXXXXXXXXXXXXXXXXXXXEVXXXXXXXXXXXXXXX

SEQ ID NO: 30341 - protein, 66 aa, Diabrotica virgifera; identical to SEQ ID NO: 26808
  misc_feature: Coding regions on vcDNA: vcDNA=SeqID_10038; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 30342 - protein, 17 aa, Diabrotica virgifera
  misc_feature: Coding regions on vcDNA: vcDNA=SeqID_10039; Strand=-; Position=1-51
  misc_feature (3)..(17): Xaa can be any naturally occurring amino acid
EVXXXXXXXXXXXXXXX

SEQ ID NO: 30343 - protein, 65 aa, Diabrotica virgifera
  misc_feature: Coding regions on vcDNA: vcDNA=SeqID_10040; Strand=+; Position=423-620
LRGWVRIFCCNAIQMGIYFFRILRRLISIFERFERRMKDYVISEGRKSLRTSIMFILISYRGEIL

SEQ ID NO: 30344 - protein, 91 aa, Diabrotica virgifera
  misc_feature: Coding regions on vcDNA: vcDNA=SeqID_10041; Strand=-; Position=159-434
YHVRWYIMGAKGPISLQTSVCGTGNRGSHSKAGCEVQFRRGNELGVKRILEALRSIICVMNKIQVEGYNFNMGYPIEIFNIAGAGEITWKR

SEQ ID NO: 30345 - protein, 61 aa, Diabrotica virgifera
  misc_feature: Coding regions on vcDNA: vcDNA=SeqID_10042; Strand=-; Position=1-183
  misc_feature (3)..(60): Xaa can be any naturally occurring amino acid
KKXXXXXXXXXXXXXXXXXXXXXXXXXXXXXXXXXXXXXXXXXXXXXXXXXXXXXXXXXXF

SEQ ID NO: 30346 - protein, 119 aa, Diabrotica virgifera
  misc_feature: Coding regions on vcDNA: vcDNA=SeqID_10043; Strand=-; Position=3-359
  misc_feature (26)..(110): Xaa can be any naturally occurring amino acid
AIVPFLDIHFSQWSLDVNLIIIEINXXXXXXXXXXXXXXXXXXXXXXXXXXXXXXXXXXXXXXXXXXXXXXXXXXXXXXXXXXXXXXXXXXXXXXXXXXXXXXXXXXXXXNTNFHSLPL

SEQ ID NO: 30347 - protein, 17 aa, Diabrotica virgifera
  misc_feature: Coding regions on vcDNA: vcDNA=SeqID_10044; Strand=-; Position=1-51
  misc_feature (3)..(17): Xaa can be any naturally occurring amino acid
EVXXXXXXXXXXXXXXX

SEQ ID NO: 30348 - protein, 163 aa, Diabrotica virgifera
  misc_feature: Coding regions on vcDNA: vcDNA=SeqID_10045; Strand=+; Position=68-560
  misc_feature: Homolog annotation: Hit_ID=XP_310186.1; Match level="QueryCoverage =92%, HitCoverage=44%, E-value=5e-34, Identity=53%"; Hit description =ENSANGP00000011006 [Anopheles gambiae]
  misc_feature: Gene Ontology Annotation: Molecular function=malic enzyme activity; Cellular component=cytosol
  misc_feature: Pfam annotation: Pfam_ID=Ldh_1_N; Match level="Score=-38.4, E-value =0.018, Copies=1"; Pfam description=lactate/malate dehydrogenase, NAD bind
  misc_feature (53)..(53): Xaa can be any naturally occurring amino acid
  misc_feature (68)..(68): Xaa can be any naturally occurring amino acid
  misc_feature (79)..(79): Xaa can be any naturally occurring amino acid
  misc_feature (84)..(84): Xaa can be any naturally occurring amino acid
  misc_feature (127)..(127): Xaa can be any naturally occurring amino acid
TCRKSRFTYPKLIAAGQIAYSLLHMSCKGDVFRPDRCLSLRLLYIPPMMSETXGVVLEHANSARPLLXETIPTADPPAXLMTNXAAFLGRAMPRKERLQRTDVLPGNGTVLGEQREALHHHTMTNVXALDRDTPANTNALLCSTYTPSIPEDNITAMTRMDLN

SEQ ID NO: 30349 - protein, 230 aa, Diabrotica virgifera
  misc_feature: Coding regions on vcDNA: vcDNA=SeqID_10046; Strand=-; Position=1-690
  misc_feature (1)..(34): Xaa can be any naturally occurring amino acid
  misc_feature (37)..(173): Xaa can be any naturally occurring amino acid
  misc_feature (176)..(213): Xaa can be any naturally occurring amino acid
  misc_feature (216)..(230): Xaa can be any naturally occurring amino acid
XXXXXXXXXXXXXXXXXXXXXXXXXXXXXXXXXXVGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVSXXXXXXXXXXXXXXXXXXXXXXXXXXXXXXXXXXXXXXEVXXXXXXXXXXXXXXX

SEQ ID NO: 30350 - protein, 120 aa, Diabrotica virgifera
  misc_feature: Coding regions on vcDNA: vcDNA=SeqID_10047; Strand=+; Position=195-557
MEEDEAFVDENVPRRSLRIALIELNEHIPDTPKSTNPEEMLVIQRGPRKKPITWSPVDYHKIGSLLAPSRDRTPEPVVTKSEINPRLRRRLIMSPSKSPSQEMDVFIAKKLRALKNISLQ

SEQ ID NO: 30351 - protein, 118 aa, Diabrotica virgifera
  misc_feature: Coding regions on vcDNA: vcDNA=SeqID_10048; Strand=+; Position=277-633
  misc_feature: Homolog annotation: Hit_ID=CAI19834.1; Match level="QueryCoverage =75%, HitCoverage=28%, E-value=9e-20, Identity=47%"; Hit description =OTTHUMP00000028759 [Homo sapiens] ref|NP_055324.2| kraken-like [Homo sapiens] emb|CAC34873.1| hypothetical
  misc_feature: Gene Ontology Annotation: Molecular function=hydrolase activity; Cellular component=cytoplasmic vesicle; Biological process=digestion
MTTNVKKIGEISIPVPWGQLAAKTWGEPDDPLILCFHGFLDNAGTFNRLIPYLPNSFYYVCIDLPGHGRSSYFPPNLPINTLNYILAYRYISYILKVIVMELSWAIFTLRCIQKMYKS

SEQ ID NO: 30352 - protein, 95 aa, Diabrotica virgifera
  misc_feature: Coding regions on vcDNA: vcDNA=SeqID_10049; Strand=-; Position=131-418
  misc_feature (2)..(51): Xaa can be any naturally occurring amino acid
  misc_feature (56)..(68): Xaa can be any naturally occurring amino acid
  misc_feature (83)..(89): Xaa can be any naturally occurring amino acid
PXXXXXXXXXXXXXXXXXXXXXXXXXXXXXXXXXXXXXXXXXXXXXXXXXXGPFLXXXXXXXXXXXXXETQPGPPPRFKSQIXXXXXXXEPSLIK

SEQ ID NO: 30353 - protein, 88 aa, Diabrotica virgifera
  misc_feature: Coding regions on vcDNA: vcDNA=SeqID_10050; Strand=+; Position=84-347
  misc_feature: Homolog annotation: Hit_ID=XP_306980.1; Match level="QueryCoverage =98%, HitCoverage=22%, E-value=3e-24, Identity=63%"; Hit description =ENSANGP00000016397 [Anopheles gambiae]
  misc_feature: Gene Ontology Annotation: Cellular component=actin filament; Biological process=reproduction
  misc_feature (17)..(17): Xaa can be any naturally occurring amino acid
  misc_feature (36)..(36): Xaa can be any naturally occurring amino acid
  misc_feature (44)..(44): Xaa can be any naturally occurring amino acid
  misc_feature (62)..(62): Xaa can be any naturally occurring amino acid
  misc_feature (72)..(72): Xaa can be any naturally occurring amino acid
  misc_feature (76)..(76): Xaa can be any naturally occurring amino acid
MNMCEEEVFGLVVENGXGMCKGGFDGDDVCSGVLSXIVGCKRYXGVMVGMGEKDLYVGDEDXSKRGIVMLKXVYGXGIVRKWDDMEKI

SEQ ID NO: 30354 - protein, 66 aa, Diabrotica virgifera
  misc_feature: Coding regions on vcDNA: vcDNA=SeqID_10051; Strand=-; Position=3-200
  misc_feature (7)..(7): Xaa can be any naturally occurring amino acid
  misc_feature (23)..(31): Xaa can be any naturally occurring amino acid
  misc_feature (33)..(46): Xaa can be any naturally occurring amino acid
  misc_feature (53)..(65): Xaa can be any naturally occurring amino acid
PLVLKYXIKLKIETNPGSHRFKXXXXXXXXXEXXXXXXXXXXXXXXSNIEVAXXXXXXXXXXXXXC

SEQ ID NO: 30355 - protein, 20 aa, Diabrotica virgifera
  misc_feature: Coding regions on vcDNA: vcDNA=SeqID_10052; Strand=-; Position=0-59
  misc_feature (3)..(4): Xaa can be any naturally occurring amino acid
  misc_feature (6)..(17): Xaa can be any naturally occurring amino acid
FYXXIXXXXXXXXXXXXIHP

SEQ ID NO: 30356 - protein, 279 aa, Diabrotica virgifera
  misc_feature: Coding regions on vcDNA: vcDNA=SeqID_10053; Strand=+; Position=3-840
  misc_feature: Homolog annotation: Hit_ID=NP_644677.1; Match level="QueryCoverage =92%, HitCoverage=42%, E-value=1e-58, Identity=46%"; Hit description =CG9522-PA [Drosophila melanogaster] gb|AAF48395.1| CG9522-PA [Drosophila melanogaster]
  misc_feature: Gene Ontology Annotation: Biological process=reproduction
  misc_feature: Pfam annotation: Pfam_ID=GMC_oxred_N; Match level="Score=183.7, E -value=3.8e-52, Copies=1"; Pfam description=GMC oxidoreductase
  misc_feature (41)..(41): Xaa can be any naturally occurring amino acid
  misc_feature (142)..(149): Xaa can be any naturally occurring amino acid
  misc_feature (245)..(245): Xaa can be any naturally occurring amino acid
  misc_feature (252)..(253): Xaa can be any naturally occurring amino acid
IQSVLFPLYPDRQLEITFKNKFDFIIVGSGPSGSALASRLXENPNVNVLLLENGEQASILTEIPLIAGAFGSTLYQWGYLTEPQPGFCRGCTNHQIKWEHGNALGGSTIINYMIYVRGNRRDYDNWADQGNPGWGYDDLLPXXXXXXXXHVAIKDDAYRGTGGPVTVTDVAWRTKVSGAYVQAAQQAGYSYVDYNGKEQLGVSYVQATTRNGRRDSAEKAYLRPIRNRKNLKIQTKSKVTKVLIXDNAALRXXNIPIMGLDTKFMQQGRVILSAGALIL

SEQ ID NO: 30357 - protein, 115 aa, Diabrotica virgifera
  misc_feature: Coding regions on vcDNA: vcDNA=SeqID_10054; Strand=-; Position=267-614
GSPSLSRRSLQSSLNIFCCTSKFVQLSYSTYIFLICNIIIKSQTNRSLCYVIPSRTHFVQTGKTLTLYAHSYLFSYQDLFVSSSIPFHSPASPYHELYCAFAQTFHTLYPSPFSV

SEQ ID NO: 30358 - protein, 108 aa, Diabrotica virgifera
  misc_feature: Coding regions on vcDNA: vcDNA=SeqID_10055; Strand=+; Position=1-327
  misc_feature: Homolog annotation: Hit_ID=AAL90009.1; Match level="QueryCoverage =94%, HitCoverage=22%, E-value=1e-15, Identity=41%"; Hit description =AT07338p [Drosophila melanogaster]
VVKKIEEEIFLVFGVPRLLLCDNGVQYTSGIFKKLMETYGASVRYNALYHPQCNPSERYNRTLKTMMATYIAGNHRKWDENLARLTSATRAVYHETTGQDPYMINFVL

SEQ ID NO: 30359 - protein, 286 aa, Diabrotica virgifera
  misc_feature: Coding regions on vcDNA: vcDNA=SeqID_10056; Strand=-; Position=1-858
  misc_feature (2)..(286): Xaa can be any naturally occurring amino acid
PXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30360 - protein, 44 aa, Diabrotica virgifera
  misc_feature: Coding regions on vcDNA: vcDNA=SeqID_10057; Strand=+; Position=49-183
MLRSLVAHNGYGVCLAVFLGNVIPRAGFPYFVVRPRYLLGMFVM

SEQ ID NO: 30361 - protein, 73 aa, Diabrotica virgifera
  misc_feature: Coding regions on vcDNA: vcDNA=SeqID_10058; Strand=-; Position=540-761
RSWQLPIHTIKIVVPSRVQDFENHSTVSQMAMARRFYGINIDNENISRSKLCGRIEELYLHMGSLYSDILILI

SEQ ID NO: 30362 - protein, 28 aa, Diabrotica virgifera
  misc_feature: Coding regions on vcDNA: vcDNA=SeqID_10059; Strand=-; Position=3-86
  misc_feature (9)..(10): Xaa can be any naturally occurring amino acid
  misc_feature (22)..(28): Xaa can be any naturally occurring amino acid
RNLYYRLTXXNKITLLSPKVIXXXXXXX

SEQ ID NO: 30363 - protein, 109 aa, Diabrotica virgifera
  misc_feature: Coding regions on vcDNA: vcDNA=SeqID_10060; Strand=+; Position=2-331
  misc_feature (4)..(24): Xaa can be any naturally occurring amino acid
  misc_feature (26)..(26): Xaa can be any naturally occurring amino acid
  misc_feature (28)..(54): Xaa can be any naturally occurring amino acid
  misc_feature (62)..(62): Xaa can be any naturally occurring amino acid
  misc_feature (65)..(71): Xaa can be any naturally occurring amino acid
RREXXXXXXXXXXXXXXXXXXXXXNXFXXXXXXXXXXXXXXXXXXXXXXXXXXXIIRINYLXDTXXXXXXXVPSNIKRGTPRWGVKVLNWGAPFFFKRGPLLNFNCIWG

SEQ ID NO: 30364 - protein, 87 aa, Diabrotica virgifera
  misc_feature: Coding regions on vcDNA: vcDNA=SeqID_10061; Strand=-; Position=373-636
  misc_feature (9)..(9): Xaa can be any naturally occurring amino acid
FSNCNYNNXRDPATLQGEGNEIKIFSLLAYSGFFFGMGCYFIFLHVPCPFRMLVTIIAILILFTATLNQPAKCFFVLDCVCLLFSLV

SEQ ID NO: 30365 - protein, 135 aa, Diabrotica virgifera
  misc_feature: Coding regions on vcDNA: vcDNA=SeqID_10062; Strand=-; Position=348-755
  misc_feature (25)..(80): Xaa can be any naturally occurring amino acid
  misc_feature (122)..(128): Xaa can be any naturally occurring amino acid
GNKFWGPYKKILSSPPPVFKLGSFXXXXXXXXXXXXXXXXXXXXXXXXXXXXXXXXXXXXXXXXXXXXXXXXXXXXXXXXKIAFIWLQKYFLYTILNIFHLPKHLIILKPNYLFSNLNMNIXXXXXXXLYANIIS

SEQ ID NO: 30366 - protein, 314 aa, Diabrotica virgifera
  misc_feature: Coding regions on vcDNA: vcDNA=SeqID_10063; Strand=+; Position=2-942
  misc_feature: Homolog annotation: Hit_ID=XP_321301.1; Match level="QueryCoverage =99%, HitCoverage=28%, E-value=2e-88, Identity=55%"; Hit description =ENSANGP00000008459 [Anopheles gambiae]
  misc_feature: Gene Ontology Annotation: Molecular function=15-hydroxyprostaglandin dehydrogenase (NAD+) activity; Cellular component=cellular_component unknown; Biological process=biological_process unknown
  misc_feature: Pfam annotation: Pfam_ID=ABC_membrane; Match level="Score=-7.3, E -value=0.0012, Copies=1"; Pfam description=ABC transporter transmembrane region
  misc_feature (276)..(276): Xaa can be any naturally occurring amino acid
  misc_feature (278)..(278): Xaa can be any naturally occurring amino acid
  misc_feature (292)..(292): Xaa can be any naturally occurring amino acid
  misc_feature (296)..(296): Xaa can be any naturally occurring amino acid
  misc_feature (300)..(300): Xaa can be any naturally occurring amino acid
  misc_feature (305)..(305): Xaa can be any naturally occurring amino acid
  misc_feature (307)..(308): Xaa can be any naturally occurring amino acid
GRVGKKLHATIFDNIITATMRFFDTNPGGRILNRFSKDMGCVDELLPKAILDSSQMLLSMCGSLLLIVIVNPYFLILIGALTVVFGFMRHVYLKSSKNIKRLEGIMRSPVFTHLRATIEGLTTIRAFGAQSTLMDEFDHHQDYHSGAWYMFIVSSNAFGFYLDCFCSLFLAALTFSLLLFGEAFNLKGGQVGLAITQATALTSLLQWGMRQSAEVTNQLMSVERVLEYQNLEKEPQPVVPQKPAKEWPQKGQITFIDTCLNNFEGGPLVLNILILXSXRKGVGSVVRTGAGXSSFXSALXRLPPXEXXIKIDDI

SEQ ID NO: 30367 - protein, 104 aa, Diabrotica virgifera
  misc_feature: Coding regions on vcDNA: vcDNA=SeqID_10064; Strand=-; Position=320-634
  misc_feature (7)..(13): Xaa can be any naturally occurring amino acid
LKVKPMXXXXXXXDIAESFHQTGKIKKKGRPSLNETVEKIVTHTKSRPHDITRKDNVGHWPIYGPKGRCRFCKNGYMTIMCQKCDMRLCFTPGKNCFFNFHNSP

SEQ ID NO: 30368 - protein, 201 aa, Diabrotica virgifera
  misc_feature: Coding regions on vcDNA: vcDNA=SeqID_10065; Strand=+; Position=168-853
  misc_feature: Homolog annotation: Hit_ID=XP_396634.1; Match level="QueryCoverage =99%, HitCoverage=59%, E-value=2e-62, Identity=61%"; Hit description =similar to cyclin D2 [Apis mellifera]
  misc_feature: Gene Ontology Annotation: Molecular function=cyclin-dependent protein kinase, intrinsic regulator activity; Cellular component=nucleus; Biological process=regulation of cell cycle
  misc_feature: Pfam annotation: Pfam_ID=Cyclin_N; Match level="Score=145.2, E-value =1.5e-40, Copies=1"; Pfam description=Cyclin, N-terminal domain
  misc_feature (162)..(162): Xaa can be any naturally occurring amino acid
  misc_feature (171)..(171): Xaa can be any naturally occurring amino acid
  misc_feature (175)..(175): Xaa can be any naturally occurring amino acid
  misc_feature (177)..(177): Xaa can be any naturally occurring amino acid
MDLYCCEKPENEVRAYDDPTILHDRVLKNLLKTEDRYVLPFNASLAKTQKEVTEEMRKIVAEWMMEVCEEQKCQDEVFSLAMNYMDRFLMCCSIMKSQLQLLGTTCLLLASKFRESTPLAGETLVYYTDHSVTKQHWWRWELLVLSQLKWDISAVTPHDFLXHLFNRLPPXTKKXTXSYEMVQKHAKTLITLCAREFTFFK

SEQ ID NO: 30369 - protein, 59 aa, Diabrotica virgifera
  misc_feature: Coding regions on vcDNA: vcDNA=SeqID_10066; Strand=-; Position=723-902
  misc_feature (4)..(4): Xaa can be any naturally occurring amino acid
  misc_feature (15)..(15): Xaa can be any naturally occurring amino acid
  misc_feature (20)..(21): Xaa can be any naturally occurring amino acid
  misc_feature (53)..(53): Xaa can be any naturally occurring amino acid
CKEXMYIKFPSYILXDIRRXXLISKKHTTTFSLCIILHAYLFDLLVFLGNLQXFVRKLK

SEQ ID NO: 30370 - protein, 202 aa, Diabrotica virgifera
  misc_feature: Coding regions on vcDNA: vcDNA=SeqID_10067; Strand=+; Position=207-815
  misc_feature: Homolog annotation: Hit_ID=EAL28092.1; Match level="QueryCoverage =97%, HitCoverage=40%, E-value=4e-18, Identity=35%"; Hit description =GA11424-PA [Drosophila pseudoobscura]
  misc_feature (88)..(96): Xaa can be any naturally occurring amino acid
  misc_feature (178)..(178): Xaa can be any naturally occurring amino acid
  misc_feature (185)..(191): Xaa can be any naturally occurring amino acid
MTALLIFMVGGTIIVWTSPAIVKMKSNDTSINPLGRPIETYEISKFMGTVGILAMGGALFLPKLADVIGRKKSLWVMAFFMFIGIVGXXXXXXXXXMIMCSTLTSIFFCGAMGILPMYLTEICEDHNRTKYGCLMSAFIPLGQLYTYLIGPVFSYTVFTILTAVPMIPFLVLFLFAPXSPVYSLXXXXXXXCLRALKSYGLI

SEQ ID NO: 30371 - protein, 24 aa, Diabrotica virgifera
  misc_feature: Coding regions on vcDNA: vcDNA=SeqID_10068; Strand=+; Position=2-76
IQHRGRNLYYRFELSNKITLLSLR

SEQ ID NO: 30372 - protein, 325 aa, Diabrotica virgifera
  misc_feature: Coding regions on vcDNA: vcDNA=SeqID_10069; Strand=+; Position=25-999
  misc_feature: Homolog annotation: Hit_ID=XP_314068.1; Match level="QueryCoverage =97%, HitCoverage=82%, E-value=1e-123, Identity=64%"; Hit description= ENSANGP00000015675 [Anopheles gambiae]
  misc_feature: Gene Ontology Annotation: Molecular function=structural molecule activity; Cellular component=nuclear pore; Biological process =protein-nucleus import
  misc_feature: Pfam annotation: Pfam_ID=WD40; Match level="Score=92.4, E-value=1.2e -24, Copies=4"; Pfam description=WD domain, G-beta repeat
  misc_feature (14)..(14): Xaa can be any naturally occurring amino acid
  misc_feature (234)..(240): Xaa can be any naturally occurring amino acid
  misc_feature (276)..(276): Xaa can be any naturally occurring amino acid
  misc_feature (291)..(291): Xaa can be any naturally occurring amino acid
VCSFSVWRLVYILXQEIHAEHKDLIHDVAYDYYGRRMATCSSDQFVKVWDQTSDGKWVLTSSWKAHSGSVWKVTWAHPEFGQVLATCSFDRTAAVWEEIVGELPGPGERGTRHWVRRTNLVDSRTSVTDVKFGPKSQGLQLATCSAEGIIRIYEAPDVMNLSQWTLQHEVQCKLPCSCLSWNPSLSKMHPQMIAVGSDDPNPANGGKVFIYEYNENSRRWTKLETISSVVDPVXXXXXXXNLGRSYHILAVATKDVRIINLTPVNDEQSIQSGVTXLDVETIAQFEDHNSXVWRVCWNLTGTVLCSLENDGCVRMVKMIYINSWK

SEQ ID NO: 30373 - protein, 297 aa, Diabrotica virgifera
  misc_feature: Coding regions on vcDNA: vcDNA=SeqID_10070; Strand=+; Position=58-948
  misc_feature: Homolog annotation: Hit_ID=XP_394508.1; Match level="QueryCoverage =47%, HitCoverage=19%, E-value=9e-32, Identity=48%"; Hit description =similar to zinc finger protein 62 homolog [Apis mellifera]
  misc_feature: Pfam annotation: Pfam_ID=zf-AD; Match level="Score=78.5, E-value=1.7e- 20, Copies=1"; Pfam description=Zinc-finger associated domain (zf-AD)
MNHNNNMLQLCRLCLVKDEVNIPIFEEQGDIRQIFLKISSCLPVKVSRDDQLPKKICDGCSYKLDMLYEFWNTSANAEKQLLTWLGEAGMTSQMTDGTISAVAQQIKPADAFVKQETIDPPDILKDDDDEDEEDKDYMKQEESSNNVEEPPPKRARRTAAVKAAIADDDSGEPMTKVEDDTDDSDNDDGPPFVDVPSTSADDQPGPSGVGKDGVEAPVIPTMDYQCRQCRAPFSTEADLQNHIECLKAHQVFCKHCFTFIRTRKGNSTRISLIPVFAREYREYALHINVFTPKPIKI

SEQ ID NO: 30374 - protein, 49 aa, Diabrotica virgifera
  misc_feature: Coding regions on vcDNA: vcDNA=SeqID_10071; Strand=-; Position=2-148
  misc_feature (10)..(16): Xaa can be any naturally occurring amino acid
  misc_feature (18)..(48): Xaa can be any naturally occurring amino acid
MFNLIRHCLXXXXXXXVXXXXXXXXXXXXXXXXXXXXXXXXXXXXXXXF

SEQ ID NO: 30375 - protein, 59 aa, Diabrotica virgifera
  misc_feature: Coding regions on vcDNA: vcDNA=SeqID_10072; Strand=+; Position=47-226
ILLLYYDNIGNKLFFYDLYSRVPGIIYKLRLYIATPIDDDLLIRFLHIPHCGIMYVYIV

SEQ ID NO: 30376 - protein, 201 aa, Diabrotica virgifera
  misc_feature: Coding regions on vcDNA: vcDNA=SeqID_10073; Strand=+; Position=2-607
  misc_feature: Homolog annotation: Hit_ID=XP_395577.1; Match level="QueryCoverage =100%, HitCoverage=59%, E-value=3e-56, Identity=45%"; Hit description= similar to ENSANGP00000021202 [Apis mellifera]
  misc_feature: Pfam annotation: Pfam_ID=KH_1; Match level="Score=75.0, E-value=2.1e -19, Copies=1"; Pfam description=KH domain
VQITFPKKGDPEESIIIITGYETNANNAKDDIMKIVNELNELVKEEISIDSNVHSRLIGARGRNIRKIMEDFNVDIKFPRDGDADENLVIITGQEESVLEAKDHLLNLAEEYLQDYTELQTRERLHTLSSHFEPPAAQNHNAHRNRDEPNNGFVVQGGPWEQQRAAAPNTASVTEFPSFRRNTEEPQSSPAPVAGAWGSRR

SEQ ID NO: 30377 - protein, 86 aa, Diabrotica virgifera
  misc_feature: Coding regions on vcDNA: vcDNA=SeqID_10074; Strand=+; Position=93-353
NVCGETLFIRTGVATAAHCDTDNYDYALGKKYFLVTSVEIYNSFVDPLDRHAQYIKISPDFVHPGYKGFIHRYVADLYLLITQKLF

SEQ ID NO: 30378 - protein, 24 aa, Diabrotica virgifera
  misc_feature: Coding regions on vcDNA: vcDNA=SeqID_10075; Strand=-; Position=0-71
  misc_feature (2)..(23): Xaa can be any naturally occurring amino acid
KXXXXXXXXXXXXXXXXXXXXXXP

SEQ ID NO: 30379 - protein, 238 aa, Diabrotica virgifera
  misc_feature: Coding regions on vcDNA: vcDNA=SeqID_10076; Strand=+; Position=2-718
  misc_feature (63)..(74): Xaa can be any naturally occurring amino acid
  misc_feature (166)..(176): Xaa can be any naturally occurring amino acid
TPIVLDPNKDYEIALRAFHSYNSIPNIENNKFYYYNDKNQLTKFDFPDGCYEIVDIEEYIQKXXXXXXXXXXXXIFSLKPNHNTLQCQIFSKYKISFKQPDSLGTVLGFSPAILPPGKTYSSDLPVRIIKVSSIRFECNISTGAFDGNRPGHTIYEFVIQSNPGYXXXXXXXXXXXLPVVPQRELTNITVLALDQEGRPVNFRGEESTLVLELRSRGKWGLVIRPSTGSKNVISCAAV

SEQ ID NO: 30380 - protein, 77 aa, Diabrotica virgifera
  misc_feature: Coding regions on vcDNA: vcDNA=SeqID_10077; Strand=-; Position=1-231
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(64): Xaa can be any naturally occurring amino acid
PFXXXXXXXXXXXTNLAHTGLNXXXXXXXXSNXXXXXXXXXXXXXXPTSRSXXXXXXXXXXXXXLRDNSVILFELSN

SEQ ID NO: 30381 - protein, 125 aa, Diabrotica virgifera
  misc_feature: Coding regions on vcDNA: vcDNA=SeqID_10078; Strand=-; Position=1-375
  misc_feature (1)..(125): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30382 - protein, 225 aa, Diabrotica virgifera
  misc_feature: Coding regions on vcDNA: vcDNA=SeqID_10079; Strand=+; Position=158-835
  misc_feature: Homolog annotation: Hit_ID=XP_313096.1; Match level="QueryCoverage =99%, HitCoverage=81%, E-value=5e-36, Identity=35%"; Hit description =ENSANGP00000012818 [Anopheles gambiae]
  misc_feature: Gene Ontology Annotation: Molecular function=tocopherol binding; Cellular component=cytosol; Biological process=transport
  misc_feature (86)..(91): Xaa can be any naturally occurring amino acid
MTFKEISVEEVYQNDNKLKKQDVLALEEWMKKQPHLPKATELQLAIFLHSSNYSNEMAKNVIESYFTMKTLCSDFLGNRTLHDDVXXXXXXTYVFSVLPKQALGGEKVVISKLMDTNLNSFTPLGMLKLMDVVLALFTHENGPPCGFQLVFDMQNSSLAHFLKVNPMLIKKFIYYLQDAMPIRLKHIHFIYPAFFLDKIFSLIKPMMKKELFELFIVHSDLKSLF

SEQ ID NO: 30383 - protein, 35 aa, Diabrotica virgifera
  misc_feature: Coding regions on vcDNA: vcDNA=SeqID_10080; Strand=-; Position=1-105
  misc_feature (2)..(35): Xaa can be any naturally occurring amino acid
KXXXXXXXXXXXXXXXXXXXXXXXXXXXXXXXXXX

SEQ ID NO: 30384 - protein, 299 aa, Diabrotica virgifera
  misc_feature: Coding regions on vcDNA: vcDNA=SeqID_10081; Strand=+; Position=3-899
  misc_feature: Homolog annotation: Hit_ID=XP_311854.1; Match level="QueryCoverage =100%, HitCoverage=48%, E-value=1e-135, Identity=79%"; Hit description=ENSANGP00000017600 [Anopheles gambiae]
  misc_feature: Gene Ontology Annotation: Molecular function=protein binding; Cellular component=cytoplasm; Biological process=synaptic vesicle priming
  misc_feature: Pfam annotation: Pfam_ID=Sec1; Match level="Score=114.8, E-value=2.1e- 31, Copies=1"; Pfam description=Sec1 family
RMVSACCKMHDISAEGITLVEDIMKKREPLGTMEAVYLITPSEKSVHALMNDFEPPRQMYRGAHVFFTEVCPEELFNELCKSCAARKIKTLKEINIAFLPYESQVFSLDSPDTFQCSYDPSFSAARNANMERMAEQIATLCATLGEYPHVRYRTDWERNVELAQLIQQKLDAYKADEPTMGEGPEKARSQLIILDRGFDCVSPLLHELTFQAMAYDLLPIENDVYKYEASAGVMKEVLLDENDELWVDLRHQHIAVVSQSVTKNLKKFTDSKRMTQSDKQSMKDLSTMIKKMPQYQKEL

SEQ ID NO: 30385 - protein, 75 aa, Diabrotica virgifera
  misc_feature: Coding regions on vcDNA: vcDNA=SeqID_10082; Strand=+; Position=286-510
CSDMPRYAMERSREHHRACIATTEYLHREIPDDMLNVAGSESTRRHWSSAEYPFQRGASIRQIVLTSARSLPAGE

SEQ ID NO: 30386 - protein, 98 aa, Diabrotica virgifera
  misc_feature: Coding regions on vcDNA: vcDNA=SeqID_10083; Strand=+; Position=225-521
  misc_feature (11)..(21): Xaa can be any naturally occurring amino acid
NVLIHLTFLSXXXXXXXXXXXQATVSLIQPSPPSTDRIILCQNRTGSSEKRKILRTFYVGGTDRAYCTFNIRLNETICALLKKEDLLFTIILFLNQEE

SEQ ID NO: 30387 - protein, 31 aa, Diabrotica virgifera
  misc_feature: Coding regions on vcDNA: vcDNA=SeqID_10084; Strand=-; Position=1-93
  misc_feature (1)..(31): Xaa can be any naturally occurring amino acid
XXXXXXXXXXXXXXXXXXXXXXXXXXXXXXX

SEQ ID NO: 30388 - protein, 80 aa, Diabrotica virgifera
  misc_feature: Coding regions on vcDNA: vcDNA=SeqID_10085; Strand=-; Position=1-240
  misc_feature (1)..(80): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30389 - protein, 185 aa, Diabrotica virgifera
  misc_feature: Coding regions on vcDNA: vcDNA=SeqID_10086; Strand=+; Position=327-881
  misc_feature: Homolog annotation: Hit_ID=NP_524466.1; Match level="QueryCoverage =97%, HitCoverage=41%, E-value=2e-59, Identity=67%"; Hit description =CG5212-PA [Drosophila melanogaster] gb|AAF56198.1| CG5212-PA [Drosophila melanogaster]
  misc_feature: Gene Ontology Annotation: Molecular function=protein binding; Biological process=Tl signaling pathway
  misc_feature: Pfam annotation: Pfam_ID=Pellino; Match level="Score=-37.6, E-value =6.4e-17, Copies=1"; Pfam description=Pellino
  misc_feature (144)..(144): Xaa can be any naturally occurring amino acid
  misc_feature (151)..(151): Xaa can be any naturally occurring amino acid
  misc_feature (154)..(154): Xaa can be any naturally occurring amino acid
  misc_feature (156)..(156): Xaa can be any naturally occurring amino acid
  misc_feature (161)..(161): Xaa can be any naturally occurring amino acid
MVKRSDGTESPILEETESANSEKPKLVKYGELVILGYNGFLPQGDRGRRRSKFVFCKRQVANGVKRLRHYVVRTPHSTQAILDATQHSISYTLSRNHAVIVEYTNDEDTDMFQIGRSSEAPIDFVVMDTIAGDKTGDTRVNQRXISRFACXDIXVXRNNPXIARIYAAGFDTLEIYFLGKIFKVA

SEQ ID NO: 30390 - protein, 79 aa, Diabrotica virgifera
  misc_feature: Coding regions on vcDNA: vcDNA=SeqID_10087; Strand=-; Position=2-238
  misc_feature (3)..(13): Xaa can be any naturally occurring amino acid
  misc_feature (16)..(26): Xaa can be any naturally occurring amino acid
  misc_feature (36)..(43): Xaa can be any naturally occurring amino acid
  misc_feature (46)..(59): Xaa can be any naturally occurring amino acid
  misc_feature (65)..(78): Xaa can be any naturally occurring amino acid
ILXXXXXXXXXXXPFXXXXXXXXXXXTNLAHTGLNXXXXXXXXSNXXXXXXXXXXXXXXPTSRSXXXXXXXXXXXXXXV

SEQ ID NO: 30391 - protein, 56 aa, Diabrotica virgifera
  misc_feature: Coding regions on vcDNA: vcDNA=SeqID_10088; Strand=-; Position=296-466
LYTFTSGKCLFVFSIAHYFSLTSFTGELCLEFIHFLRYLEIEKRYRHAVFGIMLLI

SEQ ID NO: 30392 - protein, 233 aa, Diabrotica virgifera
  misc_feature: Coding regions on vcDNA: vcDNA=SeqID_10089; Strand=-; Position=0-698
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(225): Xaa can be any naturally occurring amino acid
  misc_feature (228)..(232): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLVXXXXXV

SEQ ID NO: 30393 - protein, 66 aa, Diabrotica virgifera
  misc_feature: Coding regions on vcDNA: vcDNA=SeqID_10090; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
LFXXXXXXXXXXXTNLAHPGLNXXXXXXXXSNXXXXXXXXXXXXXXPTSRSXXXXXXXXXXXXXXV

SEQ ID NO: 30394 - protein, 75 aa, Diabrotica virgifera
  misc_feature: Coding regions on vcDNA: vcDNA=SeqID_10091; Strand=-; Position=542-769
  misc_feature (47)..(52): Xaa can be any naturally occurring amino acid
INTSKYTLYSIFHLIPCCWRHFINFILNVRPKKSVLVIWVATLLVHXXXXXXQKLINLLMEKVVYKLKYENSTFQ

SEQ ID NO: 30395 - protein, 85 aa, Diabrotica virgifera
  misc_feature: Coding regions on vcDNA: vcDNA=SeqID_10092; Strand=-; Position=178-435
  misc_feature (15)..(20): Xaa can be any naturally occurring amino acid
  misc_feature (68)..(74): Xaa can be any naturally occurring amino acid
YYFILMLCFVFLFSXXXXXXDIINPSYYLAFSFVTMLSFIFKSFLSTSSCRDSFCFCRVNFETTFGTXXXXXXXSSSNSDPVFYC

SEQ ID NO: 30396 - protein, 78 aa, Diabrotica virgifera
  misc_feature: Coding regions on vcDNA: vcDNA=SeqID_10093; Strand=-; Position=96-332
YGLSIYEIMKIQFVLSCSLQTFTSTFTVYYRTFFMFTKSTFLIPLVLLSILFCTSNSSAPDYNVICPSLKYAVHINKH

SEQ ID NO: 30397 - protein, 113 aa, Diabrotica virgifera
  misc_feature: Coding regions on vcDNA: vcDNA=SeqID_10094; Strand=+; Position=342-683
  misc_feature: Homolog annotation: Hit_ID=XP_318020.1; Match level="QueryCoverage =87%, HitCoverage=23%, E-value=5e-20, Identity=49%"; Hit description =ENSANGP00000024001 [Anopheles gambiae]
  misc_feature: Gene Ontology Annotation: Molecular function=ornithine-oxo-acid aminotransferase activity; Cellular component=mitochondrial matrix; Biological process=ornithine metabolism
  misc_feature (41)..(41): Xaa can be any naturally occurring amino acid
  misc_feature (65)..(65): Xaa can be any naturally occurring amino acid
  misc_feature (88)..(88): Xaa can be any naturally occurring amino acid
  misc_feature (98)..(98): Xaa can be any naturally occurring amino acid
VPKRLSIGKRRTHNHKYHPLPEALIIGQGVYICDDQGKRYXYYLRGYSANYYGLCHPKVVNSYTXTIESVLPHTSIEFFSNRLGQYAXVLTKLLGYDXVLPINNELKRDDTVC

SEQ ID NO: 30398 - protein, 159 aa, Diabrotica virgifera
  misc_feature: Coding regions on vcDNA: vcDNA=SeqID_10095; Strand=+; Position=1-480
  misc_feature: Homolog annotation: Hit_ID=XP_317233.1; Match level="QueryCoverage =77%, HitCoverage=8%, E-value=7e-16, Identity=42%"; Hit description =ENSANGP00000011945 [Anopheles gambiae]
  misc_feature: Gene Ontology Annotation: Biological process=axon guidance
  misc_feature (84)..(89): Xaa can be any naturally occurring amino acid
GNGSLGRSQDAEPERESSKRRKVDNSSKNSKHEERKSNSEQFQEKTEKRERSSKLKDKRDKMSEEEKEMRKERKLGRKRDRMEXXXXXXEMKRRRDEDKASKMVSPNRSSNGEIVEPSIHVREKHHRSTRDISPYQRDRSNEKSEPREKHRRGSENKRR

SEQ ID NO: 30399 - protein, 161 aa, Diabrotica virgifera
  misc_feature: Coding regions on vcDNA: vcDNA=SeqID_10096; Strand=-; Position=434-920
  misc_feature: Homolog annotation: Hit_ID=AAT40504.1; Match level="QueryCoverage =90%, HitCoverage=17%, E-value=1e-12, Identity=26%"; Hit description =putative polyprotein [Solanum demissum]
  misc_feature (15)..(21): Xaa can be any naturally occurring amino acid
  misc_feature (91)..(91): Xaa can be any naturally occurring amino acid
  misc_feature (111)..(111): Xaa can be any naturally occurring amino acid
RAISQLNSIIWDQHXXXXXXXRIYNTIIKSIVMYGSGVWQLKTTTERTLQATEMDYWRRAAGKSKLERINNERIREIKGVTHTIVEDIRVXWYRHVQRMPEHRLPKQILDXSPHGNRIRGRPRKSWREGIGREIRERDLDEDLWEDRDAWRLCIGRRRRTF

SEQ ID NO: 30400 - protein, 88 aa, Diabrotica virgifera
  misc_feature: Coding regions on vcDNA: vcDNA=SeqID_10097; Strand=-; Position=177-443
IIIVYSLPYTRQLEQSRPLQAVNSIMKFHRAIDRSRAVAMRQGTTQVVNNGPLQKSTTIARAVRVCRSVINDLSSPCTAALKIVMKMW

SEQ ID NO: 30401 - protein, 74 aa, Diabrotica virgifera
  misc_feature: Coding regions on vcDNA: vcDNA=SeqID_10098; Strand=+; Position=424-648
  misc_feature (30)..(36): Xaa can be any naturally occurring amino acid
GGIILYVTFIWLLGLCIVVSHLEICPTCTXXXXXXXVLIICFPMICLFEICLFIRSFDIFDIQNFVLFSEMLCF

SEQ ID NO: 30402 - protein, 189 aa, Diabrotica virgifera
  misc_feature: Coding regions on vcDNA: vcDNA=SeqID_10099; Strand=+; Position=4-573
  misc_feature (43)..(51): Xaa can be any naturally occurring amino acid
  misc_feature (56)..(63): Xaa can be any naturally occurring amino acid
APSRGGRRRREERKLFKGGEGRKGKEEEGGKRRRRERRRRQKXXXXXXXXXGREGXXXXXXXXREREGKGKKDRPQNNTEDNKQRSGGECEIRERRGTTHGRQTGKKGEKYRRPTDRPQEHTQRDDHKSRSAKKDQTARQGQGKRGSSACSQIDVARRERIDRRSSCSVRWSRLCITSRICRYVHNSHR

SEQ ID NO: 30403 - protein, 65 aa, Diabrotica virgifera
  misc_feature: Coding regions on vcDNA: vcDNA=SeqID_10100; Strand=+; Position=6-203
  misc_feature (3)..(9): Xaa can be any naturally occurring amino acid
GPXXXXXXXVNILILRENIVFRSKRSLFTDPCVSRLISSKLSPYYFRCYESYNIQSLVLTQKYPT

SEQ ID NO: 30404 - protein, 200 aa, Diabrotica virgifera
  misc_feature: Coding regions on vcDNA: vcDNA=SeqID_10101; Strand=-; Position=1-600
  misc_feature (2)..(9): Xaa can be any naturally occurring amino acid
  misc_feature (14)..(127): Xaa can be any naturally occurring amino acid
  misc_feature (129)..(199): Xaa can be any naturally occurring amino acid
KXXXXXXXXQTDVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXXXXXM

SEQ ID NO: 30405 - protein, 51 aa, Diabrotica virgifera
  misc_feature: Coding regions on vcDNA: vcDNA=SeqID_10102; Strand=-; Position=1-153
  misc_feature (3)..(51): Xaa can be any naturally occurring amino acid
QKXXXXXXXXXXXXXXXXXXXXXXXXXXXXXXXXXXXXXXXXXXXXXXXXX

SEQ ID NO: 30406 - protein, 53 aa, Diabrotica virgifera
  misc_feature: Coding regions on vcDNA: vcDNA=SeqID_10103; Strand=+; Position=93-254
NVEQEKPVTNQGLRASILSPAYEKDVFLYASLKARLATRVLERARHFDRFTVA

SEQ ID NO: 30407 - protein, 66 aa, Diabrotica virgifera
  misc_feature: Coding regions on vcDNA: vcDNA=SeqID_10104; Strand=-; Position=112-312
IDSFIVVISVYVNPYFSSSEYISLRYIFHNHNRYFLAVLYSKIIDISLVSTNNIITTWFKIIGFAV

SEQ ID NO: 30408 - protein, 61 aa, Diabrotica virgifera
  misc_feature: Coding regions on vcDNA: vcDNA=SeqID_10105; Strand=-; Position=2-184
  misc_feature (8)..(9): Xaa can be any naturally occurring amino acid
  misc_feature (18)..(61): Xaa can be any naturally occurring amino acid
VAIFIIDXXSPNKITLLXXXXXXXXXXXXXXXXXXXXXXXXXXXXXXXXXXXXXXXXXXXX

SEQ ID NO: 30409 - protein, 239 aa, Diabrotica virgifera
  misc_feature: Coding regions on vcDNA: vcDNA=SeqID_10106; Strand=-; Position=2-718
  misc_feature (1)..(39): Xaa can be any naturally occurring amino acid
  misc_feature (47)..(56): Xaa can be any naturally occurring amino acid
  misc_feature (61)..(182): Xaa can be any naturally occurring amino acid
  misc_feature (185)..(223): Xaa can be any naturally occurring amino acid
  misc_feature (225)..(239): Xaa can be any naturally occurring amino acid
XXXXXXXXXXXXXXXXXXXXXXXXXXXXXXXXXXXXXXXFKLIQWAXXXXXXXXXXVFLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFXXXXXXXXXXXXXXXXXXXXXXXXXXXXXXXXXXXXXXXGXXXXXXXXXXXXXXX

SEQ ID NO: 30410 - protein, 258 aa, Diabrotica virgifera
  misc_feature: Coding regions on vcDNA: vcDNA=SeqID_10107; Strand=+; Position=109-884
  misc_feature: Homolog annotation: Hit_ID=NP_956779.1; Match level="QueryCoverage =96%, HitCoverage=53%, E-value=5e-38, Identity=37%"; Hit description =hypothetical protein MGC63730 [Danio rerio] gb|AAH55224.1| Hypothetical protein MGC63730 [Danio
  misc_feature: Pfam annotation: Pfam_ID=zf-CCCH; Match level="Score=9.5, E-value =0.063, Copies=1"; Pfam description=Zinc finger C-x8-C-x5-C-x3-H type (and
  misc_feature (164)..(164): Xaa can be any naturally occurring amino acid
MDPEELNLYQQQLVQINNALCSCSEGPEKQELLTLKASIEELLELTREDSSEKLKAGGTNSIDDEFAAFMEEMEKEGAVETKNIKDSSECNKEINLEEIEGKKCRAPHHHHWGNVTYHNAMICSVVSNENEELKVRVLFINPTHQEMLPCPFYYNSDCKFSEEXKFSHGEIVPYSSLQDYVEPNFDQLEVGNSVLAKRNNNLWYRARIKSIHGDKCLVQFDSNRKEQEVVLEHICPLDNCNGSSDDDNDEDDTENLKE

SEQ ID NO: 30411 - protein, 45 aa, Diabrotica virgifera
  misc_feature: Coding regions on vcDNA: vcDNA=SeqID_10108; Strand=+; Position=52-189
TYYLLNDTSKDSAKTTIVCNNESLVPLLVDIIHTDYFIMYIVVSE

SEQ ID NO: 30412 - protein, 270 aa, Diabrotica virgifera
  misc_feature: Coding regions on vcDNA: vcDNA=SeqID_10109; Strand=+; Position=3-815
  misc_feature: Homolog annotation: Hit_ID=XP_535296.1; Match level="QueryCoverage =91%, HitCoverage=31%, E-value=1e-58, Identity=48%"; Hit description =PREDICTED: similar to Bardet-Biedl syndrome 2 protein [Canis familiaris]
  misc_feature: Gene Ontology Annotation: Molecular function=molecular_function unknown; Cellular component=cellular_component unknown; Biological process=biological_process unknown
YTTTKVLTTNKGSESDQNLIRELLAQKQSLLMELKHYDVNTKYNENIFYETESYENSGVIPANTRLELAISTNSTDPKPHVELYLCTNNSTIIRATIIFAEGIFSGETHVIHPPVSKLKSQLLVPLFLPKDSPVDIHVKVLIGYPNSCQFHVYEITRQLPRFSMYSLKEPGRNSRSDSYVEFKINERLQRICMWINQNFLLPNDIEFDSGPNLTLSLKCLRNDTDLDLVFEISGKITIYTSNISLAADIIQSIAAYLNIGNLEKRTTGSV

SEQ ID NO: 30413 - protein, 238 aa, Diabrotica virgifera
  misc_feature: Coding regions on vcDNA: vcDNA=SeqID_10110; Strand=-; Position=1-714
  misc_feature (3)..(10): Xaa can be any naturally occurring amino acid
  misc_feature (14)..(14): Xaa can be any naturally occurring amino acid
  misc_feature (17)..(29): Xaa can be any naturally occurring amino acid
  misc_feature (31)..(31): Xaa can be any naturally occurring amino acid
  misc_feature (34)..(236): Xaa can be any naturally occurring amino acid
LVXXXXXXXXNLKXKIXXXXXXXXXXXXXPXHSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRY

SEQ ID NO: 30414 - protein, 304 aa, Diabrotica virgifera
  misc_feature: Coding regions on vcDNA: vcDNA=SeqID_10111; Strand=+; Position=79-990
  misc_feature: Homolog annotation: Hit_ID=CAG31545.1; Match level="QueryCoverage =75%, HitCoverage=45%, E-value=1e-17, Identity=32%"; Hit description =hypothetical protein [Gallus gallus]
  misc_feature: Pfam annotation: Pfam_ID=dsrm; Match level="Score=37.2, E-value=4.8e -08, Copies=1"; Pfam description=Double-stranded RNA binding motif
  misc_feature (117)..(126): Xaa can be any naturally occurring amino acid
  misc_feature (215)..(223): Xaa can be any naturally occurring amino acid
  misc_feature (263)..(263): Xaa can be any naturally occurring amino acid
  misc_feature (265)..(265): Xaa can be any naturally occurring amino acid
  misc_feature (275)..(275): Xaa can be any naturally occurring amino acid
MKNQLVFFLHIIFITTVTSKTHSVKDLKNVFKDELCIEGNINSIYSKKTDTVVVKSTKTEGLLNLTSVGTVQESEKPVLSRLNELVGFNQIDYYFKLENEEGPPHNRLFTVELTLGXXXXXXXXXXLKKAKQEAATKALEKTEYDFPEIKNNSPEDIEELTPTVLLNNIASKLGVGVTYYLLDKNKEEILHSNIIMTDKKKSYLQRLNASIYNDXXXXXXXXXESTKGPFRLKLKFADYTFFTTSHSIQGGRHEVAVQALEYXGXKQDSLDIACXQEGSEAEMQQNKDYLKSPISQVYEEAEKR

SEQ ID NO: 30415 - protein, 297 aa, Diabrotica virgifera
  misc_feature: Coding regions on vcDNA: vcDNA=SeqID_10112; Strand=-; Position=1-891
  misc_feature (1)..(17): Xaa can be any naturally occurring amino acid
  misc_feature (21)..(21): Xaa can be any naturally occurring amino acid
  misc_feature (24)..(297): Xaa can be any naturally occurring amino acid
XXXXXXXXXXXXXXXXXHPNXIIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30416 - protein, 70 aa, Diabrotica virgifera
  misc_feature: Coding regions on vcDNA: vcDNA=SeqID_10113; Strand=-; Position=153-365
  misc_feature (5)..(17): Xaa can be any naturally occurring amino acid
  misc_feature (49)..(56): Xaa can be any naturally occurring amino acid
TSLMXXXXXXXXXXXXXINKVNLSHKSLDIDNKDFQVIAIKFSKIIISXXXXXXXXSLTIAINKSITNKL

SEQ ID NO: 30417 - protein, 73 aa, Diabrotica virgifera
  misc_feature: Coding regions on vcDNA: vcDNA=SeqID_10114; Strand=-; Position=30-251
KKEWLYKSHIKITQIRGYSKFKWNQVLFFYLIFLFPISKITYVCYLLNKYQERVKKLKALVGVSTEAKISYSK

SEQ ID NO: 30418 - protein, 241 aa, Diabrotica virgifera
  misc_feature: Coding regions on vcDNA: vcDNA=SeqID_10115; Strand=+; Position=2-724
  misc_feature (1)..(232): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKTRNPYRVL

SEQ ID NO: 30419 - protein, 309 aa, Diabrotica virgifera
  misc_feature: Coding regions on vcDNA: vcDNA=SeqID_10116; Strand=-; Position=1-927
  misc_feature (3)..(91): Xaa can be any naturally occurring amino acid
  misc_feature (93)..(309): Xaa can be any naturally occurring amino acid
KNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30420 - protein, 126 aa, Diabrotica virgifera
  misc_feature: Coding regions on vcDNA: vcDNA=SeqID_10117; Strand=-; Position=0-377
  misc_feature (2)..(15): Xaa can be any naturally occurring amino acid
  misc_feature (18)..(33): Xaa can be any naturally occurring amino acid
  misc_feature (50)..(103): Xaa can be any naturally occurring amino acid
  misc_feature (105)..(125): Xaa can be any naturally occurring amino acid
GXXXXXXXXXXXXXXAYXXXXXXXXXXXXXXXXFPPGGGPFFGGPTKKRXXXXXXXXXXXXXXXXXXXXXXXXXXXXXXXXXXXXXXXXXXXXXXXXXXXXXXFXXXXXXXXXXXXXXXXXXXXXR

SEQ ID NO: 30421 - protein, 74 aa, Diabrotica virgifera
  misc_feature: Coding regions on vcDNA: vcDNA=SeqID_10118; Strand=-; Position=110-334
LFNNVIQYIILALVLLLRLSCYFGVFGPSRASIIGILIPFSSMGHFPLDTLSSFSLIMAILLLVLPMLVYRCSC

SEQ ID NO: 30422 - protein, 45 aa, Diabrotica virgifera
  misc_feature: Coding regions on vcDNA: vcDNA=SeqID_10119; Strand=+; Position=1-135
  misc_feature (1)..(24): Xaa can be any naturally occurring amino acid
  misc_feature (27)..(44): Xaa can be any naturally occurring amino acid
XXXXXXXXXXXXXXXXXXXXXXXXVFXXXXXXXXXXXXXXXXXXG

SEQ ID NO: 30423 - protein, 31 aa, Diabrotica virgifera
  misc_feature: Coding regions on vcDNA: vcDNA=SeqID_10120; Strand=-; Position=163-258
  misc_feature: Homolog annotation: Hit_ID=DAA01875.1; Match level="QueryCoverage =100%, HitCoverage=21%, E-value=9e-09, Identity=90%"; Hit description= TPA: troponin C type I [Apis mellifera]
  misc_feature: Pfam annotation: Pfam_ID=efhand; Match level="Score=34.4, E-value =3.3e-07, Copies=1"; Pfam description=EF hand
DEGLDMMIEEIDTDGSGTVDFDEFMEMMTGE

SEQ ID NO: 30424 - protein, 133 aa, Diabrotica virgifera
  misc_feature: Coding regions on vcDNA: vcDNA=SeqID_10121; Strand=+; Position=752 -1153
  misc_feature (31)..(40): Xaa can be any naturally occurring amino acid
  misc_feature (68)..(74): Xaa can be any naturally occurring amino acid
  misc_feature (76)..(82): Xaa can be any naturally occurring amino acid
  misc_feature (89)..(95): Xaa can be any naturally occurring amino acid
  misc_feature (103)..(119): Xaa can be any naturally occurring amino acid
  misc_feature (121)..(128): Xaa can be any naturally occurring amino acid
LLVHKLSRLSTVLFSVALFLFCSFYYTQKWXXXXXXXXXXRTDICRIIVLSHWFKWAFLLKSLEPKLXXXXXXXPXXXXXXXPPRLLFXXXXXXXFSLFLSEXXXXXXXXXXXXXXXXXPXXXXXXXXEKKDF

SEQ ID NO: 30425 - protein, 263 aa, Diabrotica virgifera
  misc_feature: Coding regions on vcDNA: vcDNA=SeqID_10122; Strand=+; Position=2-793
  misc_feature (1)..(15): Xaa can be any naturally occurring amino acid
  misc_feature (17)..(219): Xaa can be any naturally occurring amino acid
  misc_feature (222)..(238): Xaa can be any naturally occurring amino acid
  misc_feature (243)..(243): Xaa can be any naturally occurring amino acid
  misc_feature (245)..(245): Xaa can be any naturally occurring amino acid
  misc_feature (249)..(249): Xaa can be any naturally occurring amino acid
  misc_feature (252)..(260): Xaa can be any naturally occurring amino acid
XXXXXXXXXXXXXXXTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGMXXXXXXXXXXXXXXXXXIFKLXAXIFLXDEXXXXXXXXXNSF

SEQ ID NO: 30426 - protein, 260 aa, Diabrotica virgifera
  misc_feature: Coding regions on vcDNA: vcDNA=SeqID_10123; Strand=+; Position=1-780
  misc_feature (1)..(15): Xaa can be any naturally occurring amino acid
  misc_feature (18)..(55): Xaa can be any naturally occurring amino acid
  misc_feature (58)..(211): Xaa can be any naturally occurring amino acid
  misc_feature (214)..(219): Xaa can be any naturally occurring amino acid
  misc_feature (224)..(247): Xaa can be any naturally occurring amino acid
  misc_feature (249)..(249): Xaa can be any naturally occurring amino acid
  misc_feature (251)..(251): Xaa can be any naturally occurring amino acid
XXXXXXXXXXXXXXXYLXXXXXXXXXXXXXXXXXXXXXXXXXXXXXXXXXXXXXXRNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNHXXXXXXAGCEXXXXXXXXXXXXXXXXXXXXXXXXIXLXDERPPIEFY

SEQ ID NO: 30427 - protein, 254 aa, Diabrotica virgifera
  misc_feature: Coding regions on vcDNA: vcDNA=SeqID_10124; Strand=-; Position=1-762
  misc_feature (5)..(237): Xaa can be any naturally occurring amino acid
  misc_feature (239)..(254): Xaa can be any naturally occurring amino acid
GFSSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXX

SEQ ID NO: 30428 - protein, 51 aa, Diabrotica virgifera
  misc_feature: Coding regions on vcDNA: vcDNA=SeqID_10125; Strand=+; Position=166-321
  misc_feature (2)..(8): Xaa can be any naturally occurring amino acid
PXXXXXXXKCNYMLKRNLSNLSGLWRRPILNQANSYYITTSKLLRVCPNFI

SEQ ID NO: 30429 - protein, 136 aa, Diabrotica virgifera
  misc_feature: Coding regions on vcDNA: vcDNA=SeqID_10126; Strand=+; Position=24-434
LQFKNKMNKKTLADKISSLLTTTPDELDPEDNYEDDTTAKLNTEYPQEHGEETNQGSKFRKDNIDLLADVDERYAGKKGSRRHLNPDNDSSEFSESDNDVEGNNYFSYIFNLLAAKGIFKFHPHIPRLFKLSLYVV

SEQ ID NO: 30430 - protein, 233 aa, Diabrotica virgifera
  misc_feature: Coding regions on vcDNA: vcDNA=SeqID_10127; Strand=+; Position=32-730
  misc_feature: Homolog annotation: Hit_ID=AAQ24500.1; Match level="QueryCoverage =91%, HitCoverage=71%, E-value=1e-60, Identity=55%"; Hit description =ADP/ATP translocase [Apis mellifera] ref|XP_393120.1| ADP/ATP translocase [Apis mellifera]
  misc_feature: Gene Ontology Annotation: Molecular function=adenine transporter activity; Cellular component=integral to plasma membrane; Biological process=transport
  misc_feature: Pfam annotation: Pfam_ID=Mito_carr; Match level="Score=56.7, E-value =6.6e-14, Copies=2"; Pfam description=Mitochondrial carrier protein
  misc_feature (114)..(114): Xaa can be any naturally occurring amino acid
  misc_feature (128)..(128): Xaa can be any naturally occurring amino acid
  misc_feature (188)..(188): Xaa can be any naturally occurring amino acid
QILYHILLRKDLKEYHDKPLADTDDFINDILAAGISAASANTCERPIERVKVLLLAQHISEDIGDDQRYKGMVHCFEQIPEEEDGLAYCGDNTGNVLRYFPTLALNYAYKDKYXQIFLSETHYRTQFXRNFLCNWASGGAAVCTSLCFEYPLDIARTNVAADVGEGDVEGEFSGLGNCLVDDFLADVXRGLYGALGGTILGIVIYRAAYYTVYDTVDDIMTDPHNTPRVIAWT

SEQ ID NO: 30431 - protein, 275 aa, Diabrotica virgifera
  misc_feature: Coding regions on vcDNA: vcDNA=SeqID_10128; Strand=-; Position=2-826
  misc_feature (13)..(13): Xaa can be any naturally occurring amino acid
  misc_feature (20)..(20): Xaa can be any naturally occurring amino acid
  misc_feature (24)..(24): Xaa can be any naturally occurring amino acid
  misc_feature (32)..(45): Xaa can be any naturally occurring amino acid
  misc_feature (48)..(48): Xaa can be any naturally occurring amino acid
  misc_feature (50)..(275): Xaa can be any naturally occurring amino acid
SNIESQSLYRLTXPINYAVXPKVXYSYNQKIXXXXXXXXXXXXXXLNXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30432 - protein, 70 aa, Diabrotica virgifera
  misc_feature: Coding regions on vcDNA: vcDNA=SeqID_10129; Strand=-; Position=188-400
  misc_feature (3)..(34): Xaa can be any naturally occurring amino acid
  misc_feature (36)..(48): Xaa can be any naturally occurring amino acid
PPXXXXXXXXXXXXXXXXXXXXXXXXXXXXXXXXGXXXXXXXXXXXXXRSPPGSPPRLTSDQVKFKSRPD

SEQ ID NO: 30433 - protein, 94 aa, Diabrotica virgifera
  misc_feature: Coding regions on vcDNA: vcDNA=SeqID_10130; Strand=+; Position=234-518
EPKIRFDRPKRIGVGLCDVIERRSHWRTWLVEGGGFGGRVTSWLSISTDSYFADSYFLQQTLQIWTHHSIVLHHIVNVYNLYVLFAILTYFLLL

SEQ ID NO: 30434 - protein, 58 aa, Diabrotica virgifera
  misc_feature: Coding regions on vcDNA: vcDNA=SeqID_10131; Strand=-; Position=1-174
  misc_feature (4)..(41): Xaa can be any naturally occurring amino acid
  misc_feature (44)..(58): Xaa can be any naturally occurring amino acid
TISXXXXXXXXXXXXXXXXXXXXXXXXXXXXXXXXXXXXXXEVXXXXXXXXXXXXXXX

SEQ ID NO: 30435 - protein, 56 aa, Diabrotica virgifera
  misc_feature: Coding regions on vcDNA: vcDNA=SeqID_10132; Strand=-; Position=358-528
YHLYCYDNLHSISNCNDYIWRYILVNITRAFHVLRICAPINSLLVILLMNFFTYIL

SEQ ID NO: 30436 - protein, 89 aa, Diabrotica virgifera
  misc_feature: Coding regions on vcDNA: vcDNA=SeqID_10133; Strand=+; Position=7-276
  misc_feature: Homolog annotation: Hit_ID=EAL31982.1; Match level="QueryCoverage =79%, HitCoverage=16%, E-value=1e-17, Identity=62%"; Hit description =GA21484-PA [Drosophila pseudoobscura]
  misc_feature: Gene Ontology Annotation: Molecular function=dolichyl-diphospho -oligosaccharide-protein glycosyltransferase activity; Cellular component=endoplasmic reticulum
  misc_feature (9)..(16): Xaa can be any naturally occurring amino acid
MVDRCEKYXXXXXXXXLILFSAIVVCNAQGPTLVLLDNQVIKETHSIFFRSLQERGYTLTFKIADDSSLLLSKYGEYLYKKEATLSPLK

SEQ ID NO: 30437 - protein, 71 aa, Diabrotica virgifera
  misc_feature: Coding regions on vcDNA: vcDNA=SeqID_10134; Strand=+; Position=100-315
  misc_feature: Homolog annotation: Hit_ID=NP_725863.1; Match level="QueryCoverage =85%, HitCoverage=5%, E-value=5e-09, Identity=45%"; Hit description =CG7097-PA, isoform A [Drosophila melanogaster] gb|AAF57595.1| CG7097- PA, isoform A [Drosophila
MLRVTHGDAYEDKRISTMVFVVVQEINVKAEDDDAIVEQEILMMRDCRPPNIRSKLWSYSRKDKMKDKSRN

SEQ ID NO: 30438 - protein, 62 aa, Diabrotica virgifera
  misc_feature: Coding regions on vcDNA: vcDNA=SeqID_10135; Strand=+; Position=431-619
  misc_feature (47)..(56): Xaa can be any naturally occurring amino acid
LLYSLLYNTASLTVFSVSGMLIRRYARKSLRKFFKKLSLQFQKFWDXXXXXXXXXXDCRSRY

SEQ ID NO: 30439 - protein, 263 aa, Diabrotica virgifera
  misc_feature: Coding regions on vcDNA: vcDNA=SeqID_10136; Strand=+; Position=157-945
  misc_feature: Homolog annotation: Hit_ID=NP_006586.1; Match level="QueryCoverage =97%, HitCoverage=50%, E-value=1e-42, Identity=39%"; Hit description =apoptosis inhibitor 5 [Homo sapiens] gb|AAQ76714.1| migration -inducing protein MIG8 [Homo
  misc_feature: Gene Ontology Annotation: Molecular function=apoptosis inhibitor activity; Cellular component=cellular_component unknown; Biological process=anti-apoptosis
  misc_feature: Pfam annotation: Pfam_ID=HEAT; Match level="Score=17.0, E-value =0.057, Copies=1"; Pfam description=HEAT repeat
  misc_feature (227)..(227): Xaa can be any naturally occurring amino acid
MADKFEELYQKYNLLSSAKENITELSDEYLECIEHAKGTDKEKKLAAQIIAQYFKHFPQHNEKALSAVFDLCEDGDTSIRISAIMFLPMLCKHSKEIATVVADILAQLMILLDQQQEFNVTCNSLDQVFKEYPLQTLKALFAQIYAAEPTTRENAVKYIYKKMIKLDDKVTAICTDLLIEEGKKILQVSTVTEFLIIIPFFMNTKYSKTAIGQQELANLIAHRADIXQEFDSKDSLFCDRLIICTDHVLPIFQCTVESTEYVK

SEQ ID NO: 30440 - protein, 117 aa, Diabrotica virgifera
  misc_feature: Coding regions on vcDNA: vcDNA=SeqID_10137; Strand=+; Position=109-462
  misc_feature: Homolog annotation: Hit_ID=NP_523893.1; Match level="QueryCoverage =91%, HitCoverage=33%, E-value=3e-30, Identity=55%"; Hit description =CG2101-PA [Drosophila melanogaster] gb|AAF47688.1| CG2101-PA [Drosophila melanogaster]
  misc_feature (23)..(28): Xaa can be any naturally occurring amino acid
  misc_feature (52)..(52): Xaa can be any naturally occurring amino acid
VCPRSFHPASVPLPVRQGYTKKXXXXXXYANAELIKIPNFLHLTPPVIERQXKALKQICTPWARALDTDEKCEKHFPFELTISDYCFSSPSIKKPLAIILTMRFKLKTLILNQRENG

SEQ ID NO: 30441 - protein, 39 aa, Diabrotica virgifera
  misc_feature: Coding regions on vcDNA: vcDNA=SeqID_10138; Strand=+; Position=3-119
  misc_feature (16)..(22): Xaa can be any naturally occurring amino acid
  misc_feature (34)..(34): Xaa can be any naturally occurring amino acid
SPPSFDTTTLVIIAPXXXXXXXDHEDFHCTIFPXRRRFG

SEQ ID NO: 30442 - protein, 58 aa, Diabrotica virgifera
  misc_feature: Coding regions on vcDNA: vcDNA=SeqID_10139; Strand=+; Position=1-174
  misc_feature (1)..(15): Xaa can be any naturally occurring amino acid
  misc_feature (18)..(55): Xaa can be any naturally occurring amino acid
XXXXXXXXXXXXXXXYLXXXXXXXXXXXXXXXXXXXXXXXXXXXXXXXXXXXXXXRNV

SEQ ID NO: 30443 - protein, 92 aa, Diabrotica virgifera
  misc_feature: Coding regions on vcDNA: vcDNA=SeqID_10140; Strand=-; Position=201-479
  misc_feature (3)..(12): Xaa can be any naturally occurring amino acid
  misc_feature (32)..(39): Xaa can be any naturally occurring amino acid
QLXXXXXXXXXXSLQVLFHLTGGNKYKCLSSXXXXXXXXILEIFVQVFVELKYTYLLTIHDLINIYKQKEKGDILNLQVAIYNDDEIFWIRS

SEQ ID NO: 30444 - protein, 199 aa, Diabrotica virgifera
  misc_feature: Coding regions on vcDNA: vcDNA=SeqID_10141; Strand=+; Position=2-601
  misc_feature (7)..(15): Xaa can be any naturally occurring amino acid
  misc_feature (17)..(54): Xaa can be any naturally occurring amino acid
  misc_feature (59)..(118): Xaa can be any naturally occurring amino acid
  misc_feature (126)..(179): Xaa can be any naturally occurring amino acid
  misc_feature (187)..(194): Xaa can be any naturally occurring amino acid
VRESFLXXXXXXXXXTXXXXXXXXXXXXXXXXXXXXXXXXXXXXXXXXXXXXXXNRNRXXXXXXXXXXXXXXXXXXXXXXXXXXXXXXXXXXXXXXXXXXXXXXXXXXXXXXXXXXXXFKIRYYFXXXXXXXXXXXXXXXXXXXXXXXXXXXXXXXXXXXXXXXXXXXXXXXXXXXXXXVIKNTSFXXXXXXXXAHRLI

SEQ ID NO: 30445 - protein, 269 aa, Diabrotica virgifera
  misc_feature: Coding regions on vcDNA: vcDNA=SeqID_10142; Strand=+; Position=68-877
  misc_feature: Homolog annotation: Hit_ID=P31816; Match level="QueryCoverage=90%, HitCoverage=93%, E-value=5e-92, Identity=73%"; Hit description =Tropomyosin pir||A60364 tropomyosin - migratory locust prf||1709237A tropomyosin
  misc_feature: Gene Ontology Annotation: Molecular function=molecular_function unknown; Cellular component=muscle thin filament tropomyosin; Biological process=pole plasm oskar mRNA localization
  misc_feature: Pfam annotation: Pfam_ID=Tropomyosin; Match level="Score=361.1, E -value=1.5e-105, Copies=1"; Pfam description=Tropomyosin
  misc_feature (14)..(14): Xaa can be any naturally occurring amino acid
  misc_feature (34)..(40): Xaa can be any naturally occurring amino acid
  misc_feature (67)..(74): Xaa can be any naturally occurring amino acid
  misc_feature (188)..(199): Xaa can be any naturally occurring amino acid
VLSFCPLARKQHPXALDRAAHNEQLAKDANLRAXXXXXXXRSLQKKIQAIENDLDQTQEQLTQVNGXXXXXXXXLQNAESEVAALNRRIQLLEEDLERSEERLATATAKLAEASQAADESERQRKVLENRSLADEERMDALENQLKEARFLAEEADKKYDEVARKLAMVEADLERAEERAEAGESKIXXXXXXXXXXXXKNLTTRLKEAEARAEFAERSVQKLQKEVDRLEDELVAEKERYKEIGDDLDTAFFELILYLCVLINPVFEV

SEQ ID NO: 30446 - protein, 90 aa, Diabrotica virgifera
  misc_feature: Coding regions on vcDNA: vcDNA=SeqID_10143; Strand=-; Position=2-271
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(90): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXX

SEQ ID NO: 30447 - protein, 53 aa, Diabrotica virgifera
  misc_feature: Coding regions on vcDNA: vcDNA=SeqID_10144; Strand=-; Position=1-159
  misc_feature (17)..(17): Xaa can be any naturally occurring amino acid
LRSLKFKVDRLIYSCTXYKLYPPSSRILLSIELSIKYAVSLRYLFYNQKNGIK

SEQ ID NO: 30448 - protein, 66 aa, Diabrotica virgifera; identical to SEQ ID NO: 26808
  misc_feature: Coding regions on vcDNA: vcDNA=SeqID_10145; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 30449 - protein, 74 aa, Diabrotica virgifera
  misc_feature: Coding regions on vcDNA: vcDNA=SeqID_10146; Strand=-; Position=147-371
  misc_feature (4)..(10): Xaa can be any naturally occurring amino acid
  misc_feature (32)..(38): Xaa can be any naturally occurring amino acid
MTDXXXXXXXHAFFRIKRVKTKIYQFCRSTFXXXXXXXYLHILMPCSKKLKTDCIKYINTPNHCVGMTNLIIDT

SEQ ID NO: 30450 - protein, 117 aa, Diabrotica virgifera
  misc_feature: Coding regions on vcDNA: vcDNA=SeqID_10147; Strand=-; Position=1-351
  misc_feature (2)..(11): Xaa can be any naturally occurring amino acid
  misc_feature (15)..(21): Xaa can be any naturally occurring amino acid
  misc_feature (24)..(30): Xaa can be any naturally occurring amino acid
  misc_feature (32)..(117): Xaa can be any naturally occurring amino acid
KXXXXXXXXXXQKIXXXXXXXEKXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30451 - protein, 65 aa, Diabrotica virgifera
  misc_feature: Coding regions on vcDNA: vcDNA=SeqID_10148; Strand=+; Position=2-196
  misc_feature (2)..(15): Xaa can be any naturally occurring amino acid
  misc_feature (26)..(34): Xaa can be any naturally occurring amino acid
  misc_feature (38)..(38): Xaa can be any naturally occurring amino acid
  misc_feature (55)..(63): Xaa can be any naturally occurring amino acid
NXXXXXXXXXXXXXXRPRCWIKFIIXXXXXXXXXFDFXILHDLSLNRCEPRWFLXXXXXXXXXER

SEQ ID NO: 30452 - protein, 72 aa, Diabrotica virgifera
  misc_feature: Coding regions on vcDNA: vcDNA=SeqID_10149; Strand=-; Position=3-218
  misc_feature: Homolog annotation: Hit_ID=AAV91469.1; Match level="QueryCoverage =100%, HitCoverage=38%, E-value=5e-31, Identity=90%"; Hit description= ribosomal protein 31 [Lonomia obliqua]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_L22; Match level="Score=26.5, E -value=8.1e-08, Copies=1"; Pfam description=Ribosomal protein L22p/L17e
FNGGVGRCSQAKQFGTTQGRWPKKSAEFLLQLLRNAESNADYSGLDVDRLVIEHIQVNRAASLRRRTYRASG

SEQ ID NO: 30453 - protein, 28 aa, Diabrotica virgifera
  misc_feature: Coding regions on vcDNA: vcDNA=SeqID_10150; Strand=-; Position=1-84
  misc_feature (1)..(3): Xaa can be any naturally occurring amino acid
  misc_feature (7)..(28): Xaa can be any naturally occurring amino acid
XXXSSSXXXXXXXXXXXXXXXXXXXXXX

SEQ ID NO: 30454 - protein, 84 aa, Diabrotica virgifera
  misc_feature: Coding regions on vcDNA: vcDNA=SeqID_10151; Strand=+; Position=3-254
  misc_feature (1)..(16): Xaa can be any naturally occurring amino acid
  misc_feature (22)..(31): Xaa can be any naturally occurring amino acid
  misc_feature (36)..(36): Xaa can be any naturally occurring amino acid
  misc_feature (53)..(60): Xaa can be any naturally occurring amino acid
  misc_feature (73)..(82): Xaa can be any naturally occurring amino acid
XXXXXXXXXXXXXXXXNSVIFXXXXXXXXXXRTSMXGLSLIIGVQYYLLSLVXXXXXXXXSLNRGGAQVGFYXXXXXXXXXXKG

SEQ ID NO: 30455 - protein, 82 aa, Diabrotica virgifera
  misc_feature: Coding regions on vcDNA: vcDNA=SeqID_10152; Strand=-; Position=0-245
  misc_feature (50)..(55): Xaa can be any naturally occurring amino acid
KNKNIAKEIKGRIYKTVILSYYLAAESSNQKWKIKLIDQGKAGFLSETIXXXXXXGKEMKSRIYKRVIRPIMNNDICGRNTT

SEQ ID NO: 30456 - protein, 78 aa, Diabrotica virgifera
  misc_feature: Coding regions on vcDNA: vcDNA=SeqID_10153; Strand=+; Position=206-442
VAYELIIYPNVCAKCRPTFCKTLSFTMLPVHLHKPLLLGSIDSSKKTCQDSKNDCAQVPISCVEIPILTVTARVCDKY

SEQ ID NO: 30457 - protein, 136 aa, Diabrotica virgifera
  misc_feature: Coding regions on vcDNA: vcDNA=SeqID_10154; Strand=-; Position=411-821
  misc_feature (1)..(55): Xaa can be any naturally occurring amino acid
  misc_feature (57)..(63): Xaa can be any naturally occurring amino acid
XXXXXXXXXXXXXXXXXXXXXXXXXXXXXXXXXXXXXXXXXXXXXXXXXXXXXXXSXXXXXXXSAFRSQLFFCFHSAFFYTYTAFYFHVISVTSFASVSKRITKMKIKIFIKYFRKYEFGYLHFWFFTLQIHIKKF

SEQ ID NO: 30458 - protein, 150 aa, Diabrotica virgifera
  misc_feature: Coding regions on vcDNA: vcDNA=SeqID_10155; Strand=+; Position=2-451
  misc_feature: Homolog annotation: Hit_ID=AAF87760.1; Match level="QueryCoverage =100%, HitCoverage=34%, E-value=2e-49, Identity=68%"; Hit description= cytochrome oxidase subunit I [Diabrotica virgifera zeae]
  misc_feature (14)..(20): Xaa can be any naturally occurring amino acid
  misc_feature (34)..(34): Xaa can be any naturally occurring amino acid
  misc_feature (42)..(58): Xaa can be any naturally occurring amino acid
  misc_feature (88)..(88): Xaa can be any naturally occurring amino acid
  misc_feature (104)..(111): Xaa can be any naturally occurring amino acid
  misc_feature (132)..(132): Xaa can be any naturally occurring amino acid
IDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFSFQRKRLRPLRITSSIEXLQFNPPAEHRYSELPILS

SEQ ID NO: 30459 - protein, 25 aa, Diabrotica virgifera
  misc_feature: Coding regions on vcDNA: vcDNA=SeqID_10156; Strand=-; Position=1-75
  misc_feature (4)..(25): Xaa can be any naturally occurring amino acid
HPPXXXXXXXXXXXXXXXXXXXXXX

SEQ ID NO: 30460 - protein, 72 aa, Diabrotica virgifera
  misc_feature: Coding regions on vcDNA: vcDNA=SeqID_10157; Strand=+; Position=612-830
  misc_feature (50)..(50): Xaa can be any naturally occurring amino acid
  misc_feature (57)..(64): Xaa can be any naturally occurring amino acid
KPYIIFRKPDFYSAFFEKEFMLSLKVFLFRVFSIMLIKLSTSSLAAIPLXQIFYLLXXXXXXXXLMTLTVIK

SEQ ID NO: 30461 - protein, 213 aa, Diabrotica virgifera
  misc_feature: Coding regions on vcDNA: vcDNA=SeqID_10158; Strand=+; Position=219-859
  misc_feature: Homolog annotation: Hit_ID=XP_311131.1; Match level="QueryCoverage =90%, HitCoverage=14%, E-value=9e-45, Identity=46%"; Hit description =ENSANGP00000004747 [Anopheles gambiae]
  misc_feature: Gene Ontology Annotation: Molecular function=cell adhesion receptor activity; Cellular component=muscle fiber; Biological process=wing morphogenesis
  misc_feature (181)..(181): Xaa can be any naturally occurring amino acid
MCECRFIIFCAILVSYVTCFNIEHRNYAVFEPVDNNRSMFGFTVAVHKDRGNRGWILVGAPEGQSRYQNPEIVKRGGTVYKCRSDADSVCDQIPFDRTNNVGFGDTAIDEKSWQWFGATLSSSGRMDGPVVACAPRYIWFTKDLNRRDPVGTCFVSNGAFDNFEEYSPCRTMNWGYHRQGXCQAGLGAGVKGEGDRLYVEFPGSYYWQGQCIP

SEQ ID NO: 30462 - protein, 34 aa, Diabrotica virgifera; identical to SEQ ID NO: 27603
  misc_feature: Coding regions on vcDNA: vcDNA=SeqID_10159; Strand=-; Position=80-184

SEQ ID NO: 30463 - protein, 245 aa, Diabrotica virgifera
  misc_feature: Coding regions on vcDNA: vcDNA=SeqID_10160; Strand=+; Position=18-753
  misc_feature: Homolog annotation: Hit_ID=XP_393173.1; Match level="QueryCoverage =98%, HitCoverage=5%, E-value=4e-53, Identity=51%"; Hit description =similar to Hypothetical protein CBG09037 [Apis mellifera]
  misc_feature (232)..(232): Xaa can be any naturally occurring amino acid
MATNNYFGFTHGGTQYGATTGAYQAGQAGYAVATPATAAAAATYGTQRPTSYDTAYQAAAAASQGTYAAVGTTATPAYEYGYGQTAATGYTSSAAAKPASYATTYTQRTTSQQAQQAAASAAVAAAAVVKQPAQYTATYQPTATAYQTTYPQPAAAQTTIAAQPTTQAKQTNSTTTYSGYDAALYSAATMYVAQQSGTAQHKAVGWQNYKKPGIGAKTARPKAPPKPQQLHXCDVCKITIAELQR

SEQ ID NO: 30464 - protein, 119 aa, Diabrotica virgifera; identical to SEQ ID NO: 29283
  misc_feature: Coding regions on vcDNA: vcDNA=SeqID_10161; Strand=+; Position=230-589
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 30465 - protein, 55 aa, Diabrotica virgifera
  misc_feature: Coding regions on vcDNA: vcDNA=SeqID_10162; Strand=+; Position=1-168
QESTNTYLTTNKNKNCLYLNTYLFTNNDVSLITKYRQSNGQPNNIHCIWFIQKPI

SEQ ID NO: 30466 - protein, 317 aa, Diabrotica virgifera
  misc_feature: Coding regions on vcDNA: vcDNA=SeqID_10163; Strand=+; Position=3-953
  misc_feature: Homolog annotation: Hit_ID=NP_995599.1; Match level="QueryCoverage =100%, HitCoverage=67%, E-value=1e-136, Identity=30%"; Hit description=CG32019-PD, isoform D [Drosophila melanogaster] gb|AAS64599.1| CG32019-PD, isoform D [Drosophila
  misc_feature: Gene Ontology Annotation: Molecular function=structural constituent of muscle; Cellular component=cytoskeleton; Biological process =regulation of striated muscle contraction
  misc_feature: Pfam annotation: Pfam_ID=I-set; Match level="Score=104.1, E-value =3.6e-28, Copies=2"; Pfam description=Immunoglobulin I-set domain
  misc_feature (146)..(146): Xaa can be any naturally occurring amino acid
  misc_feature (285)..(285): Xaa can be any naturally occurring amino acid
TITGNPAPHITWYKGAREITSGSRYHIYSEGEVHHLVIHDVFGEDADEYVCRASNKAGVKSTRAELLIMTAPKLNIPPRFRDSAYFDKGENVVIKIPFTGFPRPKITWVREGEVIESGGHYHVEVKDRHAILTIRDASKLDSGPYXITAENELGQDTAIIKIQIADRPDPPRFPAADNIGHDNLALTWKAPVWDGGSNITNYLVERREHPLSTWIRVGNTRLTTIAVNGLTPGHQYEFRVYAENIYGRSDASDLSSIITMKDTIKKKVEKRKYEVDENGKKNVNXTEAVTDYDKYVFDIYSKFVPQPGEIKTKSVYD

SEQ ID NO: 30467 - protein, 292 aa, Diabrotica virgifera
  misc_feature: Coding regions on vcDNA: vcDNA=SeqID_10164; Strand=+; Position=44-912
  misc_feature: Homolog annotation: Hit_ID=XP_397181.1; Match level="QueryCoverage =98%, HitCoverage=35%, E-value=2e-77, Identity=55%"; Hit description =similar to signal transducer and activator of transcription [Apis mellifera]
  misc_feature: Gene Ontology Annotation: Molecular function=transcription factor activity; Cellular component=nucleus; Biological process=JAK-STAT cascade
  misc_feature: Pfam annotation: Pfam_ID=STAT_int; Match level="Score=115.0, E-value =1.9e-31, Copies=1"; Pfam description=STAT protein, protein interaction dom
  misc_feature (38)..(38): Xaa can be any naturally occurring amino acid
  misc_feature (198)..(198): Xaa can be any naturally occurring amino acid
  misc_feature (242)..(242): Xaa can be any naturally occurring amino acid
  misc_feature (254)..(254): Xaa can be any naturally occurring amino acid
  misc_feature (256)..(256): Xaa can be any naturally occurring amino acid
  misc_feature (271)..(271): Xaa can be any naturally occurring amino acid
  misc_feature (277)..(277): Xaa can be any naturally occurring amino acid
  misc_feature (280)..(280): Xaa can be any naturally occurring amino acid
  misc_feature (284)..(284): Xaa can be any naturally occurring amino acid
MALWAKAQQLPPGSLQQIYGDIFPIEVRHYLAQYIEEXFWCDIDPQPDNPQHEQYIASLINSLIKEIENKASVVTDSEYFLTKLKLAEAAKLFRERYSSCPIQLFTHIRNCLAAEMRLVQAAGVDSLIGLPNLMISNSGAEVLQKVNVLRSRTQSTAEDLRKMEQELEAFALQYHECQKITAHLQQMTTQPNAQMPTXMATKLQKQKELLEANLNQKLAALLQLRLALGHKLKETFQLLGSXLQTHGWDEELIXWXKREQQLAGNGSAFQXVLYSIXEWXCESXAEIIWGSS

SEQ ID NO: 30468 - protein, 208 aa, Diabrotica virgifera
  misc_feature: Coding regions on vcDNA: vcDNA=SeqID_10165; Strand=-; Position=0-623
  misc_feature (4)..(206): Xaa can be any naturally occurring amino acid
PSIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGT

SEQ ID NO: 30469 - protein, 80 aa, Diabrotica virgifera
  misc_feature: Coding regions on vcDNA: vcDNA=SeqID_10166; Strand=-; Position=370-612
  misc_feature (10)..(16): Xaa can be any naturally occurring amino acid
  misc_feature (30)..(35): Xaa can be any naturally occurring amino acid
NKCFYQLLRXXXXXXXPHPRWGGNHPHGKXXXXXXYILIHGLSTTYSQTLKQTDPFCKNCEVKSFGSWTIRWWCESSRIF

SEQ ID NO: 30470 - protein, 109 aa, Diabrotica virgifera
  misc_feature: Coding regions on vcDNA: vcDNA=SeqID_10167; Strand=+; Position=1-330
  misc_feature (14)..(22): Xaa can be any naturally occurring amino acid
  misc_feature (36)..(67): Xaa can be any naturally occurring amino acid
  misc_feature (69)..(89): Xaa can be any naturally occurring amino acid
  misc_feature (91)..(101): Xaa can be any naturally occurring amino acid
SPPPRPASFLIFPXXXXXXXXXTEFYLTLVNYYSCXXXXXXXXXXXXXXXXXXXXXXXXXXXXXXXXYXXXXXXXXXXXXXXXXXXXXXDXXXXXXXXXXXRYKLFLIN

SEQ ID NO: 30471 - protein, 17 aa, Diabrotica virgifera
  misc_feature: Coding regions on vcDNA: vcDNA=SeqID_10168; Strand=-; Position=1-51
  misc_feature (3)..(17): Xaa can be any naturally occurring amino acid
EVXXXXXXXXXXXXXXX

SEQ ID NO: 30472 - protein, 58 aa, Diabrotica virgifera
  misc_feature: Coding regions on vcDNA: vcDNA=SeqID_10169; Strand=+; Position=440-613
  misc_feature (17)..(22): Xaa can be any naturally occurring amino acid
  misc_feature (24)..(47): Xaa can be any naturally occurring amino acid
ILFKLLLFYFWIPIILXXXXXXVXXXXXXXXXXXXXXXXXXXXXXXXDQNQKDPRLKT

SEQ ID NO: 30473 - protein, 100 aa, Diabrotica virgifera
  misc_feature: Coding regions on vcDNA: vcDNA=SeqID_10170; Strand=-; Position=2-301
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(99): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXG

SEQ ID NO: 30474 - protein, 296 aa, Diabrotica virgifera
  misc_feature: Coding regions on vcDNA: vcDNA=SeqID_10171; Strand=-; Position=2-889
  misc_feature: Pfam annotation: Pfam_ID=HEAT; Match level="Score=16.8, E-value =0.066, Copies=2"; Pfam description=HEAT repeat
ADVDFDQSLPSIKRVIRTLIVYSQSHWRTRKGLLVTFMHIIKFAPKEYFAENIKHFYGSLLGDHVFAVRRTAAIILPLIVKHFGMTWTSAQIIPYFKMFQRDTRYLYRYVPIFGINELIEPSVLPGEEKEYLASLKKVEDKNKAANMLWMLKCILKKLESLLEEKTFQDILSLNKSIDDFKTDNISLYAGETLNSLRSHYSENIFSYDGTKAENSNDWYLTGVLFFIYRECLGLLLTLFDDRIVNVQIRSIFTINKIKVFVDKLLAEIKEPWVEETLQVLKQEELDRIEEELNAEL

SEQ ID NO: 30475 - protein, 256 aa, Diabrotica virgifera
  misc_feature: Coding regions on vcDNA: vcDNA=SeqID_10172; Strand=+; Position=3-770
  misc_feature (1)..(219): Xaa can be any naturally occurring amino acid
  misc_feature (222)..(242): Xaa can be any naturally occurring amino acid
  misc_feature (244)..(244): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNEXXXXXXXXXXXXXXXXXXXXXAXIFLKTRTPIEFI

SEQ ID NO: 30476 - protein, 51 aa, Diabrotica virgifera
  misc_feature: Coding regions on vcDNA: vcDNA=SeqID_10173; Strand=-; Position=63-218
NVEKLFAINSQLFSSNYSIYQARIYVYNNSFVAKSYHLNIIIQIIYNNSSL

SEQ ID NO: 30477 - protein, 155 aa, Diabrotica virgifera
  misc_feature: Coding regions on vcDNA: vcDNA=SeqID_10174; Strand=-; Position=84-551
  misc_feature (37)..(44): Xaa can be any naturally occurring amino acid
  misc_feature (87)..(104): Xaa can be any naturally occurring amino acid
  misc_feature (108)..(114): Xaa can be any naturally occurring amino acid
  misc_feature (118)..(130): Xaa can be any naturally occurring amino acid
  misc_feature (139)..(155): Xaa can be any naturally occurring amino acid
FFTTPSVQLSIPILMIMLRERGQDGAFFLFPQWAEGXXXXXXXXMFPPGFSPPCCLNSSPPTYIFLLHIQNFNTPIPLINKFIFFKXXXXXXXXXXXXXXXXXXPIFXXXXXXXPGVXXXXXXXXXXXXXNLRPPLGIXXXXXXXXXXXXXXXXX

SEQ ID NO: 30478 - protein, 106 aa, Diabrotica virgifera
  misc_feature: Coding regions on vcDNA: vcDNA=SeqID_10175; Strand=+; Position=13-333
  misc_feature: Homolog annotation: Hit_ID=XP_315566.1; Match level="QueryCoverage =84%, HitCoverage=81%, E-value=2e-39, Identity=77%"; Hit description =ENSANGP00000007214 [Anopheles gambiae] gb|EAA11465.2| ENSANGP00000007214 [Anopheles gambiae
  misc_feature: Gene Ontology Annotation: Molecular function=protein binding; Cellular component=ubiquitin ligase complex; Biological process =protein modification
  misc_feature (96)..(96): Xaa can be any naturally occurring amino acid
MPQQKMADENDNEKMDIDPQKNTEKMFSLKKWNAVAMWSWDVECDTCAICRVQVMDSCLRCQAENRKDSYGKQDCVVVWGECNHSFHYCCMSLWVXLRAPSSYHSR

SEQ ID NO: 30479 - protein, 72 aa, Diabrotica virgifera
  misc_feature: Coding regions on vcDNA: vcDNA=SeqID_10176; Strand=-; Position=1-216
  misc_feature (1)..(72): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXX

SEQ ID NO: 30480 - protein, 17 aa, Diabrotica virgifera
  misc_feature: Coding regions on vcDNA: vcDNA=SeqID_10177; Strand=-; Position=19-72
RNSLRKFLNIYYRDSIM

SEQ ID NO: 30481 - protein, 193 aa, Diabrotica virgifera
  misc_feature: Coding regions on vcDNA: vcDNA=SeqID_10178; Strand=-; Position=2-580
  misc_feature (7)..(26): Xaa can be any naturally occurring amino acid
  misc_feature (40)..(46): Xaa can be any naturally occurring amino acid
  misc_feature (48)..(54): Xaa can be any naturally occurring amino acid
  misc_feature (88)..(114): Xaa can be any naturally occurring amino acid
  misc_feature (119)..(135): Xaa can be any naturally occurring amino acid
  misc_feature (139)..(154): Xaa can be any naturally occurring amino acid
  misc_feature (158)..(176): Xaa can be any naturally occurring amino acid
  misc_feature (181)..(193): Xaa can be any naturally occurring amino acid
GGWPPPXXXXXXXXXXXXXXXXXXXXRPAPPPPVINPPNXXXXXXXRXXXXXXXLSPQLKTLNPPWGVPIFNKGFTLTNKIPLFPLRXXXXXXXXXXXXXXXXXXXXXXXXXXXNPPYXXXXXXXXXXXXXXXXXFINXXXXXXXXXXXXXXXXQINXXXXXXXXXXXXXXXXXXXSIKNXXXXXXXXXXXXX

SEQ ID NO: 30482 - protein, 85 aa, Diabrotica virgifera
  misc_feature: Coding regions on vcDNA: vcDNA=SeqID_10179; Strand=-; Position=88-345
HRNHLRSRWTYHKILGPDYPCVIIRAADCPAYRLSGSGSSGLCIIRAMILYYFWATVQSKRRFGTLKNQRTFQTDSLENESRRRR

SEQ ID NO: 30483 - protein, 204 aa, Diabrotica virgifera
  misc_feature: Coding regions on vcDNA: vcDNA=SeqID_10180; Strand=-; Position=21-632
  misc_feature: Homolog annotation: Hit_ID=CAG59469.1; Match level="QueryCoverage =97%, HitCoverage=23%, E-value=9e-09, Identity=28%"; Hit description =unnamed protein product [Candida glabrata CBS138] ref|XP_446542.1| unnamed protein product [Candida glabra
VSDGTKSFPITGNGLPPRAADPTAVTPEKGSALPSNEEATSCWVGLGSTISRSELSTVRVERSSATGVVGMSSLSTGSALILTCFPFGKLSSPAISTNPSSSVSIAGGGDATFVLSPAISSSSSSTTILIGATSFKITSSSSSPSAAASCCSYSGISVASGTNLESSLSTDNISLDKGPFTSSGMMISRPGIIFSTLSSCGCSI

SEQ ID NO: 30484 - protein, 86 aa, Diabrotica virgifera
  misc_feature: Coding regions on vcDNA: vcDNA=SeqID_10181; Strand=-; Position=304-564
  misc_feature (32)..(39): Xaa can be any naturally occurring amino acid
  misc_feature (69)..(78): Xaa can be any naturally occurring amino acid
IQLFNTPIINITILKIHKFIVQYYHTSKSSFXXXXXXXXLIIYKNISNPNFSSNLTRIKSLSQALPYKXXXXXXXXXXNYQYTDNT

SEQ ID NO: 30485 - protein, 280 aa, Diabrotica virgifera
  misc_feature: Coding regions on vcDNA: vcDNA=SeqID_10182; Strand=-; Position=1-840
  misc_feature (1)..(25): Xaa can be any naturally occurring amino acid
  misc_feature (27)..(42): Xaa can be any naturally occurring amino acid
  misc_feature (46)..(67): Xaa can be any naturally occurring amino acid
  misc_feature (69)..(222): Xaa can be any naturally occurring amino acid
  misc_feature (225)..(263): Xaa can be any naturally occurring amino acid
  misc_feature (265)..(280): Xaa can be any naturally occurring amino acid
XXXXXXXXXXXXXXXXXXXXXXXXXVXXXXXXXXXXXXXXXXLINXXXXXXXXXXXXXXXXXXXXXXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFXXXXXXXXXXXXXXXXXXXXXXXXXXXXXXXXXXXXXXXRXXXXXXXXXXXXXXXX

SEQ ID NO: 30486 - protein, 265 aa, Diabrotica virgifera
  misc_feature: Coding regions on vcDNA: vcDNA=SeqID_10183; Strand=-; Position=1-795
  misc_feature (1)..(265): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30487 - protein, 61 aa, Diabrotica virgifera
  misc_feature: Coding regions on vcDNA: vcDNA=SeqID_10184; Strand=-; Position=74-259
CIFIVISVQTAVSQISKTTILIIIARCFVVTTRSCRRPTTAVCNVRHNAVRSTRSLLETAD

SEQ ID NO: 30488 - protein, 21 aa, Diabrotica virgifera
  misc_feature: Coding regions on vcDNA: vcDNA=SeqID_10185; Strand=+; Position=1-63
  misc_feature (3)..(15): Xaa can be any naturally occurring amino acid
FCXXXXXXXXXXXXXYFISIL

SEQ ID NO: 30489 - protein, 85 aa, Diabrotica virgifera
  misc_feature: Coding regions on vcDNA: vcDNA=SeqID_10186; Strand=-; Position=18-275
GRPEPDLGCSAIGVRGRKGERKRGREERGGIVVRLYYHLPIYNLYNVYKLKERERERERLVSLCYHLPIYNLYNLCFVVKFYFTY

SEQ ID NO: 30490 - protein, 354 aa, Diabrotica virgifera
  misc_feature: Coding regions on vcDNA: vcDNA=SeqID_10187; Strand=-; Position=3-1064
  misc_feature (32)..(62): Xaa can be any naturally occurring amino acid
  misc_feature (64)..(354): Xaa can be any naturally occurring amino acid
GPHLIIDGLPKKNTLLSLSNYSIIKKFDQKLXXXXXXXXXXXXXXXXXXXXXXXXXXXXXXXYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30491 - protein, 98 aa, Diabrotica virgifera
  misc_feature: Coding regions on vcDNA: vcDNA=SeqID_10188; Strand=-; Position=123-419
VYRCLATLLHLVTLSFLRICSRRLSCDGRIFLDVFLLPLCIIILLVFSINHNQLVILLLKISNWSCSLFGLTIPIESFLYNAFYYHYFNIFFSSTNIS

SEQ ID NO: 30492 - protein, 20 aa, Diabrotica virgifera
  misc_feature: Coding regions on vcDNA: vcDNA=SeqID_10189; Strand=-; Position=0-59
LKSSYLIFSGYKIAPPRRLS

SEQ ID NO: 30493 - protein, 235 aa, Diabrotica virgifera
  misc_feature: Coding regions on vcDNA: vcDNA=SeqID_10190; Strand=-; Position=1-705
  misc_feature (1)..(18): Xaa can be any naturally occurring amino acid
  misc_feature (20)..(42): Xaa can be any naturally occurring amino acid
  misc_feature (45)..(235): Xaa can be any naturally occurring amino acid
XXXXXXXXXXXXXXXXXXIXXXXXXXXXXXXXXXXXXXXXXXHVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30494 - protein, 87 aa, Diabrotica virgifera
  misc_feature: Coding regions on vcDNA: vcDNA=SeqID_10191; Strand=-; Position=83-346
MTCFCDCRRKKYPSQEEIHEFWGNQLSTPAAFNNNSGWIEDTKHNCHHYVTANYEPFTTEEVSNVIKELHNWKSPGPEGVQNFWLFL

SEQ ID NO: 30495 - protein, 76 aa, Diabrotica virgifera
  misc_feature: Coding regions on vcDNA: vcDNA=SeqID_10192; Strand=-; Position=0-227
  misc_feature (1)..(10): Xaa can be any naturally occurring amino acid
  misc_feature (22)..(35): Xaa can be any naturally occurring amino acid
  misc_feature (38)..(44): Xaa can be any naturally occurring amino acid
  misc_feature (48)..(56): Xaa can be any naturally occurring amino acid
  misc_feature (59)..(75): Xaa can be any naturally occurring amino acid
XXXXXXXXXXILFFIHRQLKSXXXXXXXXXXXXXXIIXXXXXXXFSSXXXXXXXXXKHXXXXXXXXXXXXXXXXXS

SEQ ID NO: 30496 - protein, 77 aa, Diabrotica virgifera
  misc_feature: Coding regions on vcDNA: vcDNA=SeqID_10193; Strand=+; Position=708-938
  misc_feature (44)..(44): Xaa can be any naturally occurring amino acid
  misc_feature (50)..(50): Xaa can be any naturally occurring amino acid
LLRTNRIRASNDYCIYFDYSDYFVLIVSERVTTIVSTTSTLDYXLVYRLXRKCGNDNISTFVYLRYGISDTIQIPTT

SEQ ID NO: 30497 - protein, 183 aa, Diabrotica virgifera
  misc_feature: Coding regions on vcDNA: vcDNA=SeqID_10194; Strand=-; Position=1-549
  misc_feature (1)..(166): Xaa can be any naturally occurring amino acid
  misc_feature (169)..(183): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 30498 - protein, 121 aa, Diabrotica virgifera; identical to SEQ ID NO: 22234
  misc_feature: Coding regions on vcDNA: vcDNA=SeqID_10195; Strand=+; Position=65-430
  misc_feature: Homolog annotation: Hit_ID=XP_393157.1; Match level="QueryCoverage =96%, HitCoverage=20%, E-value=2e-43, Identity=76%"; Hit description =similar to ENSANGP00000016262 [Apis mellifera]
  misc_feature: Gene Ontology Annotation: Molecular function=hydrogen-exporting ATPase activity, phosphorylative mechanism; Cellular component =hydrogen-translocating V-type ATPase complex; Biological process =vacuolar acidification
  misc_feature: Pfam annotation: Pfam_ID=V-ATPase_G; Match level="Score=171.7, E -value=1.6e-48, Copies=1"; Pfam description=Vacuolar (H+)-ATPase G subunit

SEQ ID NO: 30499 - protein, 17 aa, Diabrotica virgifera
  misc_feature: Coding regions on vcDNA: vcDNA=SeqID_10196; Strand=-; Position=1-51
  misc_feature (3)..(17): Xaa can be any naturally occurring amino acid
EVXXXXXXXXXXXXXXX

SEQ ID NO: 30500 - protein, 59 aa, Diabrotica virgifera
  misc_feature: Coding regions on vcDNA: vcDNA=SeqID_10197; Strand=+; Position=717-896
  misc_feature (32)..(38): Xaa can be any naturally occurring amino acid
CLLWSCVTFLSDVSFFFRSIDNNIYELYRYKXXXXXXXIDVIFLLSALIGLRCYFTVLI

SEQ ID NO: 30501 - protein, 66 aa, Diabrotica virgifera; identical to SEQ ID NO: 26808
  misc_feature: Coding regions on vcDNA: vcDNA=SeqID_10198; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 30502 - protein, 264 aa, Diabrotica virgifera
  misc_feature: Coding regions on vcDNA: vcDNA=SeqID_10199; Strand=+; Position=3-797
  misc_feature: Homolog annotation: Hit_ID=NP_649835.1; Match level="QueryCoverage =100%, HitCoverage=49%, E-value=1e-121, Identity=81%"; Hit description=CG8351-PA [Drosophila melanogaster] gb|AAF54292.2| CG8351-PA [Drosophila melanogaster]
  misc_feature: Gene Ontology Annotation: Molecular function=chaperone activity; Cellular component=cytoskeleton; Biological process=reproduction
  misc_feature: Pfam annotation: Pfam_ID=Cpn60_TCP1; Match level="Score=-96.6, E -value=2.7e-11, Copies=1"; Pfam description=TCP-1/cpn60 chaperonin family
  misc_feature (179)..(184): Xaa can be any naturally occurring amino acid
KLQKIYESGANVVLSKLPIGDVATQYFADRDMFCAGRVQEDDMKRTLKACGGAVMTTVNDISDSVLGKCELFEEKQIGGERFNFFKGCPNAKTCTLILRGGAEQFLEETERSLHDAIMIVRRTIKNDAVVAGGGAIEMELSKILRDHSRTIAGKEQLLIGAIAKALEIIPRQLCDNAGXXXXXXLNKLRQKHAQGHCWYGVDINKEDISDNFEACVWEPAIVKINALTAATEATCLILSVDETIKNQKSEAPPQMGGRGMGRPM

SEQ ID NO: 30503 - protein, 136 aa, Diabrotica virgifera
  misc_feature: Coding regions on vcDNA: vcDNA=SeqID_10200; Strand=-; Position=247-657
MLKGFEFPTPKDEEKSNSGPKGLKGPPKPSELTSTTPPGRSSVKGLSGFSGKSEISGFSGIDFRLGFGLGPKGLKGPPKPSELTSTTPPGRSSVKGLSGFSGKSEISGFSGIDFRLGFGLGTKTGFCSELAAGGSL

SEQ ID NO: 30504 - protein, 150 aa, Diabrotica virgifera
  misc_feature: Coding regions on vcDNA: vcDNA=SeqID_10201; Strand=+; Position=1-450
  misc_feature (1)..(148): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVV

SEQ ID NO: 30505 - protein, 245 aa, Diabrotica virgifera
  misc_feature: Coding regions on vcDNA: vcDNA=SeqID_10202; Strand=-; Position=1-735
  misc_feature (2)..(228): Xaa can be any naturally occurring amino acid
  misc_feature (230)..(245): Xaa can be any naturally occurring amino acid
LXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXX

SEQ ID NO: 30506 - protein, 303 aa, Diabrotica virgifera
  misc_feature: Coding regions on vcDNA: vcDNA=SeqID_10203; Strand=+; Position=34-942
  misc_feature: Homolog annotation: Hit_ID=AAC47556.1; Match level="QueryCoverage =97%, HitCoverage=96%, E-value=3e-34, Identity=33%"; Hit description =insect intestinal mucin IIM14 [Trichoplusia ni]
  misc_feature: Gene Ontology Annotation: Molecular function=molecular_function unknown; Cellular component=extracellular space; Biological process =biological_process unknown
  misc_feature: Pfam annotation: Pfam_ID=CBM_14; Match level="Score=130.2, E-value =5.1e-36, Copies=2"; Pfam description=Chitin binding Peritrophin-A domain
MNNMTLALVFAILFIGGISTATNKEIVQQLRHNALCLQAGFSCPAVDSQTSVYFPLADCTKFCQCSNGVPYLHNCPPGLHFNPSLNVCDYPAQAGCTGEGVVVSTTTTTTTTTTTTPAPTTTTTTTTTPAPTTTSAPTTTSTSTTAPTTTTPTTTTSAPVTTTRTTTTPAPSTTSGPITSTTAATTIKVDNLCLQQNIACPAVDGPDSVYFSHSNCSKFCQCSNGVPYEHTCPEGLHFNAKLNICDWPQNAGCSGTDVTQPTVEPTTITTANSSTATNSTTESSTTVSSTTTTQETPSDTTTL

SEQ ID NO: 30507 - protein, 119 aa, Diabrotica virgifera
  misc_feature: Coding regions on vcDNA: vcDNA=SeqID_10204; Strand=+; Position=105-464
  misc_feature (72)..(79): Xaa can be any naturally occurring amino acid
PLYIFFPSVYFVCIYTYFVVFVQYVSTSVSTLFLYMPTDSLIFLFMLKLSCCFSNLPISAYFANSQFLRFCXXXXXXXXFLYCCSFLFLYFVFPISITLFLVLSLVSFWGIYRSPVDIV

SEQ ID NO: 30508 - protein, 17 aa, Diabrotica virgifera
  misc_feature: Coding regions on vcDNA: vcDNA=SeqID_10205; Strand=-; Position=1-51
  misc_feature (4)..(13): Xaa can be any naturally occurring amino acid
  misc_feature (16)..(16): Xaa can be any naturally occurring amino acid
NNLXXXXXXXXXXKKXS

SEQ ID NO: 30509 - protein, 71 aa, Diabrotica virgifera
  misc_feature: Coding regions on vcDNA: vcDNA=SeqID_10206; Strand=-; Position=3-218
  misc_feature (23)..(23): Xaa can be any naturally occurring amino acid
  misc_feature (25)..(39): Xaa can be any naturally occurring amino acid
  misc_feature (43)..(43): Xaa can be any naturally occurring amino acid
  misc_feature (47)..(47): Xaa can be any naturally occurring amino acid
  misc_feature (49)..(71): Xaa can be any naturally occurring amino acid
NFIHLESASLYRLTSSIKYAVIXKXXXXXXXXXXXXXXXLYNXIKKXNXXXXXXXXXXXXXXXXXXXXXXX

SEQ ID NO: 30510 - protein, 66 aa, Diabrotica virgifera; identical to SEQ ID NO: 26808
  misc_feature: Coding regions on vcDNA: vcDNA=SeqID_10207; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 30511 - protein, 153 aa, Diabrotica virgifera
  misc_feature: Coding regions on vcDNA: vcDNA=SeqID_10208; Strand=+; Position=3-464
  misc_feature (3)..(108): Xaa can be any naturally occurring amino acid
  misc_feature (110)..(112): Xaa can be any naturally occurring amino acid
  misc_feature (115)..(115): Xaa can be any naturally occurring amino acid
  misc_feature (121)..(132): Xaa can be any naturally occurring amino acid
  misc_feature (137)..(145): Xaa can be any naturally occurring amino acid
NLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXYLXLVMMDXXXXXXXXXXXXIGFNXXXXXXXXXFIKTCLLY

SEQ ID NO: 30512 - protein, 66 aa, Diabrotica virgifera
  misc_feature: Coding regions on vcDNA: vcDNA=SeqID_10209; Strand=+; Position=371-571
  misc_feature (10)..(21): Xaa can be any naturally occurring amino acid
SEVNLSIYLXXXXXXXXXXXXKSYLTLTMCQFYWSNNFIHQINHSSMVKEAISFKSTVAATVYWVL

SEQ ID NO: 30513 - protein, 76 aa, Diabrotica virgifera
  misc_feature: Coding regions on vcDNA: vcDNA=SeqID_10210; Strand=+; Position=2-232
LKLHQITYRFQKDCSCNDSSNLFNVCIKSFYVYNVLYYSKSHKLERIYDREICSFFHFHSSFCTILIYATESYSTR

SEQ ID NO: 30514 - protein, 66 aa, Diabrotica virgifera; identical to SEQ ID NO: 26808
  misc_feature: Coding regions on vcDNA: vcDNA=SeqID_10211; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 30515 - protein, 218 aa, Diabrotica virgifera
  misc_feature: Coding regions on vcDNA: vcDNA=SeqID_10212; Strand=+; Position=37-693
  misc_feature: Homolog annotation: Hit_ID=EAL28161.1; Match level="QueryCoverage =90%, HitCoverage=61%, E-value=2e-30, Identity=33%"; Hit description =GA15460-PA [Drosophila pseudoobscura]
  misc_feature: Gene Ontology Annotation: Molecular function=G-protein coupled photoreceptor activity; Cellular component=cellular_component unknown; Biological process=fatty acid biosynthesis
  misc_feature: Pfam annotation: Pfam_ID=ELO; Match level="Score=-156.0, E-value =0.0069, Copies=1"; Pfam description=GNS1/SUR4 family
  misc_feature (206)..(206): Xaa can be any naturally occurring amino acid
MAIITDVVNDLTNKIDPRHDGYITASPYFLYGFLFTYLFTIKILGPKLMQYRKPYNIKNLLICYNFIQIILNTYIVYEATCVYFSNSNWICIDTTEKNLVSDTRKHYYFLKILDCVETVFFILRKKYQQASFLHIYHHTAILCGAFLGFRYDYGDTTIIIGGLNSLTHVLMYVYYLLSAIDSRWGKYTSIKKGLTLVQIVQLTTIXIFVGNNKTYARL

SEQ ID NO: 30516 - protein, 20 aa, Diabrotica virgifera
  misc_feature: Coding regions on vcDNA: vcDNA=SeqID_10213; Strand=-; Position=0-59
PSPRQPPPTHSPPRGRAARP

SEQ ID NO: 30517 - protein, 216 aa, Diabrotica virgifera
  misc_feature: Coding regions on vcDNA: vcDNA=SeqID_10214; Strand=-; Position=0-647
  misc_feature (1)..(34): Xaa can be any naturally occurring amino acid
  misc_feature (37)..(214): Xaa can be any naturally occurring amino acid
XXXXXXXXXXXXXXXXXXXXXXXXXXXXXXXXXXSGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGT

SEQ ID NO: 30518 - protein, 196 aa, Diabrotica virgifera
  misc_feature: Coding regions on vcDNA: vcDNA=SeqID_10215; Strand=-; Position=66-657
  misc_feature: Homolog annotation: Hit_ID=NP_498615.1; Match level="QueryCoverage =66%, HitCoverage=17%, E-value=4e-12, Identity=30%"; Hit description =predicted CDS, reverse transcriptase family member (3I419) [Caenorhabditis elegans]
  misc_feature: Gene Ontology Annotation: Molecular function=molecular_function unknown; Cellular component=cellular_component unknown; Biological process=biological_process unknown
  misc_feature (97)..(97): Xaa can be any naturally occurring amino acid
  misc_feature (124)..(124): Xaa can be any naturally occurring amino acid
RGNLSDSDGNIILEKQSKSRTWKEYLEKLFEDQIDNTFELEGGVNDGPRILQQEVYSAITQLKDGKAAGPDNIQAELLKLINNESIEIITKIFNNIXNSGEIPTEWLKSEFIALPKKTRSQKMXEYRTISLMSHLLKLFLMVIHTESQISLNQLGFINAVGMREALFSIQVLFQRCRDVNCAKITRRRLIEYNTPR

SEQ ID NO: 30519 - protein, 258 aa, Diabrotica virgifera
  misc_feature: Coding regions on vcDNA: vcDNA=SeqID_10216; Strand=-; Position=2-775
  misc_feature (10)..(242): Xaa can be any naturally occurring amino acid
  misc_feature (244)..(258): Xaa can be any naturally occurring amino acid
IKLYRGLSSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXX

SEQ ID NO: 30520 - protein, 62 aa, Diabrotica virgifera
  misc_feature: Coding regions on vcDNA: vcDNA=SeqID_10217; Strand=-; Position=1-186
  misc_feature (1)..(62): Xaa can be any naturally occurring amino acid
XXXXXXXXXXXXXXXXXXXXXXXXXXXXXXXXXXXXXXXXXXXXXXXXXXXXXXXXXXXXXX

SEQ ID NO: 30521 - protein, 75 aa, Diabrotica virgifera
  misc_feature: Coding regions on vcDNA: vcDNA=SeqID_10218; Strand=-; Position=280-507
CVPLPISCYFVMHTILFHQFAYVAIPLLFSIMCPAVHTLYFFSFCCFHSPFDFLIYFLKFFLLLLSPLFLVAFLL

SEQ ID NO: 30522 - protein, 166 aa, Diabrotica virgifera
  misc_feature: Coding regions on vcDNA: vcDNA=SeqID_10219; Strand=-; Position=38-538
  misc_feature (3)..(9): Xaa can be any naturally occurring amino acid
  misc_feature (13)..(26): Xaa can be any naturally occurring amino acid
  misc_feature (37)..(67): Xaa can be any naturally occurring amino acid
  misc_feature (70)..(165): Xaa can be any naturally occurring amino acid
YHXXXXXXXCFYXXXXXXXXXXXXXXLNKLIHNLIYXXXXXXXXXXXXXXXXXXXXXXXXXXXXXXXIQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXV

SEQ ID NO: 30523 - protein, 326 aa, Diabrotica virgifera
  misc_feature: Coding regions on vcDNA: vcDNA=SeqID_10220; Strand=-; Position=1-981
  misc_feature (1)..(321): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSLQI

SEQ ID NO: 30524 - protein, 18 aa, Diabrotica virgifera
  misc_feature: Coding regions on vcDNA: vcDNA=SeqID_10221; Strand=+; Position=3-59
  misc_feature (1)..(7): Xaa can be any naturally occurring amino acid
XXXXXXXTRRPYTSILNY

SEQ ID NO: 30525 - protein, 114 aa, Diabrotica virgifera
  misc_feature: Coding regions on vcDNA: vcDNA=SeqID_10222; Strand=-; Position=416-760
  misc_feature (14)..(14): Xaa can be any naturally occurring amino acid
EIENNKKAKEKARXKAGSSTVDHFFTDRGYRKEISHHCELHQYLFVDIMTFRLLNAKFWERPDGRRSVGCPRKRWKDAVANDLRKMGVQQWEIAAQDRQQWREILNAAKTHIEL

SEQ ID NO: 30526 - protein, 264 aa, Diabrotica virgifera
  misc_feature: Coding regions on vcDNA: vcDNA=SeqID_10223; Strand=-; Position=1-792
  misc_feature (1)..(264): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30527 - protein, 106 aa, Diabrotica virgifera
  misc_feature: Coding regions on vcDNA: vcDNA=SeqID_10224; Strand=-; Position=76-396
VTYRALSNKENLPIFRMNLTDNPYCECGSIKNLNHIFFECPINSIPNWDIYNFFPTSNKGHIIIPTQFSANKGLPTPITIYSILHNVDEESIKAIMKFLSINRIKL

SEQ ID NO: 30528 - protein, 66 aa, Diabrotica virgifera
  misc_feature: Coding regions on vcDNA: vcDNA=SeqID_10225; Strand=-; Position=367-567
SYHYYHNFNFIRRNNISIYTSIKFYYMYLYRGSGNEHILLTLDYQIYLWHLLLIGYDNTIKELESI

SEQ ID NO: 30529 - protein, 75 aa, Diabrotica virgifera
  misc_feature: Coding regions on vcDNA: vcDNA=SeqID_10226; Strand=-; Position=2-226
  misc_feature (1)..(10): Xaa can be any naturally occurring amino acid
  misc_feature (13)..(23): Xaa can be any naturally occurring amino acid
  misc_feature (33)..(40): Xaa can be any naturally occurring amino acid
  misc_feature (43)..(50): Xaa can be any naturally occurring amino acid
  misc_feature (61)..(74): Xaa can be any naturally occurring amino acid
XXXXXXXXXXSFXXXXXXXXXXXNHPGSHGLNXXXXXXXXRTXXXXXXXXNYKLNPTSRSXXXXXXXXXXXXXXV

SEQ ID NO: 30530 - protein, 113 aa, Diabrotica virgifera
  misc_feature: Coding regions on vcDNA: vcDNA=SeqID_10227; Strand=+; Position=278-619
TTSNDEVHLPINPVGEEFIIDQVTNTKPPPVKRRKRDVSSWKSQKRYISHQKGESYVSRRGVVVPAKEVKSLKDCLNDCKFKCGVSISENERQALFKAFYGMNQNGKTSIYLG

SEQ ID NO: 30531 - protein, 110 aa, Diabrotica virgifera
  misc_feature: Coding regions on vcDNA: vcDNA=SeqID_10228; Strand=+; Position=178-510
LYSDCILDVNIKLQLLHKIKFNNMEIKQEVSGKTCKIEIDHVTCVGPLDTLKVEVKEELKTETEYQAFEYVDLNEFPVKTEVEQGEDKFIPFDEKQTRNEESILRVSRFQ

SEQ ID NO: 30532 - protein, 85 aa, Diabrotica virgifera
  misc_feature: Coding regions on vcDNA: vcDNA=SeqID_10229; Strand=-; Position=538-795
  misc_feature (15)..(15): Xaa can be any naturally occurring amino acid
  misc_feature (42)..(42): Xaa can be any naturally occurring amino acid
  misc_feature (68)..(68): Xaa can be any naturally occurring amino acid
  misc_feature (71)..(77): Xaa can be any naturally occurring amino acid
KLCTVPKPIEFHHQXINFMNITRGMSKSLNLTQEQSSSIPHXPLENCHYEKLLGIKNQPFPHAITSLXIEXXXXXXXMDNQHYPQ

SEQ ID NO: 30533 - protein, 55 aa, Diabrotica virgifera
  misc_feature: Coding regions on vcDNA: vcDNA=SeqID_10230; Strand=+; Position=524-691
  misc_feature (32)..(38): Xaa can be any naturally occurring amino acid
LCSCNIYHIFPSLQLGQLGRKGHIEVDCLITXXXXXXXLDNAQFTYIVFKVVVLL

SEQ ID NO: 30534 - protein, 147 aa, Diabrotica virgifera
  misc_feature: Coding regions on vcDNA: vcDNA=SeqID_10231; Strand=-; Position=0-440
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(136): Xaa can be any naturally occurring amino acid
  misc_feature (140)..(145): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXVKKXXXXXXPL

SEQ ID NO: 30535 - protein, 112 aa, Diabrotica virgifera
  misc_feature: Coding regions on vcDNA: vcDNA=SeqID_10232; Strand=+; Position=333-670
  misc_feature: Homolog annotation: Hit_ID=CAA10770.1; Match level="QueryCoverage =90%, HitCoverage=28%, E-value=3e-13, Identity=38%"; Hit description =reverse transcriptase-like [Bos taurus]
  misc_feature (27)..(27): Xaa can be any naturally occurring amino acid
NRISSPKYVFSVLLYGVESWIVNKIDXTYLNRLEAFEMWFYRRILKVSWVKKIRNSTILERLSKTTEIIEGIKKRKVEYFGHVMRSFKYRLLQNIMQVKIEGKRSSGRKSTS

SEQ ID NO: 30536 - protein, 244 aa, Diabrotica virgifera
  misc_feature: Coding regions on vcDNA: vcDNA=SeqID_10233; Strand=+; Position=77-811
  misc_feature: Homolog annotation: Hit_ID=EAA08176.2; Match level="QueryCoverage =92%, HitCoverage=100%, E-value=1e-76, Identity=62%"; Hit description= ENSANGP00000002778 [Anopheles gambiae str. PEST] ref|XP_563478.1| ENSANGP00000002778 [Anopheles gambiae s
  misc_feature: Gene Ontology Annotation: Molecular function=pyrophosphatase activity; Cellular component=integral to endoplasmic reticulum membrane; Biological process=lipid metabolism
  misc_feature: Pfam annotation: Pfam_ID=PAP2; Match level="Score=59.4, E-value=1e -14, Copies=1"; Pfam description=PAP2 superfamily
MASDDGTTILNSINKDQTEWVPLSLTLVEYPKGDLFGKFLALISLAPFGIGSGFLALILFRRDLHTITFFLGTIASEAFNYLLKHIICESRPILRENHYVEYGMPSSHAQFVWFFTTYVIYFVYIRLQHMNNNTIIQSLSKFLIIFSSLSMAILVSISRIYLEYHTVSQVLYGALVGILFATFWFALTYLVLAPLFPQVVTWSISELLLLRDTTLIPNVLWFEYTNTRKEVHARSRKLVSMKSQ

SEQ ID NO: 30537 - protein, 251 aa, Diabrotica virgifera
  misc_feature: Coding regions on vcDNA: vcDNA=SeqID_10234; Strand=-; Position=0-752
  misc_feature (1)..(249): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGT

SEQ ID NO: 30538 - protein, 62 aa, Diabrotica virgifera
  misc_feature: Coding regions on vcDNA: vcDNA=SeqID_10235; Strand=-; Position=131-319
  misc_feature (5)..(13): Xaa can be any naturally occurring amino acid
MYFLXXXXXXXXXLKRYDKLPQAIKITLKNNISIIHDSYVCPWPSSVSQGVCSSCPNLRNER

SEQ ID NO: 30539 - protein, 131 aa, Diabrotica virgifera
  misc_feature: Coding regions on vcDNA: vcDNA=SeqID_10236; Strand=+; Position=340-732
  misc_feature (101)..(108): Xaa can be any naturally occurring amino acid
MLDCSSLNRCEPGWKFKRTKFYNRGVGTQNFFKGAPKFNFRGGFLKPGGGENPGVTPIYSLGKTPPFPRWGKKKKAPPHPPSPKLANLKGEGDPPLKGQFXXXXXXXXPKGARYFCGRLRPLPFLFFPFFS

SEQ ID NO: 30540 - protein, 270 aa, Diabrotica virgifera
  misc_feature: Coding regions on vcDNA: vcDNA=SeqID_10237; Strand=+; Position=116-927
  misc_feature: Homolog annotation: Hit_ID=AAH74605.1; Match level="QueryCoverage =87%, HitCoverage=33%, E-value=1e-64, Identity=55%"; Hit description =DHX33 protein [Xenopus tropicalis]
  misc_feature: Gene Ontology Annotation: Molecular function=pre-mRNA splicing factor activity; Cellular component=spliceosome complex; Biological process =RNA splicing
  misc_feature: Pfam annotation: Pfam_ID=DEAD; Match level="Score=28.5, E-value=7.9e -08, Copies=1"; Pfam description=DEAD/DEAH box helicase
  misc_feature (207)..(207): Xaa can be any naturally occurring amino acid
  misc_feature (226)..(226): Xaa can be any naturally occurring amino acid
  misc_feature (249)..(249): Xaa can be any naturally occurring amino acid
MMDSKYNNGYAKNGIQKFQMKLKPIPVVFNNKNGPPSPKKMKFNNENHNPSSSNGHLNGKVKISIQDQRRSLPVFDKRKQLLALIEKHKTLIILGETGSGKTTQIPQYIFSVGLNEGGKIAITQPRRVAAISVATRVAEEYGRGKTVGDIVGYSVRFQDCTSNQTKIKFLTDGMLLREAISDRLLMEYRVVILDEAHERTIHTDVLXGIVKRAQKIREDRNLPALXILIMSATMDVDHFSQYFNKWPKXYLEGRTFPCNIHYTIKPHDDY

SEQ ID NO: 30541 - protein, 103 aa, Diabrotica virgifera
  misc_feature: Coding regions on vcDNA: vcDNA=SeqID_10238; Strand=+; Position=191-502
  misc_feature (55)..(79): Xaa can be any naturally occurring amino acid
TTSLVFISDNPFLIYILVDLLLHITMHFVFFGEINMLNFLAVILNLCNKRLKSSXXXXXXXXXXXXXXXXXXXXXXXXXVLTFFLYFVSYYWMLQVFQPCKMD

SEQ ID NO: 30542 - protein, 249 aa, Diabrotica virgifera
  misc_feature: Coding regions on vcDNA: vcDNA=SeqID_10239; Strand=+; Position=159-902
  misc_feature: Homolog annotation: Hit_ID=XP_393415.1; Match level="QueryCoverage =99%, HitCoverage=34%, E-value=6e-97, Identity=75%"; Hit description =similar to ENSANGP00000012563 [Apis mellifera]
  misc_feature: Gene Ontology Annotation: Cellular component=synaptic vesicle; Biological process=calcium ion homeostasis
  misc_feature: Pfam annotation: Pfam_ID=DUF1228; Match level="Score=-26.6, E-value =0.064, Copies=1"; Pfam description=Protein of unknown function (DUF1228)
  misc_feature (166)..(166): Xaa can be any naturally occurring amino acid
  misc_feature (200)..(200): Xaa can be any naturally occurring amino acid
  misc_feature (226)..(226): Xaa can be any naturally occurring amino acid
MVEGESPRNQKQDSDVKIEHLANGCGSKDLELGNFTTTKELPFKLSSDVDKSSDKADFEKAIELTRYGKFHFLLLAVCGFVSTSEEMDVISMSFILPSAQCDLNLNTQTKGWLNSIIFIGMMAGAYVWGSVADSLGRKKVLIVSSFMNALCIVASSFCQTYELFMXVFRFLNGAALGGSGPVIWSYFAEFQPKSKRGSMXLSFMAAFWTLGNLFVAGLAWLIIPSXIGFKKQYFVYNSWRIFLLICSFH

SEQ ID NO: 30543 - protein, 300 aa, Diabrotica virgifera
  misc_feature: Coding regions on vcDNA: vcDNA=SeqID_10240; Strand=-; Position=0-899
  misc_feature (3)..(298): Xaa can be any naturally occurring amino acid
LFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKG

SEQ ID NO: 30544 - protein, 66 aa, Diabrotica virgifera; identical to SEQ ID NO: 26808
  misc_feature: Coding regions on vcDNA: vcDNA=SeqID_10241; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 30545 - protein, 93 aa, Diabrotica virgifera
  misc_feature: Coding regions on vcDNA: vcDNA=SeqID_10242; Strand=+; Position=491-769
  misc_feature: Homolog annotation: Hit_ID=AAF22466.1; Match level="QueryCoverage =67%, HitCoverage=17%, E-value=1e-13, Identity=61%"; Hit description =cytochrome oxidase subunit I [Petrolisthes cinctipes]
  misc_feature (64)..(64): Xaa can be any naturally occurring amino acid
MMNLLLSNTPICLSCRKYMNHYLLLSLPILAGPITTLLPDRTLNTSFSDPAEARDPILYQLLLXDDVHPEEHIILLPLYLLYSHIARSYRISS

SEQ ID NO: 30546 - protein, 258 aa, Diabrotica virgifera
  misc_feature: Coding regions on vcDNA: vcDNA=SeqID_10243; Strand=+; Position=48-824
  misc_feature: Homolog annotation: Hit_ID=XP_307960.1; Match level="QueryCoverage =96%, HitCoverage=21%, E-value=4e-39, Identity=35%"; Hit description =ENSANGP00000013501 [Anopheles gambiae] gb|EAA03817.1| ENSANGP00000013501 [Anopheles gambiae
  misc_feature: Pfam annotation: Pfam_ID=zf-CCCH; Match level="Score=33.8, E-value=5e- 07, Copies=1"; Pfam description=Zinc finger C-x8-C-x5-C-x3-H type (an
MNGEDCIDKTDFFLREIPDVKIGQTAPLKKKIVKEELQYLTLPELIQEKILDTLKYIHGPNFKLSDISDYEESNSNLLKRYWVGQGSLVVKGGVDFSQSRDQPAEEAERLKQFGLMRLESYGFHKNHCLEAFEYCKGDVEDSIYLLYQKYFNFDAAPKEIEHGLSKKELTEQRDDEKSSLESIYEKSFNVKTDDVWILNLKLEYLVDIFHNKDIVKKKPVVKDKREKCRNLLRGNCKFGAKCRFSHEIEQLSFRRFYI

SEQ ID NO: 30547 - protein, 118 aa, Diabrotica virgifera
  misc_feature: Coding regions on vcDNA: vcDNA=SeqID_10244; Strand=+; Position=535-890
  misc_feature: Homolog annotation: Hit_ID=XP_222107.2; Match level="QueryCoverage =96%, HitCoverage=9%, E-value=9e-23, Identity=48%"; Hit description =similar to septin 10 isoform 1 [Rattus norvegicus]
  misc_feature (14)..(14): Xaa can be any naturally occurring amino acid
  misc_feature (45)..(45): Xaa can be any naturally occurring amino acid
  misc_feature (57)..(57): Xaa can be any naturally occurring amino acid
  misc_feature (61)..(61): Xaa can be any naturally occurring amino acid
  misc_feature (81)..(81): Xaa can be any naturally occurring amino acid
  misc_feature (94)..(94): Xaa can be any naturally occurring amino acid
  misc_feature (98)..(98): Xaa can be any naturally occurring amino acid
SPFFAIQLDESTDXQCYQLIVYVRYNQNERMKDKLLFSTELETGXTTKAINVMKAVXSFLXEHELSWQKLISLCTDGAPSXLGFRSGYLQLVIXEKCXDVMGIHCFIHRQALSAKPFK

SEQ ID NO: 30548 - protein, 105 aa, Diabrotica virgifera
  misc_feature: Coding regions on vcDNA: vcDNA=SeqID_10245; Strand=-; Position=116-433
HILWACVSSTVSLQHDVPVTMALSTFINTRTSHTKTSTVISHTRSPLVVTMCPMGYFTLQRHNSSGGHVSMCDLHVTCEGSSSHFLCVAEQSGACGKGYHDSLGP

SEQ ID NO: 30549 - protein, 215 aa, Diabrotica virgifera
  misc_feature: Coding regions on vcDNA: vcDNA=SeqID_10246; Strand=-; Position=3-647
  misc_feature (1)..(1): Xaa can be any naturally occurring amino acid
  misc_feature (6)..(6): Xaa can be any naturally occurring amino acid
  misc_feature (11)..(12): Xaa can be any naturally occurring amino acid
  misc_feature (18)..(18): Xaa can be any naturally occurring amino acid
  misc_feature (23)..(31): Xaa can be any naturally occurring amino acid
  misc_feature (44)..(44): Xaa can be any naturally occurring amino acid
  misc_feature (47)..(55): Xaa can be any naturally occurring amino acid
  misc_feature (57)..(215): Xaa can be any naturally occurring amino acid
XKIEPXWLTRXXLRSCKXLKVDXXXXXXXXXNYKLNPPSRSQSXLSXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30550 - protein, 58 aa, Diabrotica virgifera
  misc_feature: Coding regions on vcDNA: vcDNA=SeqID_10247; Strand=-; Position=0-173
  misc_feature (1)..(26): Xaa can be any naturally occurring amino acid
  misc_feature (31)..(31): Xaa can be any naturally occurring amino acid
  misc_feature (34)..(34): Xaa can be any naturally occurring amino acid
  misc_feature (36)..(57): Xaa can be any naturally occurring amino acid
XXXXXXXXXXXXXXXXXXXXXXXXXXSLVFXKNXSXXXXXXXXXXXXXXXXXXXXXXS

SEQ ID NO: 30551 - protein, 163 aa, Diabrotica virgifera
  misc_feature: Coding regions on vcDNA: vcDNA=SeqID_10248; Strand=+; Position=2-493
  misc_feature (1)..(132): Xaa can be any naturally occurring amino acid
  misc_feature (134)..(147): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXXXXXXXXXXHYRILIFSYLFSIVTW

SEQ ID NO: 30552 - protein, 42 aa, Diabrotica virgifera
  misc_feature: Coding regions on vcDNA: vcDNA=SeqID_10249; Strand=-; Position=1-126
  misc_feature (5)..(5): Xaa can be any naturally occurring amino acid
  misc_feature (13)..(37): Xaa can be any naturally occurring amino acid
  misc_feature (39)..(40): Xaa can be any naturally occurring amino acid
  misc_feature (42)..(42): Xaa can be any naturally occurring amino acid
NYAVXPKGNYFYXXXXXXXXXXXXXXXXXXXXXXXXXIXXNX

SEQ ID NO: 30553 - protein, 59 aa, Diabrotica virgifera
  misc_feature: Coding regions on vcDNA: vcDNA=SeqID_10250; Strand=-; Position=3-179
HLPLSLTTIPTLKYSPLILKYPSPIIYNHHNIKFLLSKRALPLLLFLLSHSLKGLAPPQ

SEQ ID NO: 30554 - protein, 126 aa, Diabrotica virgifera
  misc_feature: Coding regions on vcDNA: vcDNA=SeqID_10251; Strand=-; Position=558-938
  misc_feature (32)..(32): Xaa can be any naturally occurring amino acid
  misc_feature (38)..(38): Xaa can be any naturally occurring amino acid
KVYFLRAYKVHPHLFSMQIHGGYILRPCRVIXNSTKIXNRSCIYMFISTWRLCLRSSHDEKAYLPINYTANCHLSKLLLIVYVVKNLSLNIFLMNSIKITIWLKKCINTDLLFACFVKSLFSKVFL

SEQ ID NO: 30555 - protein, 244 aa, Diabrotica virgifera
  misc_feature: Coding regions on vcDNA: vcDNA=SeqID_10252; Strand=-; Position=1-732
  misc_feature (2)..(244): Xaa can be any naturally occurring amino acid
LXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30556 - protein, 66 aa, Diabrotica virgifera
  misc_feature: Coding regions on vcDNA: vcDNA=SeqID_10253; Strand=-; Position=652-852
  misc_feature (37)..(53): Xaa can be any naturally occurring amino acid
KARIQVLPELGSSKSLQFFGTKASNFLKFIGFWISVXXXXXXXXXXXXXXXXXTTFAAGTIAVCYI

SEQ ID NO: 30557 - protein, 114 aa, Diabrotica virgifera
  misc_feature: Coding regions on vcDNA: vcDNA=SeqID_10254; Strand=-; Position=152-496
  misc_feature (18)..(104): Xaa can be any naturally occurring amino acid
TDFLTPAPEGVVVFFFRXXXXXXXXXXXXXXXXXXXXXXXXXXXXXXXXXXXXXXXXXXXXXXXXXXXXXXXXXXXXXXXXXXXXXXXXXXXXXXXXXXXXXXXLKYIYFVEII

SEQ ID NO: 30558 - protein, 99 aa, Diabrotica virgifera
  misc_feature: Coding regions on vcDNA: vcDNA=SeqID_10255; Strand=-; Position=3-299
  misc_feature (34)..(40): Xaa can be any naturally occurring amino acid
  misc_feature (92)..(98): Xaa can be any naturally occurring amino acid
YTQIIQHDRSSEQMTIIEKPYIGSQREPQYMSFXXXXXXXLTIFFRYSTTRPVIKGPGTHSYIFHKYKIISTTFFTLLVPFTICYIYLLRNXXXXXXXI

SEQ ID NO: 30559 - protein, 92 aa, Diabrotica virgifera
  misc_feature: Coding regions on vcDNA: vcDNA=SeqID_10256; Strand=+; Position=443-721
  misc_feature (3)..(9): Xaa can be any naturally occurring amino acid
  misc_feature (16)..(28): Xaa can be any naturally occurring amino acid
  misc_feature (66)..(75): Xaa can be any naturally occurring amino acid
LIXXXXXXXHTFKDIXXXXXXXXXXXXXPLYDAVLEYKSQLLKSSNDDNITIKQLYILVETYRFNXXXXXXXXXXRIMTVSSCITDGVSSAH

SEQ ID NO: 30560 - protein, 171 aa, Diabrotica virgifera; identical to SEQ ID NO: 27583
  misc_feature: Coding regions on vcDNA: vcDNA=SeqID_10257; Strand=-; Position=4-519
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(166): Xaa can be any naturally occurring amino acid

SEQ ID NO: 30561 - protein, 276 aa, Diabrotica virgifera
  misc_feature: Coding regions on vcDNA: vcDNA=SeqID_10258; Strand=+; Position=114-945
  misc_feature: Homolog annotation: Hit_ID=XP_396250.1; Match level="QueryCoverage =80%, HitCoverage=45%, E-value=2e-17, Identity=25%"; Hit description =similar to ENSANGP00000009437 [Apis mellifera]
  misc_feature (162)..(162): Xaa can be any naturally occurring amino acid
  misc_feature (214)..(220): Xaa can be any naturally occurring amino acid
  misc_feature (246)..(247): Xaa can be any naturally occurring amino acid
  misc_feature (250)..(250): Xaa can be any naturally occurring amino acid
MTIVEPSERHGVEYVPYNTESTEKNNLVQLKPQNQGAKSDTPFLIMTILSGTMLATIAGSQMVWTSPVIPKITSNISDDNPLGRTATTYEISMIAGFPPLASLAGSLFLGQLAEVFGRKRSILILALGNLTTVVCLAFSTNVYCIVVFRCIIFMFFNGAITXPVYLTEICEDHNRARYGCLMGGMLPSGSLFGYVVGSFFTIRVFTLLTLSPLXXXXXXXVCAPESPVYSLSRGRREECLRALRKXXKHXNDKEIEDDMYQIEETKLGKFFFLVYL

SEQ ID NO: 30562 - protein, 169 aa, Diabrotica virgifera
  misc_feature: Coding regions on vcDNA: vcDNA=SeqID_10259; Strand=+; Position=120-627
  misc_feature: Homolog annotation: Hit_ID=AAR89978.1; Match level="QueryCoverage =100%, HitCoverage=36%, E-value=4e-27, Identity=44%"; Hit description= putative elongation factor 1-alpha [Homalodisca coagulata] gb|AAS60203.1| putative elongation factor 1-al
  misc_feature: Pfam annotation: Pfam_ID=GTP_EFTU; Match level="Score=-37.0, E-value =0.00028, Copies=1"; Pfam description=Elongation factor Tu GTP binding domai
  misc_feature (32)..(32): Xaa can be any naturally occurring amino acid
  misc_feature (81)..(81): Xaa can be any naturally occurring amino acid
  misc_feature (95)..(95): Xaa can be any naturally occurring amino acid
  misc_feature (106)..(106): Xaa can be any naturally occurring amino acid
  misc_feature (124)..(129): Xaa can be any naturally occurring amino acid
MHIYISDIERIDAGKSTTTDFLVDICGGIDYXTTIQIEKEFRKKGKGSLYYACALNYLDVDRERDITPSVVLCIINTPFNXDTLLDAPGRIDVFXKMITGTYYTEXAVLIVAAVTGGFPTPISXXXXXXVRALLALTLVRHFVFVRASEKDYPVTAFLESRFEENQKEI

SEQ ID NO: 30563 - protein, 30 aa, Diabrotica virgifera
  misc_feature: Coding regions on vcDNA: vcDNA=SeqID_10260; Strand=-; Position=1-90
  misc_feature (2)..(28): Xaa can be any naturally occurring amino acid
IXXXXXXXXXXXXXXXXXXXXXXXXXXXFL

SEQ ID NO: 30564 - protein, 35 aa, Diabrotica virgifera
  misc_feature: Coding regions on vcDNA: vcDNA=SeqID_10261; Strand=+; Position=1-105
  misc_feature (2)..(33): Xaa can be any naturally occurring amino acid
AXXXXXXXXXXXXXXXXXXXXXXXXXXXXXXXXGG

SEQ ID NO: 30565 - protein, 270 aa, Diabrotica virgifera
  misc_feature: Coding regions on vcDNA: vcDNA=SeqID_10262; Strand=+; Position=125-933
  misc_feature: Homolog annotation: Hit_ID=XP_316049.1; Match level="QueryCoverage =94%, HitCoverage=61%, E-value=5e-65, Identity=48%"; Hit description =ENSANGP00000010847 [Anopheles gambiae]
  misc_feature (220)..(220): Xaa can be any naturally occurring amino acid
  misc_feature (239)..(239): Xaa can be any naturally occurring amino acid
MNNFTSQKQRVLVVCSQKLTTKSVEQRDRAVIEAEKIVGYPTSFLNLRWLLNDEVANIASHLKKLIGTKHPLVHTARELLLNKEVPSWGLIVLLISKAGGLRTKFSHLDCDINAGILHTQRVLAEITEMVRTSNIIHKSVLNITTEDEFQEDLHFGNKLSLLTGDYLLSNSFRELAALKCHPVNELVSTALRDLVEATFIEPRDKQNRPVPASPLSEHKXMLVPHEYEKDLPTLSDVLXNAKAEWTLRHLLDGASLLGKCCQAALMLADH

SEQ ID NO: 30566 - protein, 49 aa, Diabrotica virgifera
  misc_feature: Coding regions on vcDNA: vcDNA=SeqID_10263; Strand=-; Position=1-147
  misc_feature (10)..(10): Xaa can be any naturally occurring amino acid
  misc_feature (25)..(25): Xaa can be any naturally occurring amino acid
  misc_feature (35)..(47): Xaa can be any naturally occurring amino acid
PGLNSDHVNXKSRTDLINILLHQLXNLNPNIEVRXXXXXXXXXXXXXLL

SEQ ID NO: 30567 - protein, 95 aa, Diabrotica virgifera
  misc_feature: Coding regions on vcDNA: vcDNA=SeqID_10264; Strand=-; Position=262-549
  misc_feature (7)..(20): Xaa can be any naturally occurring amino acid
  misc_feature (22)..(37): Xaa can be any naturally occurring amino acid
  misc_feature (40)..(46): Xaa can be any naturally occurring amino acid
  misc_feature (50)..(56): Xaa can be any naturally occurring amino acid
  misc_feature (66)..(90): Xaa can be any naturally occurring amino acid
RAHSNYXXXXXXXXXXXXXXVXXXXXXXXXXXXXXXXIYXXXXXXXLIVXXXXXXXLNNLDLYVNXXXXXXXXXXXXXXXXXXXXXXXXXILICI

SEQ ID NO: 30568 - protein, 290 aa, Diabrotica virgifera
  misc_feature: Coding regions on vcDNA: vcDNA=SeqID_10265; Strand=+; Position=3-872
  misc_feature: Homolog annotation: Hit_ID=XP_310670.1; Match level="QueryCoverage =81%, HitCoverage=26%, E-value=5e-83, Identity=63%"; Hit description =ENSANGP00000020760 [Anopheles gambiae]
  misc_feature: Gene Ontology Annotation: Molecular function=receptor signaling protein activity; Cellular component=soluble fraction; Biological process=signal transduction
  misc_feature: Pfam annotation: Pfam_ID=Beach; Match level="Score=386.8, E-value =2.7e-113, Copies=1"; Pfam description=Beige/BEACH domain
IVSNYSDEKLDFSDPSNYRDLSKPVGALNEVRLNRLLERYQEMTINKFLYGSHYSTPGFVLYYLARLYPHYVLCLQSGRFDHPDRMFNSVADAYKNCLNNMSDFKELIPQFYDINDQGKFLVNNMGINFGYRYNNLKVDNVELPPWASSPKDFINKLRDALESEIVSENLHKWIDLIFGYKQKGERAIQAHNLFYHLCEGAIDLDAISDLNERHALEVQIMEFGQIPKQVFRVPHPQRKTGLTLMTEPLLKPIELSFEDTWKASELELTSYSHKNSVSHLHNEDGERITS

SEQ ID NO: 30569 - protein, 127 aa, Diabrotica virgifera
  misc_feature: Coding regions on vcDNA: vcDNA=SeqID_10266; Strand=+; Position=3-383
  misc_feature (1)..(103): Xaa can be any naturally occurring amino acid
  misc_feature (105)..(105): Xaa can be any naturally occurring amino acid
  misc_feature (109)..(109): Xaa can be any naturally occurring amino acid
  misc_feature (115)..(115): Xaa can be any naturally occurring amino acid
  misc_feature (117)..(117): Xaa can be any naturally occurring amino acid
  misc_feature (119)..(119): Xaa can be any naturally occurring amino acid
  misc_feature (123)..(123): Xaa can be any naturally occurring amino acid
  misc_feature (125)..(125): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXILLXFNFLIXIXIXNFHXLXMV

SEQ ID NO: 30570 - protein, 40 aa, Diabrotica virgifera
  misc_feature: Coding regions on vcDNA: vcDNA=SeqID_10267; Strand=-; Position=1-120
  misc_feature (6)..(6): Xaa can be any naturally occurring amino acid
  misc_feature (10)..(10): Xaa can be any naturally occurring amino acid
PFEAFXWTRXLLDTEGGRKMSRPRDVGRHLKRFERACVGR

SEQ ID NO: 30571 - protein, 73 aa, Diabrotica virgifera
  misc_feature: Coding regions on vcDNA: vcDNA=SeqID_10268; Strand=-; Position=2-220
QVQRTLNLSSYILTILSQYSLSYQVPSYKNIPKCRIEKTSSIGVNGYLSHPTEIVLDVGLRVPKEPIIFTGFR

SEQ ID NO: 30572 - protein, 69 aa, Diabrotica virgifera
  misc_feature: Coding regions on vcDNA: vcDNA=SeqID_10269; Strand=+; Position=628-837
  misc_feature (45)..(45): Xaa can be any naturally occurring amino acid
LAPSMRVRYKNKFMVCISYKNFLLSKPQLFFSFLPLQRRCYLFFXHPIYPKIYLPILCPTLTLQYKEHF

SEQ ID NO: 30573 - protein, 73 aa, Diabrotica virgifera
  misc_feature: Coding regions on vcDNA: vcDNA=SeqID_10270; Strand=+; Position=179-400
  misc_feature (40)..(49): Xaa can be any naturally occurring amino acid
SNKIPDCMVYLLYKYNRMGKVVAFPHIGYLYFLRYMVVSXXXXXXXXXXMFSIISILRVDLNDTHCTRDLLCS

SEQ ID NO: 30574 - protein, 38 aa, Diabrotica virgifera
  misc_feature: Coding regions on vcDNA: vcDNA=SeqID_10271; Strand=-; Position=1-114
  misc_feature (1)..(1): Xaa can be any naturally occurring amino acid
  misc_feature (4)..(12): Xaa can be any naturally occurring amino acid
  misc_feature (20)..(20): Xaa can be any naturally occurring amino acid
  misc_feature (25)..(25): Xaa can be any naturally occurring amino acid
  misc_feature (29)..(29): Xaa can be any naturally occurring amino acid
XKSXXXXXXXXXPIINLIHXRGRNXYYRXELSNKITLL

SEQ ID NO: 30575 - protein, 243 aa, Diabrotica virgifera
  misc_feature: Coding regions on vcDNA: vcDNA=SeqID_10272; Strand=-; Position=1-729
  misc_feature (6)..(6): Xaa can be any naturally occurring amino acid
  misc_feature (8)..(18): Xaa can be any naturally occurring amino acid
  misc_feature (22)..(148): Xaa can be any naturally occurring amino acid
  misc_feature (150)..(243): Xaa can be any naturally occurring amino acid
LFTKNXNXXXXXXXXXXXIHPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30576 - protein, 245 aa, Diabrotica virgifera
  misc_feature: Coding regions on vcDNA: vcDNA=SeqID_10273; Strand=+; Position=3-738
  misc_feature: Homolog annotation: Hit_ID=EAA00853.2; Match level="QueryCoverage =71%, HitCoverage=41%, E-value=3e-17, Identity=33%"; Hit description =ENSANGP00000011627 [Anopheles gambiae str. PEST] ref|XP_551262.1| ENSANGP00000011627 [Anopheles gambiae st
  misc_feature: Gene Ontology Annotation: Molecular function=molecular_function unknown
  misc_feature: Pfam annotation: Pfam_ID=APH; Match level="Score=-13.8, E-value =0.023, Copies=1"; Pfam description=Phosphotransferase enzyme family
  misc_feature (14)..(14): Xaa can be any naturally occurring amino acid
WAELILREYGKLHXLSLAFRDQHPEEFRDLCRRFPNIHSIFAAQNDMHEYVESRIEEMVNVLKTNGDVELSVRLQAELEDGFKIEDDEIRAVDEQYVICHGDNWNNNYMFKYSADNGCQIPNSVMLLDWQLSGIRSPAQDLSNFLFLTCSQKELDQLENLLHIYHDALTDRLKLLGSSTNLFTFDDLKRHWKEHSSSGLLSMVIDQDSDVMESAEILFYRAKAAVSTYFKYQEIFLINDLYFALK

SEQ ID NO: 30577 - protein, 88 aa, Diabrotica virgifera
  misc_feature: Coding regions on vcDNA: vcDNA=SeqID_10274; Strand=-; Position=1-264
  misc_feature (3)..(88): Xaa can be any naturally occurring amino acid
LYXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30578 - protein, 255 aa, Diabrotica virgifera
  misc_feature: Coding regions on vcDNA: vcDNA=SeqID_10275; Strand=-; Position=0-764
  misc_feature (1)..(239): Xaa can be any naturally occurring amino acid
  misc_feature (241)..(251): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXXXXXXXGREG

SEQ ID NO: 30579 - protein, 92 aa, Diabrotica virgifera
  misc_feature: Coding regions on vcDNA: vcDNA=SeqID_10276; Strand=+; Position=1-279
  misc_feature (4)..(69): Xaa can be any naturally occurring amino acid
LRSXXXXXXXXXXXXXXXXXXXXXXXXXXXXXXXXXXXXXXXXXXXXXXXXXXXXXXXXXXXXXXXXXXQHYLRICVCSNAGLRLLFGQRFR

SEQ ID NO: 30580 - protein, 89 aa, Diabrotica virgifera
  misc_feature: Coding regions on vcDNA: vcDNA=SeqID_10277; Strand=-; Position=1-267
  misc_feature (5)..(25): Xaa can be any naturally occurring amino acid
  misc_feature (28)..(89): Xaa can be any naturally occurring amino acid
SFPNXXXXXXXXXXXXXXXXXXXXXYRXXXXXXXXXXXXXXXXXXXXXXXXXXXXXXXXXXXXXXXXXXXXXXXXXXXXXXXXXXXXXX

SEQ ID NO: 30581 - protein, 255 aa, Diabrotica virgifera
  misc_feature: Coding regions on vcDNA: vcDNA=SeqID_10278; Strand=+; Position=3-770
  misc_feature (36)..(41): Xaa can be any naturally occurring amino acid
  misc_feature (199)..(204): Xaa can be any naturally occurring amino acid
  misc_feature (250)..(255): Xaa can be any naturally occurring amino acid
YVRTDLMSSPDSGIFSYNTMCSQDSGYISQSFSVEXXXXXXSQPPSPDAELDRVLAKFEEAATNEPYYLLESTYPMSSFNIKIGLSPARDFSPSIMLYRHGTCNKISLHTNEWATIIEWLKERLVDFFQADLPTFADEYDPIELKCGDFYTLRQLVMENVKLVTIEKFGVEYYLWEGEVNQILEADQSMMSHKVMLLKXXXXXXYYINLSTFIKKNLYVKDPLYGPVEAFNAYCAICPDTLLSLALREYXXXXXX

SEQ ID NO: 30582 - protein, 99 aa, Diabrotica virgifera
  misc_feature: Coding regions on vcDNA: vcDNA=SeqID_10279; Strand=-; Position=597-896
  misc_feature (12)..(12): Xaa can be any naturally occurring amino acid
SSSTARKLGCTXSHVIVATRSTRCRTCALSTKSAYQRHCNAVPACTIIIFFYTDPFPIVRIPFCYVWQSISSIVQRNFFSSFSNSFAAVKTRLFLMFPI

SEQ ID NO: 30583 - protein, 115 aa, Diabrotica virgifera
  misc_feature: Coding regions on vcDNA: vcDNA=SeqID_10280; Strand=-; Position=823 -1170
  misc_feature (1)..(43): Xaa can be any naturally occurring amino acid
  misc_feature (56)..(100): Xaa can be any naturally occurring amino acid
XXXXXXXXXXXXXXXXXXXXXXXXXXXXXXXXXXXXXXXXXXXYISPLINYNFIHXXXXXXXXXXXXXXXXXXXXXXXXXXXXXXXXXXXXXXXXXXXXXYIPPKTKTFYILFNI

SEQ ID NO: 30584 - protein, 82 aa, Diabrotica virgifera
  misc_feature: Coding regions on vcDNA: vcDNA=SeqID_10281; Strand=-; Position=283-531
  misc_feature (43)..(49): Xaa can be any naturally occurring amino acid
KTGHRISWRLRVPNRVRPGRICFEGDVRGHILKFFRKNCAITXXXXXXXFISTVGGIRGVQVLGRGNEKRPCASRGEILQLS

SEQ ID NO: 30585 - protein, 337 aa, Diabrotica virgifera
  misc_feature: Coding regions on vcDNA: vcDNA=SeqID_10282; Strand=-; Position=2-1012
  misc_feature (7)..(68): Xaa can be any naturally occurring amino acid
  misc_feature (70)..(335): Xaa can be any naturally occurring amino acid
PKVIYSXXXXXXXXXXXXXXXXXXXXXXXXXXXXXXXXXXXXXXXXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDA

SEQ ID NO: 30586 - protein, 148 aa, Diabrotica virgifera
  misc_feature: Coding regions on vcDNA: vcDNA=SeqID_10283; Strand=-; Position=2-445
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(146): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXAV

SEQ ID NO: 30587 - protein, 230 aa, Diabrotica virgifera
  misc_feature: Coding regions on vcDNA: vcDNA=SeqID_10284; Strand=+; Position=159-851
  misc_feature: Homolog annotation: Hit_ID=XP_320075.1; Match level="QueryCoverage =86%, HitCoverage=43%, E-value=1e-21, Identity=36%"; Hit description =ENSANGP00000012365 [Anopheles gambiae]
  misc_feature: Gene Ontology Annotation: Cellular component=membrane; Biological process=lipid metabolism
  misc_feature (211)..(211): Xaa can be any naturally occurring amino acid
MNTTIPEIISSSSIPIRNRAGFETIAVILPSFFYSLIIVVLETYISLKTSSKFVLELATIVLPITLGMTLLSEYSNLMIGVLSMLSALLLGVSYKKRTSTKKSDSFHTSFITNSRSTINILSVIAILAVDFDIFPSRFTKMDTLGYSLMDTGVGLYVFANGIVSPESRGVKNPISKSIKGSLPLFLIGSARFVLTKLFHYHLPEGEYGVHXEFFYNSSCHQTVHFVPSRF

SEQ ID NO: 30588 - protein, 76 aa, Diabrotica virgifera
  misc_feature: Coding regions on vcDNA: vcDNA=SeqID_10285; Strand=-; Position=153-383
  misc_feature (66)..(73): Xaa can be any naturally occurring amino acid
YRHTFRHFYFTYFSQFFYFFSSIFYFSLDNHKAYFVITKNLMSFLCFMEHSRLDLKLRICCVNVNXXXXXXXXFFL

SEQ ID NO: 30589 - protein, 69 aa, Diabrotica virgifera
  misc_feature: Coding regions on vcDNA: vcDNA=SeqID_10286; Strand=-; Position=63-272
ANSGRTGEADHEADYKAKAITFGLRFVSLSIVIGRSFSRGTQAQALSGLFVVVDSTRIKNSVFLFIMNS

SEQ ID NO: 30590 - protein, 138 aa, Diabrotica virgifera
  misc_feature: Coding regions on vcDNA: vcDNA=SeqID_10287; Strand=-; Position=2-415
LNKCCLCSLDYSLSPKTRSPPGDSDNMDRYGVSILEMESISARARITNSECDIFVIFSHLQGSSPLISVSKYMLALRKLLLRMVFVSVIRNSDHVSWLLTPQKGFMEYSVFAQYRWQMTDSFITMALWYLSQVEWADA

SEQ ID NO: 30591 - protein, 32 aa, Diabrotica virgifera
  misc_feature: Coding regions on vcDNA: vcDNA=SeqID_10288; Strand=-; Position=1-96
  misc_feature (3)..(32): Xaa can be any naturally occurring amino acid
PKXXXXXXXXXXXXXXXXXXXXXXXXXXXXXX

SEQ ID NO: 30592 - protein, 99 aa, Diabrotica virgifera
  misc_feature: Coding regions on vcDNA: vcDNA=SeqID_10289; Strand=+; Position=44-340
  misc_feature: Homolog annotation: Hit_ID=BAC87222.1; Match level="QueryCoverage =97%, HitCoverage=87%, E-value=2e-11, Identity=29%"; Hit description =unnamed protein product [Homo sapiens]
  misc_feature (11)..(11): Xaa can be any naturally occurring amino acid
  misc_feature (23)..(23): Xaa can be any naturally occurring amino acid
  misc_feature (27)..(27): Xaa can be any naturally occurring amino acid
  misc_feature (57)..(66): Xaa can be any naturally occurring amino acid
  misc_feature (82)..(88): Xaa can be any naturally occurring amino acid
PPIKGERERLXERKKRRRGKKKXKRKXGKEEREERRERKEKEKKRKKGERKRKKRKXXXXXXXXXXKERRKEKGRGRKKGKXXXXXXXKGEKRERKRGE

SEQ ID NO: 30593 - protein, 271 aa, Diabrotica virgifera
  misc_feature: Coding regions on vcDNA: vcDNA=SeqID_10290; Strand=+; Position=116-928
  misc_feature: Homolog annotation: Hit_ID=XP_393046.1; Match level="QueryCoverage =80%, HitCoverage=90%, E-value=1e-113, Identity=91%"; Hit description= similar to CG13852-PA [Apis mellifera]
  misc_feature: Gene Ontology Annotation: Molecular function=kinase regulator activity; Cellular component=bud neck; Biological process=mitosis
  misc_feature: Pfam annotation: Pfam_ID=Mob1_phocein; Match level="Score=396.0, E -value=4.9e-116, Copies=1"; Pfam description=Mob1/phocein family
  misc_feature (205)..(211): Xaa can be any naturally occurring amino acid
NVVAIVYDCKVKTINCCFYVFTMSFLFGSRSSKTFKPKKNIPEGTHQYELMKHAAATLGSGNLRLAVMLPEGEDLNEWVAVNTVDFFNQINMLYGTITEFCTEDSCPIMSAGPKYEYHWADGHTVKKPIKCSAPKYIDYLMTWVQDQLDDETLFPSKIGVPFPKNFQSIAKTILKRLFRVYAHIYHQHFSEVVQLGEEAHLNTSXXXXXXXVQEFSLIDRRELAPLQELIDKLTAKETRLNNLSLIGSIYLCLVFNLTRVIPFALRKNLTR

SEQ ID NO: 30594 - protein, 249 aa, Diabrotica virgifera
  misc_feature: Coding regions on vcDNA: vcDNA=SeqID_10291; Strand=-; Position=1-747
  misc_feature (3)..(232): Xaa can be any naturally occurring amino acid
  misc_feature (235)..(249): Xaa can be any naturally occurring amino acid
KKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 30595 - protein, 143 aa, Diabrotica virgifera
  misc_feature: Coding regions on vcDNA: vcDNA=SeqID_10292; Strand=+; Position=80-508
  misc_feature (52)..(61): Xaa can be any naturally occurring amino acid
  misc_feature (73)..(83): Xaa can be any naturally occurring amino acid
  misc_feature (98)..(134): Xaa can be any naturally occurring amino acid
YRRDEHLTFLKEKISHFSYLVYQGSTQSQSIHHHLFTFEFQKSSKNLKIFLXXXXXXXXXXVIETLFVFQIIXXXXXXXXXXXLSQQYILSIKYFSSXXXXXXXXXXXXXXXXXXXXXXXXXXXXXXXXXXXXXLLSYFYHIY

SEQ ID NO: 30596 - protein, 109 aa, Diabrotica virgifera
  misc_feature: Coding regions on vcDNA: vcDNA=SeqID_10293; Strand=-; Position=2-328
  misc_feature (6)..(17): Xaa can be any naturally occurring amino acid
  misc_feature (74)..(108): Xaa can be any naturally occurring amino acid
SVHILXXXXXXXXXXXXPTGERGEGSTAGQLGRNPGFSITHHIKNRPTGINLGAIMNRFLFPPPPGLTWYLCRXXXXXXXXXXXXXXXXXXXXXXXXXXXXXXXXXXXP

SEQ ID NO: 30597 - protein, 17 aa, Diabrotica virgifera
  misc_feature: Coding regions on vcDNA: vcDNA=SeqID_10294; Strand=-; Position=2-52
  misc_feature (13)..(17): Xaa can be any naturally occurring amino acid
DKLKSYKNVFYSXXXXX

SEQ ID NO: 30598 - protein, 159 aa, Diabrotica virgifera
  misc_feature: Coding regions on vcDNA: vcDNA=SeqID_10295; Strand=-; Position=2-478
  misc_feature (1)..(8): Xaa can be any naturally occurring amino acid
  misc_feature (10)..(23): Xaa can be any naturally occurring amino acid
  misc_feature (28)..(46): Xaa can be any naturally occurring amino acid
  misc_feature (55)..(65): Xaa can be any naturally occurring amino acid
  misc_feature (70)..(93): Xaa can be any naturally occurring amino acid
  misc_feature (96)..(106): Xaa can be any naturally occurring amino acid
  misc_feature (116)..(123): Xaa can be any naturally occurring amino acid
  misc_feature (126)..(139): Xaa can be any naturally occurring amino acid
  misc_feature (145)..(158): Xaa can be any naturally occurring amino acid
XXXXXXXXPXXXXXXXXXXXXXXIARSXXXXXXXXXXXXXXXXXXXQSHAFNKHXXXXXXXXXXXPTYFXXXXXXXXXXXXXXXXXXXXXXXXPFXXXXXXXXXXXTNLAHTGLNXXXXXXXXSNXXXXXXXXXXXXXXPTSRSXXXXXXXXXXXXXXV

SEQ ID NO: 30599 - protein, 267 aa, Diabrotica virgifera
  misc_feature: Coding regions on vcDNA: vcDNA=SeqID_10296; Strand=-; Position=1-801
  misc_feature (2)..(52): Xaa can be any naturally occurring amino acid
  misc_feature (55)..(233): Xaa can be any naturally occurring amino acid
  misc_feature (235)..(264): Xaa can be any naturally occurring amino acid
KXXXXXXXXXXXXXXXXXXXXXXXXXXXXXXXXXXXXXXXXXXXXXXXXXXXQWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXEKD

SEQ ID NO: 30600 - protein, 16 aa, Diabrotica virgifera
  misc_feature: Coding regions on vcDNA: vcDNA=SeqID_10297; Strand=-; Position=5-55
  misc_feature (6)..(7): Xaa can be any naturally occurring amino acid
YYRLTXXNKITLLSLR

SEQ ID NO: 30601 - protein, 88 aa, Diabrotica virgifera
  misc_feature: Coding regions on vcDNA: vcDNA=SeqID_10298; Strand=-; Position=151-417
RDSVVMKEQQDTLSPKFMTNKSSISIQSKYFTVSTLVLNKCYAIKDRLDMLTIEWHIIARNSSYGYNWCNRNSQVVVFLFSILLTLSS

SEQ ID NO: 30602 - protein, 48 aa, Diabrotica virgifera
  misc_feature: Coding regions on vcDNA: vcDNA=SeqID_10299; Strand=-; Position=2-145
  misc_feature (17)..(48): Xaa can be any naturally occurring amino acid
TDSSDYIPLALSQMCAXXXXXXXXXXXXXXXXXXXXXXXXXXXXXXXX

SEQ ID NO: 30603 - protein, 33 aa, Diabrotica virgifera
  misc_feature: Coding regions on vcDNA: vcDNA=SeqID_10300; Strand=-; Position=32-133
YLDSGVTLQNVLNYTDIIIYHHTNCQASDNILQ

SEQ ID NO: 30604 - protein, 90 aa, Diabrotica virgifera
  misc_feature: Coding regions on vcDNA: vcDNA=SeqID_10301; Strand=+; Position=1-273
  misc_feature (3)..(70): Xaa can be any naturally occurring amino acid
LSXXXXXXXXXXXXXXXXXXXXXXXXXXXXXXXXXXXXXXXXXXXXXXXXXXXXXXXXXXXXXXXXXXXXIFIEELLFYLFCRMIEVVGL

SEQ ID NO: 30605 - protein, 259 aa, Diabrotica virgifera
  misc_feature: Coding regions on vcDNA: vcDNA=SeqID_10302; Strand=+; Position=115-891
  misc_feature: Homolog annotation: Hit_ID=NP_694591.1; Match level="QueryCoverage =75%, HitCoverage=21%, E-value=7e-09, Identity=26%"; Hit description =tudor domain containing 9 [Homo sapiens] dbj|BAC86372.1| unnamed protein product [Homo sapiens]
  misc_feature: Pfam annotation: Pfam_ID=TUDOR; Match level="Score=47.0, E-value=5.5e- 11, Copies=1"; Pfam description=Tudor domain
  misc_feature (132)..(143): Xaa can be any naturally occurring amino acid
MPSTFADRNCFSLGAHNPIPGLDVEWITLKITEYEDAGHFWANNLESEPYLTALEEILNKAILHSVVSRGQTVEVGSTYAARFVEDNMFYRCKVFSVSPTYAEVRFIDYGNMQRVPIKEIYLLPNRPECSFXXXXXXXXXXXXKPSRKANIRGIWSEATTNFVKKHTFNILLYGRVHSVVDKVVYLEVYKRDPHMNNSKSLNLVMLEDGWAEPAIESYHSRDDSNNRQVYASDKSRAEAVRVSFDKVPSYDDFDAPQMS

SEQ ID NO: 30606 - protein, 97 aa, Diabrotica virgifera
  misc_feature: Coding regions on vcDNA: vcDNA=SeqID_10303; Strand=-; Position=2-292
  misc_feature (3)..(13): Xaa can be any naturally occurring amino acid
  misc_feature (73)..(93): Xaa can be any naturally occurring amino acid
  misc_feature (97)..(97): Xaa can be any naturally occurring amino acid
GAXXXXXXXXXXXTPPGPPRLTPNMKFKSDPYYNNLPPIKTYSTRGPHFYFGCPPQKNPAASLGYFFLKPKKXXXXXXXXXXXXXXXXXXXXXPQIX

SEQ ID NO: 30607 - protein, 17 aa, Diabrotica virgifera
  misc_feature: Coding regions on vcDNA: vcDNA=SeqID_10304; Strand=-; Position=0-50
  misc_feature (1)..(14): Xaa can be any naturally occurring amino acid
XXXXXXXXXXXXXXTPT

SEQ ID NO: 30608 - protein, 54 aa, Diabrotica virgifera
  misc_feature: Coding regions on vcDNA: vcDNA=SeqID_10305; Strand=+; Position=63-227
  misc_feature (10)..(17): Xaa can be any naturally occurring amino acid
  misc_feature (24)..(30): Xaa can be any naturally occurring amino acid
LTLTYLINEXXXXXXXXAKNLTLXXXXXXXKIPVYHIPCTCNSTIPFVFIVIVF

SEQ ID NO: 30609 - protein, 29 aa, Diabrotica virgifera
  misc_feature: Coding regions on vcDNA: vcDNA=SeqID_10306; Strand=-; Position=2-88
SLCLDSFVIFDGIDPLTIKPDAGAGIRPD

SEQ ID NO: 30610 - protein, 78 aa, Diabrotica virgifera; identical to SEQ ID NO: 29528
  misc_feature: Coding regions on vcDNA: vcDNA=SeqID_10307; Strand=-; Position=2-235
  misc_feature (1)..(12): Xaa can be any naturally occurring amino acid
  misc_feature (15)..(25): Xaa can be any naturally occurring amino acid
  misc_feature (35)..(42): Xaa can be any naturally occurring amino acid
  misc_feature (45)..(58): Xaa can be any naturally occurring amino acid
  misc_feature (64)..(77): Xaa can be any naturally occurring amino acid

SEQ ID NO: 30611 - protein, 50 aa, Diabrotica virgifera
  misc_feature: Coding regions on vcDNA: vcDNA=SeqID_10308; Strand=-; Position=1-150
  misc_feature (24)..(24): Xaa can be any naturally occurring amino acid
  misc_feature (27)..(28): Xaa can be any naturally occurring amino acid
  misc_feature (36)..(46): Xaa can be any naturally occurring amino acid
SRFPQFSSYKHSFSTYHLLQIIAXPFXXLNISPFKXXXXXXXXXXXALGR

SEQ ID NO: 30612 - protein, 65 aa, Diabrotica virgifera
  misc_feature: Coding regions on vcDNA: vcDNA=SeqID_10309; Strand=-; Position=0-194
  misc_feature (18)..(61): Xaa can be any naturally occurring amino acid
KNSAVSLGNLSIIKKFGXXXXXXXXXXXXXXXXXXXXXXXXXXXXXXXXXXXXXXXXXXXXGSLV

SEQ ID NO: 30613 - protein, 50 aa, Diabrotica virgifera
  misc_feature: Coding regions on vcDNA: vcDNA=SeqID_10310; Strand=-; Position=236-388
NMNFFRHKLLYKVHYQQILFFSEFLRMFNINDMDIFHFPYCVNKYILYMK

SEQ ID NO: 30614 - protein, 99 aa, Diabrotica virgifera
  misc_feature: Coding regions on vcDNA: vcDNA=SeqID_10311; Strand=-; Position=197-496
CCSAWLYMTDIVRFVAIIYFAVPHLHILSRSRVINLYLLPPVVREVSVMDVHWGEHQSAMEVIHQGHGIVGPQYYFGSDHGRVPFRGNNILDYVALARS

SEQ ID NO: 30615 - protein, 147 aa, Diabrotica virgifera
  misc_feature: Coding regions on vcDNA: vcDNA=SeqID_10312; Strand=+; Position=2-445
  misc_feature (41)..(48): Xaa can be any naturally occurring amino acid
NVAEQRQLNRIVETEDHIRQSMPLPPMSFLAKVPSSPSCDXXXXXXXXTIYDDTWVSQFTTVKEEPEDRLSHPQITPASLDDLDRIDDLLPMDGINLEELADIDTNFDTASNSSGSHLDFSCPKDIPMFSNIENETWAEMQTAAFLM

SEQ ID NO: 30616 - protein, 122 aa, Diabrotica virgifera
  misc_feature: Coding regions on vcDNA: vcDNA=SeqID_10313; Strand=+; Position=1-369
  misc_feature (6)..(17): Xaa can be any naturally occurring amino acid
  misc_feature (19)..(32): Xaa can be any naturally occurring amino acid
  misc_feature (34)..(46): Xaa can be any naturally occurring amino acid
  misc_feature (49)..(62): Xaa can be any naturally occurring amino acid
  misc_feature (76)..(85): Xaa can be any naturally occurring amino acid
  misc_feature (99)..(122): Xaa can be any naturally occurring amino acid
PPLASXXXXXXXXXXXXKXXXXXXXXXXXXXXEXXXXXXXXXXXXXHLXXXXXXXXXXXXXXLEYQRAKQLYCLLXXXXXXXXXXVSCLRISIYLINKXXXXXXXXXXXXXXXXXXXXXXXX

SEQ ID NO: 30617 - protein, 170 aa, Diabrotica virgifera
  misc_feature: Coding regions on vcDNA: vcDNA=SeqID_10314; Strand=-; Position=11-523
  misc_feature (26)..(46): Xaa can be any naturally occurring amino acid
  misc_feature (55)..(90): Xaa can be any naturally occurring amino acid
  misc_feature (92)..(143): Xaa can be any naturally occurring amino acid
  misc_feature (149)..(158): Xaa can be any naturally occurring amino acid
RDHTNSSVGRRVFIYYTKRHVYNQQXXXXXXXXXXXXXXXXXXXXXIILIFSSIXXXXXXXXXXXXXXXXXXXXXXXXXXXXXXXXXXXXLXXXXXXXXXXXXXXXXXXXXXXXXXXXXXXXXXXXXXXXXXXXXXXXXXXXXSITFLXXXXXXXXXXTIKIKYFRSLLK

SEQ ID NO: 30618 - protein, 32 aa, Diabrotica virgifera
  misc_feature: Coding regions on vcDNA: vcDNA=SeqID_10315; Strand=-; Position=0-95
  misc_feature (2)..(29): Xaa can be any naturally occurring amino acid
LXXXXXXXXXXXXXXXXXXXXXXXXXXXXSIP

SEQ ID NO: 30619 - protein, 24 aa, Diabrotica virgifera
  misc_feature: Coding regions on vcDNA: vcDNA=SeqID_10316; Strand=-; Position=1-72
  misc_feature (1)..(24): Xaa can be any naturally occurring amino acid
XXXXXXXXXXXXXXXXXXXXXXXX

SEQ ID NO: 30620 - protein, 146 aa, Diabrotica virgifera
  misc_feature: Coding regions on vcDNA: vcDNA=SeqID_10317; Strand=+; Position=2-637
  misc_feature: Homolog annotation: Hit_ID=AAF87759.1; Match level="QueryCoverage =100%, HitCoverage=49%, E-value=1e-55, Identity=60%"; Hit description= cytochrome oxidase subunit I [Diabrotica virgifera virgifera]
  misc_feature: Pfam annotation: Pfam_ID=COX1; Match level="Score=-182.2, E-value =4.7e-05, Copies=1"; Pfam description=Cytochrome C and Quinol oxidase polyp
  misc_feature (9)..(9): Xaa can be any naturally occurring amino acid
  misc_feature (63)..(63): Xaa can be any naturally occurring amino acid
  misc_feature (98)..(98): Xaa can be any naturally occurring amino acid
FDRIPLFVXAVVITAILLLLSLPVLAGAITILLTDRNLNTSFFDPAGIIYAIIAIGLLGFIVXAHHIFTVGMDVDTRAYFTSATIIIAVPTGIKVFRXLATYHGTTITYRLTGVVLANSSIDIVLHDTYYVVAIGAVFAIIAGFIQ

SEQ ID NO: 30621 - protein, 264 aa, Diabrotica virgifera
  misc_feature: Coding regions on vcDNA: vcDNA=SeqID_10318; Strand=-; Position=0-791
  misc_feature (12)..(260): Xaa can be any naturally occurring amino acid
NFYKASFFFIHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAPGG

SEQ ID NO: 30622 - protein, 67 aa, Diabrotica virgifera
  misc_feature: Coding regions on vcDNA: vcDNA=SeqID_10319; Strand=-; Position=2-202
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (56)..(64): Xaa can be any naturally occurring amino acid
FXXXXXXXXXXXNQPGSHRFKXXXXXXXXXEXXXXXXXXXXXXXXSNIEVAIFMIXXXXXXXXXSDL

SEQ ID NO: 30623 - protein, 157 aa, Diabrotica virgifera
  misc_feature: Coding regions on vcDNA: vcDNA=SeqID_10320; Strand=+; Position=2-475
  misc_feature (1)..(136): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXITYFYILLCLFAIILLIKRSP

SEQ ID NO: 30624 - protein, 284 aa, Diabrotica virgifera
  misc_feature: Coding regions on vcDNA: vcDNA=SeqID_10321; Strand=-; Position=1-852
  misc_feature (2)..(284): Xaa can be any naturally occurring amino acid
NXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30625 - protein, 123 aa, Diabrotica virgifera
  misc_feature: Coding regions on vcDNA: vcDNA=SeqID_10322; Strand=+; Position=6-377
  misc_feature (5)..(11): Xaa can be any naturally occurring amino acid
  misc_feature (17)..(43): Xaa can be any naturally occurring amino acid
  misc_feature (47)..(60): Xaa can be any naturally occurring amino acid
  misc_feature (64)..(84): Xaa can be any naturally occurring amino acid
  misc_feature (90)..(121): Xaa can be any naturally occurring amino acid
RPPYXXXXXXXKTFRKXXXXXXXXXXXXXXXXXXXXXXXXXXXVVYXXXXXXXXXXXXXXFIRXXXXXXXXXXXXXXXXXXXXXVLVFKXXXXXXXXXXXXXXXXXXXXXXXXXXXXXXXXKS

SEQ ID NO: 30626 - protein, 34 aa, Diabrotica virgifera; identical to SEQ ID NO: 27603
  misc_feature: Coding regions on vcDNA: vcDNA=SeqID_10323; Strand=-; Position=80-184

SEQ ID NO: 30627 - protein, 139 aa, Diabrotica virgifera
  misc_feature: Coding regions on vcDNA: vcDNA=SeqID_10324; Strand=-; Position=199-618
  misc_feature (30)..(40): Xaa can be any naturally occurring amino acid
  misc_feature (77)..(92): Xaa can be any naturally occurring amino acid
LIPCIHLYILTILPPFLHLTRYPHASTLSXXXXXXXXXXXRHLHYVYINLHYNISFITTISSPKFYFYLKCQYKLIXXXXXXXXXXXXXXXXLMIIILLINSFHLFVIILHISQITSDFITQKYSLYYLHFNIIHSFLL

SEQ ID NO: 30628 - protein, 130 aa, Diabrotica virgifera
  misc_feature: Coding regions on vcDNA: vcDNA=SeqID_10325; Strand=+; Position=2-394
  misc_feature (5)..(17): Xaa can be any naturally occurring amino acid
  misc_feature (20)..(39): Xaa can be any naturally occurring amino acid
  misc_feature (48)..(64): Xaa can be any naturally occurring amino acid
  misc_feature (70)..(95): Xaa can be any naturally occurring amino acid
  misc_feature (98)..(116): Xaa can be any naturally occurring amino acid
WRGEXXXXXXXXXXXXXGGXXXXXXXXXXXXXXXXXXXXGGGVSYTCXXXXXXXXXXXXXXXXXFLITNXXXXXXXXXXXXXXXXXXXXXXXXXXDNXXXXXXXXXXXXXXXXXXXYKRGSRPFFFSRVI

SEQ ID NO: 30629 - protein, 69 aa, Diabrotica virgifera
  misc_feature: Coding regions on vcDNA: vcDNA=SeqID_10326; Strand=+; Position=54-263
  misc_feature: Homolog annotation: Hit_ID=CAE47497.1; Match level="QueryCoverage =94%, HitCoverage=20%, E-value=1e-17, Identity=53%"; Hit description =cathepsin L-like proteinase [Diabrotica virgifera virgifera]
  misc_feature: Gene Ontology Annotation: Molecular function=cathepsin K activity; Cellular component=extracellular space; Biological process =proteolysis and peptidolysis
KYYAGGIYDDKYCGDNINHAIIATGYTDEYIVIKNSWGEEWGEDGYMRIARGKNICHINDDNSYPILSS

SEQ ID NO: 30630 - protein, 200 aa, Diabrotica virgifera
  misc_feature: Coding regions on vcDNA: vcDNA=SeqID_10327; Strand=+; Position=165-767
  misc_feature: Homolog annotation: Hit_ID=XP_395079.1; Match level="QueryCoverage =87%, HitCoverage=29%, E-value=3e-28, Identity=42%"; Hit description =similar to ENSANGP00000016599 [Apis mellifera]
  misc_feature: Gene Ontology Annotation: Molecular function=heparin binding; Cellular component=extracellular; Biological process=fatty acid metabolism
  misc_feature: Pfam annotation: Pfam_ID=Lipase; Match level="Score=-25.4, E-value =1.3e-10, Copies=1"; Pfam description=Lipase
MKSTDRKGSHFDLYPTRILIHGHGENGQSSWVLTARNAYLGLREPHNVVIVDWATGAAPYETAAANTKPLGELIGKYILDNELELEKLQLIGVGMGAHAAGQAGKYITRVSLHHIGRITGLDVAGPKFELDSVPAEGKLQKTDAFFVDTVHTNVQKFGYKCPIGHVDWYVNGGNVQPGCPVLDSPDLDVCREFTRPRPVC

SEQ ID NO: 30631 - protein, 285 aa, Diabrotica virgifera
  misc_feature: Coding regions on vcDNA: vcDNA=SeqID_10328; Strand=+; Position=1-858
  misc_feature: Homolog annotation: Hit_ID=XP_318885.1; Match level="QueryCoverage =98%, HitCoverage=41%, E-value=1e-105, Identity=63%"; Hit description= ENSANGP00000015756 [Anopheles gambiae]
  misc_feature: Gene Ontology Annotation: Molecular function=zinc ion binding; Cellular component=endoplasmic reticulum; Biological process=cell -cell signaling
  misc_feature: Pfam annotation: Pfam_ID=Peptidase_M13_N; Match level="Score=74.6, E -value=2.7e-19, Copies=1"; Pfam description=Peptidase family M13
EVLNQLGGWPVLKQNWTVPSFSVEILIGLIRSYYNEGLLIEQWVGPDDKNSSVNIIQMDQSILALPSRDYYLKPSSKGDLLAYHRYMTNIAILLGANKTTAGDELQKVIEFEKQLANASLPEQDRHDTSMIYKKMSIKDLAKLVPKFNWLEYFRTIFDMNINEDEQIVAYGISYFVELGKILSTTDRRIIHNYVLWRLVMSLSTHLVDDYQKERVEFRKILQGVLSERHRWAQCVEWTNKKMGMAVGALYIRDNFDHLNKETALEMIHTIKEAFNELLPENHWMG

SEQ ID NO: 30632 - protein, 76 aa, Diabrotica virgifera
  misc_feature: Coding regions on vcDNA: vcDNA=SeqID_10329; Strand=-; Position=221-451
  misc_feature (7)..(15): Xaa can be any naturally occurring amino acid
CSSPSSXXXXXXXXXLVSSSCGSGALCGGLTKGGTSVDHRGYSPGAWFRRISMVFRIWSRAGTVEWSIHSRLWSSW

SEQ ID NO: 30633 - protein, 23 aa, Diabrotica virgifera
  misc_feature: Coding regions on vcDNA: vcDNA=SeqID_10330; Strand=-; Position=0-68
  misc_feature (18)..(18): Xaa can be any naturally occurring amino acid
MVESGGRTAETLSCDHFXTGGSR

SEQ ID NO: 30634 - protein, 205 aa, Diabrotica virgifera
  misc_feature: Coding regions on vcDNA: vcDNA=SeqID_10331; Strand=+; Position=5-619
  misc_feature (2)..(175): Xaa can be any naturally occurring amino acid
  misc_feature (179)..(189): Xaa can be any naturally occurring amino acid
VXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSFSXXXXXXXXXXXAGGISINYELFLHNYI

SEQ ID NO: 30635 - protein, 66 aa, Diabrotica virgifera
  misc_feature: Coding regions on vcDNA: vcDNA=SeqID_10332; Strand=-; Position=128-328
  misc_feature (6)..(6): Xaa can be any naturally occurring amino acid
  misc_feature (10)..(19): Xaa can be any naturally occurring amino acid
  misc_feature (26)..(26): Xaa can be any naturally occurring amino acid
  misc_feature (32)..(33): Xaa can be any naturally occurring amino acid
  misc_feature (43)..(44): Xaa can be any naturally occurring amino acid
  misc_feature (46)..(48): Xaa can be any naturally occurring amino acid
  misc_feature (50)..(51): Xaa can be any naturally occurring amino acid
  misc_feature (57)..(57): Xaa can be any naturally occurring amino acid
ILLSSXNLHXXXXXXXXXXLSNISHXHNYLPXXLPYYKINIFXXHXXXIXXSLNHFXILQLYLLLN

SEQ ID NO: 30636 - protein, 74 aa, Diabrotica virgifera
  misc_feature: Coding regions on vcDNA: vcDNA=SeqID_10333; Strand=-; Position=38-262
  misc_feature (31)..(35): Xaa can be any naturally occurring amino acid
TGTISKSFRFHFVKIYDSTLKNFIVQFFFKXXXXXGAKTVMRTKPTTNTTSITMYIPNMHFLAVENLASRFLSL

SEQ ID NO: 30637 - protein, 221 aa, Diabrotica virgifera
  misc_feature: Coding regions on vcDNA: vcDNA=SeqID_10334; Strand=-; Position=2-664
  misc_feature (11)..(17): Xaa can be any naturally occurring amino acid
  misc_feature (26)..(33): Xaa can be any naturally occurring amino acid
  misc_feature (49)..(146): Xaa can be any naturally occurring amino acid
  misc_feature (148)..(173): Xaa can be any naturally occurring amino acid
  misc_feature (175)..(208): Xaa can be any naturally occurring amino acid
  misc_feature (211)..(220): Xaa can be any naturally occurring amino acid
HGHNTATIQTXXXXXXXLYVIQKVMXXXXXXXXRLRIPLINLYISTKYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQXXXXXXXXXXXXXXXXXXXXXXXXXXKXXXXXXXXXXXXXXXXXXXXXXXXXXXXXXXXXXLIXXXXXXXXXXY

SEQ ID NO: 30638 - protein, 209 aa, Diabrotica virgifera
  misc_feature: Coding regions on vcDNA: vcDNA=SeqID_10335; Strand=-; Position=1-627
  misc_feature (1)..(207): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHF

SEQ ID NO: 30639 - protein, 116 aa, Diabrotica virgifera
  misc_feature: Coding regions on vcDNA: vcDNA=SeqID_10336; Strand=-; Position=41-391
  misc_feature (62)..(81): Xaa can be any naturally occurring amino acid
  misc_feature (83)..(108): Xaa can be any naturally occurring amino acid
HNSLISLVLMKYLFSLRSEFLVRSLLSINLFRLFYINVSLCSTSSLYFVWFAFKIFISYTQXXXXXXXXXXXXXXXXXXXXNXXXXXXXXXXXXXXXXXXXXXXXXXXHFDCLEMK

SEQ ID NO: 30640 - protein, 57 aa, Diabrotica virgifera
  misc_feature: Coding regions on vcDNA: vcDNA=SeqID_10337; Strand=+; Position=248-421
  misc_feature (5)..(11): Xaa can be any naturally occurring amino acid
KLYCXXXXXXXTLLYYSCTVMSALITCKIPQKIEIILGCEMKGGESGIGGKFNDKNL

SEQ ID NO: 30641 - protein, 89 aa, Diabrotica virgifera
  misc_feature: Coding regions on vcDNA: vcDNA=SeqID_10338; Strand=+; Position=4-273
SPQTSKHIMTVPAKEANGTDVENAAQQKEQEVQKEKELLKAMRKSKRKFPGFRKNLYDYFQEFTGITVIHAFNYMEELERNSYERIGRA

SEQ ID NO: 30642 - protein, 241 aa, Diabrotica virgifera
  misc_feature: Coding regions on vcDNA: vcDNA=SeqID_10339; Strand=+; Position=87-812
  misc_feature: Homolog annotation: Hit_ID=EAL27922.1; Match level="QueryCoverage =92%, HitCoverage=76%, E-value=1e-67, Identity=59%"; Hit description =GA18836-PA [Drosophila pseudoobscura]
  misc_feature: Gene Ontology Annotation: Molecular function=DNA-directed RNA polymerase III activity; Cellular component=DNA-directed RNA polymerase III complex; Biological process=transcription
  misc_feature: Pfam annotation: Pfam_ID=RNA_pol_Rpc34; Match level="Score=240.3, E -value=3.6e-69, Copies=1"; Pfam description=RNA polymerase Rpc34 subunit
  misc_feature (51)..(60): Xaa can be any naturally occurring amino acid
MSTQSSQNGNVSESTEAENRLIELAKSNSEGISNDDITKHMPDVPLTEITXXXXXXXXXXTFDLFKTKDNLLYKYKDPSKKTNIKGADSEEKVVYKIIEEAGNKGIWIRDIRFSSNLNMTQLNKVLKSLETKKLIKAVKSVSASKKKVYMLYDLEPDRSVTGGAWYQDQDFESEFVDVLSQQCHRFLVEKWEEANKKAGGPLLVRNRSYATASDVHKFISELGISKVSLSVDDIESIFVYS

SEQ ID NO: 30643 - protein, 315 aa, Diabrotica virgifera
  misc_feature: Coding regions on vcDNA: vcDNA=SeqID_10340; Strand=+; Position=1-948
  misc_feature (1)..(286): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRIITLGITAVFFIGRVQIDNKDVRPRWLD

SEQ ID NO: 30644 - protein, 122 aa, Diabrotica virgifera
  misc_feature: Coding regions on vcDNA: vcDNA=SeqID_10341; Strand=+; Position=36-406
  misc_feature: Homolog annotation: Hit_ID=DAA01983.1; Match level="QueryCoverage =100%, HitCoverage=30%, E-value=3e-26, Identity=50%"; Hit description= TPA: troponin T isoform 2 [Drosophila pseudoobscura]
  misc_feature (43)..(43): Xaa can be any naturally occurring amino acid
  misc_feature (57)..(57): Xaa can be any naturally occurring amino acid
  misc_feature (77)..(77): Xaa can be any naturally occurring amino acid
MTDNEEVYSEKKEEEEDFDTTTTTTSNAEEGAGELEFLKRQDXKRSDLDEQIHEYIXEWSKQRDKDEEDLKKLVERXANSKITRADEERNMAERNIAAEKRRVHVIVMKTEEDIEEMKHRLD

SEQ ID NO: 30645 - protein, 96 aa, Diabrotica virgifera
  misc_feature: Coding regions on vcDNA: vcDNA=SeqID_10342; Strand=+; Position=553-843
IQRKGSDTHGLRPEIKLHLFKIIPYFFECLFFQLHEERTTKLDTNITYLIFPLRKCGILFYETNSISSKTCDDLRVAEAVIISCRSFISTCVPMAN

SEQ ID NO: 30646 - protein, 22 aa, Diabrotica virgifera
  misc_feature: Coding regions on vcDNA: vcDNA=SeqID_10343; Strand=-; Position=1-66
  misc_feature (4)..(22): Xaa can be any naturally occurring amino acid
SKKXXXXXXXXXXXXXXXXXXX

SEQ ID NO: 30647 - protein, 25 aa, Diabrotica virgifera
  misc_feature: Coding regions on vcDNA: vcDNA=SeqID_10344; Strand=-; Position=0-74
  misc_feature (1)..(21): Xaa can be any naturally occurring amino acid
XXXXXXXXXXXXXXXXXXXXXFFIT

SEQ ID NO: 30648 - protein, 27 aa, Diabrotica virgifera
  misc_feature: Coding regions on vcDNA: vcDNA=SeqID_10345; Strand=-; Position=0-80
  misc_feature (5)..(26): Xaa can be any naturally occurring amino acid
KKLGXXXXXXXXXXXXXXXXXXXXXXT

SEQ ID NO: 30649 - protein, 228 aa, Diabrotica virgifera
  misc_feature: Coding regions on vcDNA: vcDNA=SeqID_10346; Strand=+; Position=1-687
  misc_feature: Homolog annotation: Hit_ID=Q9Y4A0; Match level="QueryCoverage=89%, HitCoverage=45%, E-value=3e-16, Identity=25%"; Hit description=Jerky protein homolog like (HHMJG) pir||JC5594 jerky gene protein homolog - human gb|AAB65833.1|
  misc_feature: Gene Ontology Annotation: Cellular component=nucleus; Biological process=central nervous system development
  misc_feature (5)..(10): Xaa can be any naturally occurring amino acid
FVVMXXXXXXNVTALLQPMDQGIIVKCKKLYRKQVLQRLLIAERDEDSVITFSKQLNLKDCCHMLADSWDSLTNENLKNGCNKLWKIQDDKQIESVQDENMTHISAICQNIPGFEECDEQDVNEWLEFDHNLQGHQIYEDDEIVDIVSNMVDDNAEDSSDDDHDNDDPKPSHSDAFNSLETAMKWFENQPESNSAQLLVLKRIRDLAAKKRAATVVQKKISDYIHVTN

SEQ ID NO: 30650 - protein, 120 aa, Diabrotica virgifera
  misc_feature: Coding regions on vcDNA: vcDNA=SeqID_10347; Strand=-; Position=1-360
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(120): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXX

SEQ ID NO: 30651 - protein, 146 aa, Diabrotica virgifera
  misc_feature: Coding regions on vcDNA: vcDNA=SeqID_10348; Strand=+; Position=101-541
  misc_feature: Homolog annotation: Hit_ID=XP_310264.1; Match level="QueryCoverage =68%, HitCoverage=31%, E-value=2e-10, Identity=35%"; Hit description =ENSANGP00000015944 [Anopheles gambiae]
IADDVIAEKRTTQGNINLIKRWLFAADEKYVPSKLSDEFIVLFLLSCNNDIDVTKKTITAYYKLRKDAPELFDDRTSEREDIQKALNTLRMVSIPNRTDENYQVVYLSLKDTDSSNFELNPDMKASLMLIYIEHHNIPPYGIMLLL

SEQ ID NO: 30652 - protein, 254 aa, Diabrotica virgifera
  misc_feature: Coding regions on vcDNA: vcDNA=SeqID_10349; Strand=+; Position=1-762
  misc_feature (1)..(15): Xaa can be any naturally occurring amino acid
  misc_feature (18)..(55): Xaa can be any naturally occurring amino acid
  misc_feature (58)..(242): Xaa can be any naturally occurring amino acid
  misc_feature (246)..(253): Xaa can be any naturally occurring amino acid
XXXXXXXXXXXXXXXYLXXXXXXXXXXXXXXXXXXXXXXXXXXXXXXXXXXXXXXEIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVKSXXXXXXXXT

SEQ ID NO: 30653 - protein, 83 aa, Diabrotica virgifera
  misc_feature: Coding regions on vcDNA: vcDNA=SeqID_10350; Strand=-; Position=75-326
HKIFLHLDSDPESILIMDCRIGPLVERVGRHLGRIVYHHLLELGVQLFKKTQTRNYSPPLLLSISRGVARDASSFFILFSKHL

SEQ ID NO: 30654 - protein, 158 aa, Diabrotica virgifera
  misc_feature: Coding regions on vcDNA: vcDNA=SeqID_10351; Strand=-; Position=1-475
  misc_feature: Homolog annotation: Hit_ID=AAN87272.1; Match level="QueryCoverage =88%, HitCoverage=16%, E-value=2e-23, Identity=39%"; Hit description =ORF1 [Drosophila melanogaster]
  misc_feature (87)..(87): Xaa can be any naturally occurring amino acid
ETHIIIFYHRNVDTAVTNLQTALEEIEEWSIKWKIAINSDKTQAVLYKKGRQQPEEQLTVQNRPIEWKNEAKYLGVIMDKGLTFQKXHVEATVRKANIAKATLRGLTGRKSKLRLKTRLRLINSIILPVLTYASLAWGHVSNTHKKKIQAAHNNSLRE

SEQ ID NO: 30655 - protein, 70 aa, Diabrotica virgifera
  misc_feature: Coding regions on vcDNA: vcDNA=SeqID_10352; Strand=-; Position=9-221
LRMLLNSAYKCVKKQVVEDSPTFCSTYLSGVVLYDCFNHFASQKSTSTDTSSHIKSHVSNLNRGIELAPL

SEQ ID NO: 30656 - protein, 97 aa, Diabrotica virgifera
  misc_feature: Coding regions on vcDNA: vcDNA=SeqID_10353; Strand=-; Position=42-335
EHFTYELSKIEPSFQPRLRFLPQRLHHSLPFIKTRSKSIVKRSWGREFLSSYIQFCLEYTSIISNFSIDFCKEAIILMRLSTLSNNELSSRRQAELS

SEQ ID NO: 30657 - protein, 25 aa, Diabrotica virgifera
  misc_feature: Coding regions on vcDNA: vcDNA=SeqID_10354; Strand=+; Position=1-75
SSIIISYLLEAGKKGWMIKKNWNLF

SEQ ID NO: 30658 - protein, 68 aa, Diabrotica virgifera
  misc_feature: Coding regions on vcDNA: vcDNA=SeqID_10355; Strand=+; Position=154-360
MIVLMFNMRLFKWIHFHIANFGGYFYLITTHGESAGRASFHVLLVAPLTIGLLQKVIMQSECAFHPLC

SEQ ID NO: 30659 - protein, 241 aa, Diabrotica virgifera
  misc_feature: Coding regions on vcDNA: vcDNA=SeqID_10356; Strand=+; Position=24-749
  misc_feature: Homolog annotation: Hit_ID=AAM88288.1; Match level="QueryCoverage =86%, HitCoverage=72%, E-value=1e-29, Identity=36%"; Hit description =cuticle protein 36 [Manduca sexta]
  misc_feature: Pfam annotation: Pfam_ID=Chitin_bind_4; Match level="Score=84.4, E -value=3e-22, Copies=1"; Pfam description=Insect cuticle protein
MRQFVVLFAIIGLSYCGRLENTYLPPNQGGGYDSAAHARFNKISTHRANSFSSQNSFQQPSFNNKYSAPAPSGPAGPINKEANDVPILRLDNNNDGETYNYALETGNGISMQEQGDASHDGTNAQGGFSYTAPDGQQISIQYVAGESGFVPQGAHIPTAPPVPEDIQKALEQNLADEARGIVDDGQYREEGESGQYNQAAYGGHGGRNEQDTGASKNNFNFQPDKNQYIPPSHNGKQGYHY

SEQ ID NO: 30660 - protein, 35 aa, Diabrotica virgifera
  misc_feature: Coding regions on vcDNA: vcDNA=SeqID_10357; Strand=-; Position=0-104
RSSTSWMFDDYFIAQPKITIRPGAWGAPRKPRRCT

SEQ ID NO: 30661 - protein, 66 aa, Diabrotica virgifera; identical to SEQ ID NO: 26808
  misc_feature: Coding regions on vcDNA: vcDNA=SeqID_10358; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 30662 - protein, 68 aa, Diabrotica virgifera
  misc_feature: Coding regions on vcDNA: vcDNA=SeqID_10359; Strand=+; Position=211-418
  misc_feature: Homolog annotation: Hit_ID=AAA51586.1; Match level="QueryCoverage =97%, HitCoverage=20%, E-value=1e-15, Identity=57%"; Hit description =actin prepeptide
  misc_feature: Gene Ontology Annotation: Molecular function=structural constituent of cytoskeleton; Cellular component=cytoskeleton; Biological process= actin cytoskeleton organization and biogenesis
  misc_feature (17)..(17): Xaa can be any naturally occurring amino acid
  misc_feature (36)..(36): Xaa can be any naturally occurring amino acid
AKQDSYAGHRAQIEKGXLLVMKPLEHGIDTNCKDMXSRWLHSFYHEMREAPEEHPVLLTENPIKHKAI

SEQ ID NO: 30663 - protein, 224 aa, Diabrotica virgifera
  misc_feature: Coding regions on vcDNA: vcDNA=SeqID_10360; Strand=+; Position=234-905
  misc_feature: Homolog annotation: Hit_ID=XP_314017.1; Match level="QueryCoverage =99%, HitCoverage=40%, E-value=1e-110, Identity=89%"; Hit description= ENSANGP00000009989 [Anopheles gambiae]
  misc_feature: Gene Ontology Annotation: Cellular component=extracellular space; Biological process=morphogenesis
  misc_feature: Pfam annotation: Pfam_ID=ATP-synt_ab; Match level="Score=150.4, E -value=4e-42, Copies=1"; Pfam description=ATP synthase alpha/beta family, nucleo
  misc_feature (111)..(117): Xaa can be any naturally occurring amino acid
AGDIVKRTGAIVDVPVGDQILGRVVDALGNPIDGKGPLNTKQRFRVGIKAPGIIPRISVREPMQSGIKAVDSLVPIGRGQRELIIGDRQTGKTALAIDTIINQKRFNDAEXXXXXXXCIHFAIGQKRSTVAQILKRLTDTGAINYTIIVSATASDAAPLQYLAPYSGCAMGEFFRDNGKHALIIYDDLSKQAVAYRQMSLLLRRPPGREAYPGDVFYFHSRLLE

SEQ ID NO: 30664 - protein, 308 aa, Diabrotica virgifera
  misc_feature: Coding regions on vcDNA: vcDNA=SeqID_10361; Strand=+; Position=50-975
  misc_feature: Homolog annotation: Hit_ID=NP_572639.2; Match level="QueryCoverage =93%, HitCoverage=62%, E-value=3e-90, Identity=57%"; Hit description =CG1628-PB [Drosophila melanogaster] gb|AAF46607.2| CG1628-PB [Drosophila melanogaster]
  misc_feature: Gene Ontology Annotation: Molecular function=binding; Cellular component=mitochondrial inner membrane; Biological process=transport
  misc_feature: Pfam annotation: Pfam_ID=Mito_carr; Match level="Score=277.6, E-value= 2.1e-80, Copies=3"; Pfam description=Mitochondrial carrier protein
  misc_feature (150)..(150): Xaa can be any naturally occurring amino acid
  misc_feature (255)..(255): Xaa can be any naturally occurring amino acid
KLVGKQHVKDGIIDFTGGSLGGVALVYVGQPLDTVKVKMQTFPTLYKNMFNCFATTLKTDGVRRGLYAGTVPALATNVAENAVLFFAYGFCQKFMQHITGAQSIDELSTVTNATAGFLAAFFSSVAICPTELVKCRLQAMHEVNNSRLNXGKAVKSVGPLQLTAEVIRTEGVKGMFRGLVPTIVREMPGYFFFFGAYEGTRELLRKPDQKKEDIGLVKTMIAGGMGGGIFWTALFPADVAKSRIQVNNLKRNMMXVIFKIARHEGIGALYNGLLPTVIRAVPATAVMVLTIEYSKKWMHHISRDYRSF

SEQ ID NO: 30665 - protein, 247 aa, Diabrotica virgifera
  misc_feature: Coding regions on vcDNA: vcDNA=SeqID_10362; Strand=-; Position=0-740
  misc_feature (2)..(10): Xaa can be any naturally occurring amino acid
  misc_feature (14)..(23): Xaa can be any naturally occurring amino acid
  misc_feature (27)..(42): Xaa can be any naturally occurring amino acid
  misc_feature (44)..(51): Xaa can be any naturally occurring amino acid
  misc_feature (53)..(70): Xaa can be any naturally occurring amino acid
  misc_feature (73)..(96): Xaa can be any naturally occurring amino acid
  misc_feature (99)..(106): Xaa can be any naturally occurring amino acid
  misc_feature (115)..(129): Xaa can be any naturally occurring amino acid
  misc_feature (131)..(151): Xaa can be any naturally occurring amino acid
  misc_feature (159)..(179): Xaa can be any naturally occurring amino acid
  misc_feature (184)..(190): Xaa can be any naturally occurring amino acid
  misc_feature (203)..(217): Xaa can be any naturally occurring amino acid
  misc_feature (222)..(246): Xaa can be any naturally occurring amino acid
GXXXXXXXXXEERXXXXXXXXXXTHRXXXXXXXXXXXXXXXXRXXXXXXXXSXXXXXXXXXXXXXXXXXXDGXXXXXXXXXXXXXXXXXXXXXXXXRGXXXXXXXXGGGGGNSAXXXXXXXXXXXXXXXKXXXXXXXXXXXXXXXXXXXXXAPPLKWWXXXXXXXXXXXXXXXXXXXXXKGPFXXXXXXXWPPPPPPHQQQKXXXXXXXXXXXXXXXESTHXXXXXXXXXXXXXXXXXXXXXXXXXA

SEQ ID NO: 30666 - protein, 28 aa, Diabrotica virgifera
  misc_feature: Coding regions on vcDNA: vcDNA=SeqID_10363; Strand=-; Position=0-83
  misc_feature (4)..(13): Xaa can be any naturally occurring amino acid
  misc_feature (15)..(27): Xaa can be any naturally occurring amino acid
LMWXXXXXXXXXXFXXXXXXXXXXXXXS

SEQ ID NO: 30667 - protein, 17 aa, Diabrotica virgifera
  misc_feature: Coding regions on vcDNA: vcDNA=SeqID_10364; Strand=-; Position=1-51
  misc_feature (3)..(17): Xaa can be any naturally occurring amino acid
EVXXXXXXXXXXXXXXX

SEQ ID NO: 30668 - protein, 65 aa, Diabrotica virgifera
  misc_feature: Coding regions on vcDNA: vcDNA=SeqID_10365; Strand=-; Position=3-197
  misc_feature (2)..(12): Xaa can be any naturally occurring amino acid
  misc_feature (20)..(20): Xaa can be any naturally occurring amino acid
  misc_feature (28)..(28): Xaa can be any naturally occurring amino acid
  misc_feature (32)..(45): Xaa can be any naturally occurring amino acid
  misc_feature (52)..(64): Xaa can be any naturally occurring amino acid
FXXXXXXXXXXXNQPGSHRXKLRSCKIXKVEXXXXXXXXXXXXXXSNIEVAXXXXXXXXXXXXXC

SEQ ID NO: 30669 - protein, 120 aa, Diabrotica virgifera
  misc_feature: Coding regions on vcDNA: vcDNA=SeqID_10366; Strand=+; Position=160-519
IPRRGALIPFPPLSRKISYCFESASYTSDLHMRNGSYPCSELRLHQSSKFYGSTKNMKLRADDMTTFICIRYVSLIVIYMRQHSRVSIIQSNFIWAAYAKDGDGSAPFVRMNVPPVPTSS

SEQ ID NO: 30670 - protein, 78 aa, Diabrotica virgifera
  misc_feature: Coding regions on vcDNA: vcDNA=SeqID_10367; Strand=-; Position=1-234
  misc_feature (15)..(21): Xaa can be any naturally occurring amino acid
  misc_feature (68)..(77): Xaa can be any naturally occurring amino acid
PLAPPPRVLNPQDSXXXXXXXWNQTIKKLTFFPPNIKPLIPPLGRSPIFYYGFGTPPIKNYRCYSLKXXXXXXXXXXG

SEQ ID NO: 30671 - protein, 66 aa, Diabrotica virgifera; identical to SEQ ID NO: 26808
  misc_feature: Coding regions on vcDNA: vcDNA=SeqID_10368; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 30672 - protein, 266 aa, Diabrotica virgifera
  misc_feature: Coding regions on vcDNA: vcDNA=SeqID_10369; Strand=+; Position=72-870
  misc_feature: Homolog annotation: Hit_ID=A45321; Match level="QueryCoverage=98%, HitCoverage=34%, E-value=2e-57, Identity=39%"; Hit description =protein-glutamine gamma-glutamyltransferase (EC 2.3.2.13) - horseshoe crab
  misc_feature: Gene Ontology Annotation: Molecular function=protein-glutamine gamma -glutamyltransferase activity; Cellular component=cellular_component unknown; Biological process=protein amino acid polyamination
  misc_feature: Pfam annotation: Pfam_ID=Transglut_N; Match level="Score=59.8, E -value=7.9e-15, Copies=1"; Pfam description=Transglutaminase family
  misc_feature (162)..(169): Xaa can be any naturally occurring amino acid
  misc_feature (237)..(237): Xaa can be any naturally occurring amino acid
MEPATVTGVDFFHKENAHNHHTCEYELVNAEAPTPVLRRGAVFQLGINLNRTFDPEHDVIRISFGFGEKPTVILGTRAVRPLNPKLNHFPKDPHVWGVMLKENKGSSVIVNVRIPPQVQVGIWNCNIISTIAGQKGVRKDYKFEDDIYIIFNPWCPEDGVFXXXXXXXXEYVLNDCGKIWCGTFKKPTGKHWIFGQFDEISLPAAIFLLEKSALVTAQRGNPIMVSRAISAIVNAVXDGGLLEGRWDGDYSDGTSPFAWTGSTGIL

SEQ ID NO: 30673 - protein, 119 aa, Diabrotica virgifera
  misc_feature: Coding regions on vcDNA: vcDNA=SeqID_10370; Strand=-; Position=207-566
  misc_feature (85)..(95): Xaa can be any naturally occurring amino acid
YRARREWRINFSLISRYLYVLCRDLGKYGDHLSTSAIDARVEKSLIIARAMQSETKILAGVVEKYILSSMKTIICITGILPFNSXXXXXXXXXXXMWNSFFLQCCCEYSLLHIRQGYNG

SEQ ID NO: 30674 - protein, 119 aa, Diabrotica virgifera
  misc_feature: Coding regions on vcDNA: vcDNA=SeqID_10371; Strand=+; Position=558-917
  misc_feature (7)..(16): Xaa can be any naturally occurring amino acid
  misc_feature (19)..(39): Xaa can be any naturally occurring amino acid
  misc_feature (57)..(66): Xaa can be any naturally occurring amino acid
  misc_feature (70)..(89): Xaa can be any naturally occurring amino acid
  misc_feature (95)..(102): Xaa can be any naturally occurring amino acid
  misc_feature (106)..(113): Xaa can be any naturally occurring amino acid
HNGYLAXXXXXXXXXXPPXXXXXXXXXXXXXXXXXXXXXLIHLNVRVILSGLREHKXXXXXXXXXXTGPXXXXXXXXXXXXXXXXXXXXKPSNFXXXXXXXXVKMXXXXXXXXFFTIKN

SEQ ID NO: 30675 - protein, 67 aa, Diabrotica virgifera
  misc_feature: Coding regions on vcDNA: vcDNA=SeqID_10372; Strand=+; Position=125-328
  misc_feature: Homolog annotation: Hit_ID=XP_393604.1; Match level="QueryCoverage =83%, HitCoverage=10%, E-value=2e-09, Identity=46%"; Hit description =similar to CG5034-PA [Apis mellifera]
  misc_feature: Pfam annotation: Pfam_ID=zf-AD; Match level="Score=22.9, E-value =0.00028, Copies=1"; Pfam description=Zinc-finger associated domain (zf-AD)
MESWRSYATICRLCLQKDGFMLGIFNHIQGKDRSIYKKIIDCTALQISSGDGLPNVICHRCLYKIQF

SEQ ID NO: 30676 - protein, 244 aa, Diabrotica virgifera
  misc_feature: Coding regions on vcDNA: vcDNA=SeqID_10373; Strand=-; Position=1-732
  misc_feature (2)..(227): Xaa can be any naturally occurring amino acid
  misc_feature (230)..(244): Xaa can be any naturally occurring amino acid
LXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 30677 - protein, 290 aa, Diabrotica virgifera
  misc_feature: Coding regions on vcDNA: vcDNA=SeqID_10374; Strand=+; Position=32-901
  misc_feature: Homolog annotation: Hit_ID=XP_310203.1; Match level="QueryCoverage =91%, HitCoverage=66%, E-value=9e-58, Identity=40%"; Hit description =ENSANGP00000011059 [Anopheles gambiae]
  misc_feature: Gene Ontology Annotation: Molecular function=acetylcholine receptor activity; Cellular component=nicotinic acetylcholine-gated receptor -channel complex; Biological process=synaptic transmission
  misc_feature: Pfam annotation: Pfam_ID=Neur_chan_LBD; Match level="Score=171.7, E -value=1.5e-48, Copies=1"; Pfam description=Neurotransmitter-gated ion-channel lig
  misc_feature (274)..(274): Xaa can be any naturally occurring amino acid
  misc_feature (279)..(279): Xaa can be any naturally occurring amino acid
MIRVLIILSICTVVYGLSSEIGTLSCDKLRHDLLLNYDKFSRPSHHSNTTKLRFGISITHVELQEFKSTLTVHGMLKMVWNDDKLKWNASNYGNLSVLRLAEHEFWQPDIYLYNSALSASVNQYGNTHSLVYPNGEVLWVPPVQLNALCQLHLKYWPFDTQECYLMFGSWTHHGEQIDIQNYNGKDNNSVIVELMRILDTDIEWKIVEAIQYVDKKEYECCPDEVYPYVSVKLTISRVSDAYKIILVAPILLVILLTLWSFWLPPQASEKVILXGCTAXIVSLFLLYFTQ

SEQ ID NO: 30678 - protein, 57 aa, Diabrotica virgifera
  misc_feature: Coding regions on vcDNA: vcDNA=SeqID_10375; Strand=-; Position=614-787
  misc_feature: Homolog annotation: Hit_ID=AAC46945.1; Match level="QueryCoverage =70%, HitCoverage=11%, E-value=1e-09, Identity=70%"; Hit description =mariner transposase pir||S35520 transposase - lacewing
HKSVMTMANTHELGFELLSHPAYSPDLTPSDYHVFPNLKRYRNLFLKIFFIKLMKLC

SEQ ID NO: 30679 - protein, 280 aa, Diabrotica virgifera
  misc_feature: Coding regions on vcDNA: vcDNA=SeqID_10376; Strand=+; Position=23-865
  misc_feature: Homolog annotation: Hit_ID=CAG09306.1; Match level="QueryCoverage =75%, HitCoverage=33%, E-value=6e-43, Identity=40%"; Hit description =unnamed protein product [Tetraodon nigroviridis]
  misc_feature: Gene Ontology Annotation: Molecular function=molecular_function unknown; Cellular component=cellular_component unknown; Biological process=cell organization and biogenesis
YATAQKSNQVISLYKCLMLDRKEEISESVILNRLKNCVTNQHWTILMLGGGHFAGAVFKGNEPILHKTFHCYTVRAGQGGSQGARDNKSGGSQPKSAGASLRRYNETALVQHVKSIVETWKTEIENSSLIMYRAAGPYNRGVLFGGSTPLLDRTNPKLRTIPFSTRRATFTELKRVHQLLTTVNVYDSLETATKNFSKQVAPDVDAKRNKVRTSCINRAKSRETVERPLPTEHLSSDSESETDQIYLSTNDQEISFEDSLTPEQEKSLQRRKTEKSKSKK

SEQ ID NO: 30680 - protein, 189 aa, Diabrotica virgifera
  misc_feature: Coding regions on vcDNA: vcDNA=SeqID_10377; Strand=-; Position=1-567
  misc_feature (1)..(189): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30681 - protein, 58 aa, Diabrotica virgifera
  misc_feature: Coding regions on vcDNA: vcDNA=SeqID_10378; Strand=-; Position=99-275
SCISFCLTVFNSTSIKSTIIPLSYGYNKWYTPYTLPHLYSPHNSCSYNIGFCITIQSI

SEQ ID NO: 30682 - protein, 80 aa, Diabrotica virgifera
  misc_feature: Coding regions on vcDNA: vcDNA=SeqID_10379; Strand=-; Position=325-567
TKGHHRTISKPHSTTLLVRHGKIRLSNTANHLRKSPVLTTAKGACEYDQKILSPGHKKSLRTGISSAETECRGYIVKPIN

SEQ ID NO: 30683 - protein, 96 aa, Diabrotica virgifera
  misc_feature: Coding regions on vcDNA: vcDNA=SeqID_10380; Strand=-; Position=185-475
  misc_feature (55)..(68): Xaa can be any naturally occurring amino acid
SPTSTSFISFYIITNYVFCLFRYFASYSRTHHCIQKFLKFLNKLKMNNHFQLIFXXXXXXXXXXXXXXVCIKDIPGRCLLPKAYILIRRFEGIYTC

SEQ ID NO: 30684 - protein, 28 aa, Diabrotica virgifera
  misc_feature: Coding regions on vcDNA: vcDNA=SeqID_10381; Strand=-; Position=1-84
  misc_feature (1)..(26): Xaa can be any naturally occurring amino acid
XXXXXXXXXXXXXXXXXXXXXXXXXXIN

SEQ ID NO: 30685 - protein, 108 aa, Diabrotica virgifera
  misc_feature: Coding regions on vcDNA: vcDNA=SeqID_10382; Strand=+; Position=236-562
  misc_feature (15)..(21): Xaa can be any naturally occurring amino acid
  misc_feature (24)..(57): Xaa can be any naturally occurring amino acid
  misc_feature (65)..(82): Xaa can be any naturally occurring amino acid
  misc_feature (86)..(100): Xaa can be any naturally occurring amino acid
DVLLFIFQYILFIKXXXXXXXQHXXXXXXXXXXXXXXXXXXXXXXXXXXXXXXXXXXKIINFHMXXXXXXXXXXXXXXXXXXSLLXXXXXXXXXXXXXXXSIRILYIY

SEQ ID NO: 30686 - protein, 83 aa, Diabrotica virgifera
  misc_feature: Coding regions on vcDNA: vcDNA=SeqID_10383; Strand=+; Position=128-379
  misc_feature (1)..(7): Xaa can be any naturally occurring amino acid
  misc_feature (24)..(32): Xaa can be any naturally occurring amino acid
XXXXXXXVAKIKFSNFFRPYWIRXXXXXXXXXRFVISDLNLPNFTKKFSFLIHIFNFFPPCWIRHFVFQKNNAIFVISDAKNP

SEQ ID NO: 30687 - protein, 202 aa, Diabrotica virgifera
  misc_feature: Coding regions on vcDNA: vcDNA=SeqID_10384; Strand=-; Position=2-606
  misc_feature: Homolog annotation: Hit_ID=AAC46945.1; Match level="QueryCoverage =59%, HitCoverage=34%, E-value=2e-19, Identity=45%"; Hit description =mariner transposase pir||S35520 transposase - lacewing
  misc_feature (104)..(104): Xaa can be any naturally occurring amino acid
  misc_feature (169)..(169): Xaa can be any naturally occurring amino acid
MWTFLICRSISLGSNHEMASIINFPYDISAVLTIKSILSKFPDIRIPDQGLKWLYFYDFSKQWIQNNFMGLSLLFDGKNTVQTEQWINKCQRDSCSSSITIKRXFAELKRGSTDNNNDGRCGGPNGAVIPEKIEKTGKNIMKYRKMRLKEIADTLQIKKESFLTIIHEXLGMRNLFSKWVSRFLTPDQKQQRIEESCTVWTC

SEQ ID NO: 30688 - protein, 103 aa, Diabrotica virgifera
  misc_feature: Coding regions on vcDNA: vcDNA=SeqID_10385; Strand=-; Position=255-566
KQTIGISILHYRTLDKAIRGRNMSDIKAITMLNSILWDQSIITRGYETIVKSITLYSCEVWSLKERTLATLRPTEIDLWRRVARRSRRENITNECIREIMGIK

SEQ ID NO: 30689 - protein, 65 aa, Diabrotica virgifera
  misc_feature: Coding regions on vcDNA: vcDNA=SeqID_10386; Strand=+; Position=580-777
  misc_feature (2)..(11): Xaa can be any naturally occurring amino acid
YXXXXXXXXXXKGHNLGKKRPHAALRPHVRHPWARLTFCDIFEKSSTFQGCLFSCGWLVVSGYLM

SEQ ID NO: 30690 - protein, 261 aa, Diabrotica virgifera
  misc_feature: Coding regions on vcDNA: vcDNA=SeqID_10387; Strand=+; Position=44-829
  misc_feature: Homolog annotation: Hit_ID=CAE71185.1; Match level="QueryCoverage =89%, HitCoverage=40%, E-value=2e-17, Identity=27%"; Hit description =Hypothetical protein CBG18042 [Caenorhabditis briggsae]
  misc_feature: Gene Ontology Annotation: Molecular function=enzyme regulator activity; Cellular component=extracellular; Biological process =biological_process unknown
  misc_feature: Pfam annotation: Pfam_ID=LRR_1; Match level="Score=38.7, E-value=1.8e- 08, Copies=5"; Pfam description=Leucine Rich Repeat
MSPGCNWMENEEEWQCNSISLQSPDPELAKLNPTEVLSLCLYKVYGNINPDLFTNLTSLKVLLLLETEFKTFKFKSNTLQSLQLIRNKFPRGSNIKNCCYKLEKLTLKNNTGISLKHEVLSSFKRLRSLDLILQKVKHINKHIFKGLTKLKKLSIVNCSTETIAEDAFRDLSHLQELYIEDNSLRHIHPKAFEPLKQLTSLSIYSNRLPPLPLTTFSEQKRLTQIGLPTNTWKSITVEDVPYMFPRLFFSYMGGWKTEEDK

SEQ ID NO: 30691 - protein, 68 aa, Diabrotica virgifera
  misc_feature: Coding regions on vcDNA: vcDNA=SeqID_10388; Strand=-; Position=263-469
KRESPWTCHVLYRTSKNYRRAVYRVINFCDKVQHICYYTIYEKTLLIKVIDTFNVHILKLVRNIQGPP

SEQ ID NO: 30692 - protein, 140 aa, Diabrotica virgifera
  misc_feature: Coding regions on vcDNA: vcDNA=SeqID_10389; Strand=-; Position=3-425
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(121): Xaa can be any naturally occurring amino acid
  misc_feature (125)..(132): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXDPIXXXXXXXXFIRPYRVL

SEQ ID NO: 30693 - protein, 19 aa, Diabrotica virgifera
  misc_feature: Coding regions on vcDNA: vcDNA=SeqID_10390; Strand=-; Position=0-56
  misc_feature (1)..(18): Xaa can be any naturally occurring amino acid
XXXXXXXXXXXXXXXXXXA

SEQ ID NO: 30694 - protein, 34 aa, Diabrotica virgifera
  misc_feature: Coding regions on vcDNA: vcDNA=SeqID_10391; Strand=-; Position=0-101
  misc_feature (3)..(27): Xaa can be any naturally occurring amino acid
PPXXXXXXXXXXXXXXXXXXXXXXXXXPIGVFLV

SEQ ID NO: 30695 - protein, 86 aa, Diabrotica virgifera
  misc_feature: Coding regions on vcDNA: vcDNA=SeqID_10392; Strand=-; Position=1-258
  misc_feature (3)..(86): Xaa can be any naturally occurring amino acid
KPXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30696 - protein, 193 aa, Diabrotica virgifera
  misc_feature: Coding regions on vcDNA: vcDNA=SeqID_10393; Strand=+; Position=92-669
  misc_feature: Homolog annotation: Hit_ID=XP_392811.1; Match level="QueryCoverage =95%, HitCoverage=51%, E-value=6e-47, Identity=59%"; Hit description =similar to ENSANGP00000023556 [Apis mellifera]
  misc_feature: Gene Ontology Annotation: Molecular function=isocitrate dehydrogenase (NAD+) activity; Cellular component=mitochondrion; Biological process= carbohydrate metabolism
  misc_feature: Pfam annotation: Pfam_ID=Iso_dh; Match level="Score=-166.0, E-value =0.0007, Copies=1"; Pfam description=Isocitrate/isopropylmalate dehydrogen
  misc_feature (82)..(82): Xaa can be any naturally occurring amino acid
  misc_feature (96)..(96): Xaa can be any naturally occurring amino acid
  misc_feature (110)..(110): Xaa can be any naturally occurring amino acid
  misc_feature (129)..(129): Xaa can be any naturally occurring amino acid
  misc_feature (152)..(152): Xaa can be any naturally occurring amino acid
  misc_feature (179)..(179): Xaa can be any naturally occurring amino acid
LSTSLALEISTCALIPVDGIGPAISSFVQTIFQPVIMPIVWYSVYVTPDNFPNEWFAIPHAAIVSFNQSKIGLKGPLMTPVXGKGHSSLNLVLMKXFILYANVLALLNYXGYKTFHHLVDVMTILENTXRVYSVIEFEIVYRVVQSIKQISXYASWRVADFAFLYATENTTKKATALHXSNIMRMFDLHILRS

SEQ ID NO: 30697 - protein, 90 aa, Diabrotica virgifera
  misc_feature: Coding regions on vcDNA: vcDNA=SeqID_10394; Strand=+; Position=114-386
  misc_feature (64)..(71): Xaa can be any naturally occurring amino acid
PFLLFSPQLLLCTYNSPVTVLVTILLRNGLTDFYEILHIYPVGLRIGFNLFFIPISCKGGCPLXXXXXXXXTKLSILILYYVSLVNTCNP

SEQ ID NO: 30698 - protein, 252 aa, Diabrotica virgifera
  misc_feature: Coding regions on vcDNA: vcDNA=SeqID_10395; Strand=+; Position=156-911
  misc_feature: Homolog annotation: Hit_ID=XP_487285.1; Match level="QueryCoverage =63%, HitCoverage=95%, E-value=1e-23, Identity=34%"; Hit description =similar to hypothetical protein FLJ14345 [Mus musculus]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=74.8, E-value =2.4e-19, Copies=5"; Pfam description=Zinc finger, C2H2 type
  misc_feature (171)..(178): Xaa can be any naturally occurring amino acid
  misc_feature (217)..(218): Xaa can be any naturally occurring amino acid
  misc_feature (226)..(226): Xaa can be any naturally occurring amino acid
MQVEIKPEVNRELITIKDEPQETPPNSCIKQESDVNMDIDATPVIKQEQNETVKSECKVETEIKSEPLDVSIKEDDSSFEDDDLNVSVDELKAISEDKDVTVIVNETTTYKCQLCDTIFIKYEEFKVHRKNHYIEKRRCHLCNKVLKSLSLLEEHVNKHMGFKPYKCDECXXXXXXXXHLSLHKRCHNKDEIFKCNQCNKHFKSSGSLRSHRLVHSXXSIDDLKCXVCGYKSQKEAEHKEHMSEHATKEELK

SEQ ID NO: 30699 - protein, 30 aa, Diabrotica virgifera
  misc_feature: Coding regions on vcDNA: vcDNA=SeqID_10396; Strand=-; Position=2-91
  misc_feature (16)..(27): Xaa can be any naturally occurring amino acid
RNLYYRLTLPIKLRCXXXXXXXXXXXXLDQ

SEQ ID NO: 30700 - protein, 246 aa, Diabrotica virgifera
  misc_feature: Coding regions on vcDNA: vcDNA=SeqID_10397; Strand=+; Position=50-787
  misc_feature: Homolog annotation: Hit_ID=XP_395773.1; Match level="QueryCoverage =45%, HitCoverage=12%, E-value=8e-19, Identity=42%"; Hit description =similar to CG1084-PA [Apis mellifera]
  misc_feature: Pfam annotation: Pfam_ID=Lectin_C; Match level="Score=-5.1, E-value =0.0015, Copies=1"; Pfam description=Lectin C-type domain
MLLYIFWCFSVIEITLAQIDPYSSNSLNENPYNPNNDNSQVYNLNNPNSNYNPGFNYPDLNQNQASNLNPGSTFNNGYNRDFNYNQNYPSSNPGYGYGRGYGYGSTDELRCPQYWIRYQNTCYKFVRSPLRAYNEARKICQTYSPDNGGSDLVSISNSDEHGFIINQLNAIDPQHRRWYIGAHQTSPNYYTNVDGTQLANMDNAIMEIDYPYGRDYLAYNFSKHHLHWGFGPVRGGEPLLFICEAK

SEQ ID NO: 30701 - protein, 49 aa, Diabrotica virgifera
  misc_feature: Coding regions on vcDNA: vcDNA=SeqID_10398; Strand=-; Position=2-148
  misc_feature (2)..(49): Xaa can be any naturally occurring amino acid
LXXXXXXXXXXXXXXXXXXXXXXXXXXXXXXXXXXXXXXXXXXXXXXXX

SEQ ID NO: 30702 - protein, 167 aa, Diabrotica virgifera
  misc_feature: Coding regions on vcDNA: vcDNA=SeqID_10399; Strand=+; Position=1-501
  misc_feature (1)..(18): Xaa can be any naturally occurring amino acid
  misc_feature (31)..(50): Xaa can be any naturally occurring amino acid
  misc_feature (52)..(82): Xaa can be any naturally occurring amino acid
  misc_feature (96)..(102): Xaa can be any naturally occurring amino acid
  misc_feature (111)..(120): Xaa can be any naturally occurring amino acid
  misc_feature (144)..(161): Xaa can be any naturally occurring amino acid
XXXXXXXXXXXXXXXXXXSSNLLKTRRPIEXXXXXXXXXXXXXXXXXXXXGXXXXXXXXXXXXXXXXXXXXXXXXXXXXXXXLRETTEIFIGKVQXXXXXXXPPGGLKVLXXXXXXXXXXVSAFLKFNRVFWLLTPGGGPRGVXXXXXXXXXXXXXXXXXXKGPPHP

SEQ ID NO: 30703 - protein, 102 aa, Diabrotica virgifera
  misc_feature: Coding regions on vcDNA: vcDNA=SeqID_10400; Strand=-; Position=2-307
PPKLFKLSHHLFLGLSILLRQFGDLSRAIRTILSSRILLMCSFHSCFCFVTHPFMSSTLHDLRMFSLLSLSNRLFPDIRRSIVISIVSRSRLVLDVSALAAL

SEQ ID NO: 30704 - protein, 76 aa, Diabrotica virgifera
  misc_feature: Coding regions on vcDNA: vcDNA=SeqID_10401; Strand=+; Position=3-230
  misc_feature (2)..(14): Xaa can be any naturally occurring amino acid
  misc_feature (22)..(22): Xaa can be any naturally occurring amino acid
  misc_feature (26)..(34): Xaa can be any naturally occurring amino acid
  misc_feature (36)..(45): Xaa can be any naturally occurring amino acid
  misc_feature (55)..(61): Xaa can be any naturally occurring amino acid
  misc_feature (65)..(73): Xaa can be any naturally occurring amino acid
TXXXXXXXXXXXXXCDLDVGLXFIIXXXXXXXXXFXXXXXXXXXXKPCEPGWFYXXXXXXXYERXXXXXXXXXIIF

SEQ ID NO: 30705 - protein, 26 aa, Diabrotica virgifera
  misc_feature: Coding regions on vcDNA: vcDNA=SeqID_10402; Strand=-; Position=0-77
  misc_feature (1)..(25): Xaa can be any naturally occurring amino acid
XXXXXXXXXXXXXXXXXXXXXXXXXP

SEQ ID NO: 30706 - protein, 56 aa, Diabrotica virgifera
  misc_feature: Coding regions on vcDNA: vcDNA=SeqID_10403; Strand=+; Position=1-168
  misc_feature (3)..(15): Xaa can be any naturally occurring amino acid
  misc_feature (19)..(51): Xaa can be any naturally occurring amino acid
YRXXXXXXXXXXXXXNLFXXXXXXXXXXXXXXXXXXXXXXXXXXXXXXXXXNPHFF

SEQ ID NO: 30707 - protein, 77 aa, Diabrotica virgifera
  misc_feature: Coding regions on vcDNA: vcDNA=SeqID_10404; Strand=+; Position=184-417
KLVNIYTIYDMYTAQIVIALKLLLVMCKAWKSNGSYLIKLRKHSKFDALLLTKTTCTVLQIFIISSQRRKICLNNYT

SEQ ID NO: 30708 - protein, 49 aa, Diabrotica virgifera
  misc_feature: Coding regions on vcDNA: vcDNA=SeqID_10405; Strand=-; Position=2-151
  misc_feature (18)..(27): Xaa can be any naturally occurring amino acid
  misc_feature (37)..(45): Xaa can be any naturally occurring amino acid
LIYILLNTNLMIQHGTEXXXXXXXXXXIISQFLISIXXXXXXXXXSNSI

SEQ ID NO: 30709 - protein, 67 aa, Diabrotica virgifera
  misc_feature: Coding regions on vcDNA: vcDNA=SeqID_10406; Strand=+; Position=37-237
RYYNASTWNSCKYKIELTDLCEPYHKNKRYESIRFLFFVIYGMQPVQEFFPCDVFVILHREKIVRPL

SEQ ID NO: 30710 - protein, 211 aa, Diabrotica virgifera
  misc_feature: Coding regions on vcDNA: vcDNA=SeqID_10407; Strand=+; Position=2-637
  misc_feature: Homolog annotation: Hit_ID=XP_318103.1; Match level="QueryCoverage =97%, HitCoverage=21%, E-value=5e-82, Identity=73%"; Hit description =ENSANGP00000017513 [Anopheles gambiae]
  misc_feature: Gene Ontology Annotation: Molecular function=translation initiation factor activity; Cellular component=eukaryotic translation initiation factor 3 complex; Biological process=regulation of translational initiation
  misc_feature: Pfam annotation: Pfam_ID=PCI; Match level="Score=127.4, E-value=3.4e -35, Copies=1"; Pfam description=PCI domain
ISKTFYQQLRSSERQSLVGPPESMREHVVAAAKAMRNGNWAACNTFIINDKMNAKVWDLFYQADQVRSMLTKLIKEESLRTYLFTYSHVYDSISMATLAEMFQLGKPVVHSIISKMIINEELMASLDDPTQTVVMHRSEPSRLQSLALQLADKINNFVDSNERILESKQGNFFLRGANQGNFRGDRQNYRGNNQNWDRQRRDRDRKEKDNY

SEQ ID NO: 30711 - protein, 84 aa, Diabrotica virgifera
  misc_feature: Coding regions on vcDNA: vcDNA=SeqID_10408; Strand=+; Position=244-498
  misc_feature (49)..(61): Xaa can be any naturally occurring amino acid
YEPYISKSSAMNLCSKIFRNVSNNPYFCRMLFEKPILEDLKSRIVMKSXXXXXXXXXXXXXKVYIMLNMIYNPYFCFFLQRSSW

SEQ ID NO: 30712 - protein, 139 aa, Diabrotica virgifera
  misc_feature: Coding regions on vcDNA: vcDNA=SeqID_10409; Strand=+; Position=2-421
  misc_feature (2)..(113): Xaa can be any naturally occurring amino acid
  misc_feature (125)..(134): Xaa can be any naturally occurring amino acid
FXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXELAMMYNIIHYXXXXXXXXXXIIIFR

SEQ ID NO: 30713 - protein, 80 aa, Diabrotica virgifera
  misc_feature: Coding regions on vcDNA: vcDNA=SeqID_10410; Strand=-; Position=98-340
  misc_feature (4)..(15): Xaa can be any naturally occurring amino acid
  misc_feature (62)..(71): Xaa can be any naturally occurring amino acid
APFXXXXXXXXXXXXNRNPHPGLPTRFKLQIQLKFLKLEQALINIAATPNYKPLIPTFEGCXXXXXXXXXXLKITLYPLR

SEQ ID NO: 30714 - protein, 58 aa, Diabrotica virgifera
  misc_feature: Coding regions on vcDNA: vcDNA=SeqID_10411; Strand=-; Position=0-173
  misc_feature (24)..(33): Xaa can be any naturally occurring amino acid
  misc_feature (35)..(56): Xaa can be any naturally occurring amino acid
SSSLVQPFIMDKLLFIILFLKISXXXXXXXXXXKXXXXXXXXXXXXXXXXXXXXXXKT

SEQ ID NO: 30715 - protein, 56 aa, Diabrotica virgifera
  misc_feature: Coding regions on vcDNA: vcDNA=SeqID_10412; Strand=+; Position=63-230
  misc_feature (26)..(35): Xaa can be any naturally occurring amino acid
KFIAPALRQSLLNRPIAQPNYQLILXXXXXXXXXXHKQKRRTRIQIAKILDYEQSI

SEQ ID NO: 30716 - protein, 47 aa, Diabrotica virgifera
  misc_feature: Coding regions on vcDNA: vcDNA=SeqID_10413; Strand=+; Position=1-141
  misc_feature (32)..(32): Xaa can be any naturally occurring amino acid
VEATHWLGREWIQALEINLHQMDTFLLRFLRXQKFSIPMAEQTLPEY

SEQ ID NO: 30717 - protein, 113 aa, Diabrotica virgifera
  misc_feature: Coding regions on vcDNA: vcDNA=SeqID_10414; Strand=+; Position=2-340
  misc_feature (3)..(3): Xaa can be any naturally occurring amino acid
  misc_feature (5)..(6): Xaa can be any naturally occurring amino acid
  misc_feature (9)..(21): Xaa can be any naturally occurring amino acid
  misc_feature (24)..(24): Xaa can be any naturally occurring amino acid
  misc_feature (34)..(34): Xaa can be any naturally occurring amino acid
  misc_feature (65)..(71): Xaa can be any naturally occurring amino acid
  misc_feature (73)..(79): Xaa can be any naturally occurring amino acid
  misc_feature (85)..(110): Xaa can be any naturally occurring amino acid
VIXKXXLTXXXXXXXXXXXXXQFXLIIRNNYLRXYSVFFFWRGQSIIRWGPPGGGLRGLKLGVAXXXXXXXGXXXXXXXGFGGLXXXXXXXXXXXXXXXXXXXXXXXXXXGGP

SEQ ID NO: 30718 - protein, 77 aa, Diabrotica virgifera
  misc_feature: Coding regions on vcDNA: vcDNA=SeqID_10415; Strand=+; Position=669-899
  misc_feature (39)..(39): Xaa can be any naturally occurring amino acid
QRLKYRWYERCMACSGKTNFFSEKFYLLLEDRERVQFVXYTVILGRIDIKLHLRCAVTETHSLNGVPLTVYSHGLCT

SEQ ID NO: 30719 - protein, 115 aa, Diabrotica virgifera
  misc_feature: Coding regions on vcDNA: vcDNA=SeqID_10416; Strand=+; Position=4-351
  misc_feature (2)..(14): Xaa can be any naturally occurring amino acid
  misc_feature (21)..(21): Xaa can be any naturally occurring amino acid
  misc_feature (26)..(33): Xaa can be any naturally occurring amino acid
  misc_feature (36)..(43): Xaa can be any naturally occurring amino acid
  misc_feature (55)..(63): Xaa can be any naturally occurring amino acid
  misc_feature (66)..(97): Xaa can be any naturally occurring amino acid
QXXXXXXXXXXXXXRPRCWIXVYNWXXXXXXXXVRXXXXXXXXFKPCEPGWFLSXXXXXXXXXRDXXXXXXXXXXXXXXXXXXXXXXXXXXXXXXXXPLGNQAYDPRGGPRLNPF

SEQ ID NO: 30720 - protein, 113 aa, Diabrotica virgifera
  misc_feature: Coding regions on vcDNA: vcDNA=SeqID_10417; Strand=-; Position=2-340
  misc_feature (10)..(89): Xaa can be any naturally occurring amino acid
  misc_feature (94)..(100): Xaa can be any naturally occurring amino acid
  misc_feature (103)..(109): Xaa can be any naturally occurring amino acid
  misc_feature (112)..(112): Xaa can be any naturally occurring amino acid
NFFLIIQKKXXXXXXXXXXXXXXXXXXXXXXXXXXXXXXXXXXXXXXXXXXXXXXXXXXXXXXXXXXXXXXXXXXXXXXXXXXXXXXXXPSHPXXXXXXXVIXXXXXXXIRXA

SEQ ID NO: 30721 - protein, 253 aa, Diabrotica virgifera
  misc_feature: Coding regions on vcDNA: vcDNA=SeqID_10418; Strand=+; Position=63-821
  misc_feature: Homolog annotation: Hit_ID=EAL25213.1; Match level="QueryCoverage =83%, HitCoverage=97%, E-value=2e-20, Identity=32%"; Hit description =GA11212-PA [Drosophila pseudoobscura]
  misc_feature: Gene Ontology Annotation: Molecular function=protein binding; Cellular component=nuclear speck; Biological process=mRNA splice site selection
  misc_feature (149)..(155): Xaa can be any naturally occurring amino acid
MGKYSSDSENERRGSKSSSKAKSRRRSSSSDSSDSKSRSSRRRSDKKSSRRSRTRSRDRSRDRYGRSRRSRSRSSSTYKSSKSRSYRSKSRDRYRDRHRRSRSRDRYRSRRSRSKSYIKEYVSKPKRRSHSSSSTSSSECVKTNVKHNXXXXXXXNTKGTVSKKEKSASPDCIVIDNEVLDEINENSFAPKQFTSKSKKVPENIVIDLKKNTITVPEIEQEEPDSIFHQTLCLSDEARMEKWVRELYSFRQKA

SEQ ID NO: 30722 - protein, 79 aa, Diabrotica virgifera
  misc_feature: Coding regions on vcDNA: vcDNA=SeqID_10419; Strand=+; Position=117-356
  misc_feature: Homolog annotation: Hit_ID=XP_307773.1; Match level="QueryCoverage =87%, HitCoverage=95%, E-value=3e-16, Identity=56%"; Hit description =ENSANGP00000012946 [Anopheles gambiae]
  misc_feature: Pfam annotation: Pfam_ID=PBD; Match level="Score=18.4, E-value =0.0026, Copies=1"; Pfam description=P21-Rho-binding domain
MAAINELRVTLFSCCIPQPPKRKHHIDRSMIGYPTNFQHTGHVGSRDVEMPGEQLIALQNQMKSKGGYETPYKEPDWCQ

SEQ ID NO: 30723 - protein, 262 aa, Diabrotica virgifera
  misc_feature: Coding regions on vcDNA: vcDNA=SeqID_10420; Strand=-; Position=2-787
  misc_feature (4)..(4): Xaa can be any naturally occurring amino acid
  misc_feature (6)..(262): Xaa can be any naturally occurring amino acid
LLIXYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30724 - protein, 31 aa, Diabrotica virgifera
  misc_feature: Coding regions on vcDNA: vcDNA=SeqID_10421; Strand=+; Position=1-93
  misc_feature (1)..(15): Xaa can be any naturally occurring amino acid
XXXXXXXXXXXXXXXVCNILFTCTTAHMFFW

SEQ ID NO: 30725 - protein, 150 aa, Diabrotica virgifera
  misc_feature: Coding regions on vcDNA: vcDNA=SeqID_10422; Strand=+; Position=16-467
  misc_feature: Homolog annotation: Hit_ID=XP_393544.1; Match level="QueryCoverage =99%, HitCoverage=98%, E-value=2e-53, Identity=65%"; Hit description =similar to putative MLC1 protein [Apis mellifera]
  misc_feature: Gene Ontology Annotation: Molecular function=muscle motor activity; Cellular component=muscle myosin; Biological process=muscle contraction
  misc_feature: Pfam annotation: Pfam_ID=efhand; Match level="Score=22.6, E-value =0.0012, Copies=2"; Pfam description=EF hand
  misc_feature (54)..(63): Xaa can be any naturally occurring amino acid
  misc_feature (134)..(134): Xaa can be any naturally occurring amino acid
MSDLSARDVERANFVFSIYDFEGNGTVDAVNLGDMLRALNLNPTLVTIEKVGGXXXXXXXXXXLDEFLPIFSQVKKDKEQGNFDDFLECLKLYDKEENGKMMAAELSHTLLSLGERLADAETEQVLADCMDKEXDDGFIPYEPFLKKLMA

SEQ ID NO: 30726 - protein, 72 aa, Diabrotica virgifera
  misc_feature: Coding regions on vcDNA: vcDNA=SeqID_10423; Strand=-; Position=14-232
  misc_feature (1)..(11): Xaa can be any naturally occurring amino acid
  misc_feature (14)..(24): Xaa can be any naturally occurring amino acid
  misc_feature (34)..(41): Xaa can be any naturally occurring amino acid
  misc_feature (43)..(51): Xaa can be any naturally occurring amino acid
  misc_feature (59)..(59): Xaa can be any naturally occurring amino acid
  misc_feature (68)..(68): Xaa can be any naturally occurring amino acid
XXXXXXXXXXXPFXXXXXXXXXXXNQPGSHRFKXXXXXXXXSXXXXXXXXXPIINLIHXRGRNLYYRXELSK

SEQ ID NO: 30727 - protein, 194 aa, Diabrotica virgifera
  misc_feature: Coding regions on vcDNA: vcDNA=SeqID_10424; Strand=+; Position=85-669
  misc_feature: Homolog annotation: Hit_ID=AAH81123.1; Match level="QueryCoverage =85%, HitCoverage=19%, E-value=3e-36, Identity=46%"; Hit description =MGC83827 protein [Xenopus laevis]
  misc_feature: Gene Ontology Annotation: Molecular function=molecular_function unknown; Cellular component=membrane; Biological process =intracellular protein transport
MTYMFEYPQYVKISNKAGLYAYSEGRLTERTRNMYFDAIPVLFIPGNAGSHKQVRSLSSVALRKWMNSRTSYHFDYFAVDLNEEYSGLYGPLLFDQLRYVNASLYRILELYADRQKPPESVVVVGHSMGGIIAMKLLSELEQPELISVLITRAAMSLDYHMNKFYEGIFDEGFQCNHCRQSRRDIRYFDASTFY

SEQ ID NO: 30728 - protein, 99 aa, Diabrotica virgifera
  misc_feature: Coding regions on vcDNA: vcDNA=SeqID_10425; Strand=+; Position=1-336
EDDTKTDETASAEDDGKDEASNEGDDEKADEKASEDEENGESEEPQAESEEEKADTDDSKEEAEAQQTQMTRLKMTVHNDESKRKQLNQMIRVRNMETR

SEQ ID NO: 30729 - protein, 74 aa, Diabrotica virgifera
  misc_feature: Coding regions on vcDNA: vcDNA=SeqID_10426; Strand=+; Position=41-262
  misc_feature (47)..(71): Xaa can be any naturally occurring amino acid
QGIFFGEGQSKIRWGPPGGVKVFNWGRGNNIYKSVGPLKFLFDSGVXXXXXXXXXXXXXXXXXXXXXXXXXRAR

SEQ ID NO: 30730 - protein, 66 aa, Diabrotica virgifera; identical to SEQ ID NO: 26808
  misc_feature: Coding regions on vcDNA: vcDNA=SeqID_10427; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 30731 - protein, 82 aa, Diabrotica virgifera
  misc_feature: Coding regions on vcDNA: vcDNA=SeqID_10428; Strand=+; Position=289-537
  misc_feature (1)..(8): Xaa can be any naturally occurring amino acid
  misc_feature (11)..(21): Xaa can be any naturally occurring amino acid
  misc_feature (53)..(61): Xaa can be any naturally occurring amino acid
XXXXXXXXHFXXXXXXXXXXXLFRHELQNQILLIFNFHIKITIKHLHITKTCXXXXXXXXXSHCVHVFHYNINSDSSHLRTR

SEQ ID NO: 30732 - protein, 160 aa, Diabrotica virgifera
  misc_feature: Coding regions on vcDNA: vcDNA=SeqID_10429; Strand=-; Position=194-676
  misc_feature: Homolog annotation: Hit_ID=CAA10770.1; Match level="QueryCoverage =80%, HitCoverage=37%, E-value=3e-18, Identity=34%"; Hit description =reverse transcriptase-like [Bos taurus]
  misc_feature (78)..(83): Xaa can be any naturally occurring amino acid
  misc_feature (131)..(141): Xaa can be any naturally occurring amino acid
MRSFFCNDTLQLQLRKRMIKCYIWSVLLYGVEAWTLKISTINRLEAFEMWLHRRILKIPWTAMLTNVAVLKRANATRXXXXXXKYRKMAYFGHVVRGDRYNILQLIMMGKIEGRRGIGRKQASWLKNIREXXXXXXXXXXXRIARDRDSFAMLIANVKGT

SEQ ID NO: 30733 - protein, 278 aa, Diabrotica virgifera
  misc_feature: Coding regions on vcDNA: vcDNA=SeqID_10430; Strand=+; Position=113-946
  misc_feature: Homolog annotation: Hit_ID=EAL23899.1; Match level="QueryCoverage =53%, HitCoverage=25%, E-value=4e-14, Identity=32%"; Hit description =fidgetin-like 1 [Homo sapiens] ref|NP_071399.2| fidgetin-like 1 [Homo sapiens] gb|AAH51867.1| Fidgetin-lik
MSTDQQDLDLSVHHQIYLKDSDQPHNIQRKCLTHLVKVSSNILDNENTCTLVDHKLKALADILDKGHENVYDNRIKSLLLKSGKVAGNNIKSQLSNINPQQYITALPCTSEKSSCYNSENFDEELQDLLDTLKQNKSCKPAQNPEFLNQPNKKSYIEEKTKSNDNMTSLASSFKTAREELQIQNIQKYGTASNTVQSNSLAQKKRVGNRRGISNKFISPLRSNSGSHEDIKPKESEEPVDERLKNIEPQMVELIKSKIMDCNANLHWDEIAGYPLPKL

SEQ ID NO: 30734 - protein, 87 aa, Diabrotica virgifera
  misc_feature: Coding regions on vcDNA: vcDNA=SeqID_10431; Strand=+; Position=459-722
LDYCVLHLYYLLCVFDICLCWTSFKIIIVGYAAECIFYDISERHLSYWLPSSDIIVNFPLLIYNCPELSIWSESRMSALSLCDFYFL

SEQ ID NO: 30735 - protein, 103 aa, Diabrotica virgifera
  misc_feature: Coding regions on vcDNA: vcDNA=SeqID_10432; Strand=-; Position=2-310
  misc_feature (1)..(37): Xaa can be any naturally occurring amino acid
  misc_feature (40)..(50): Xaa can be any naturally occurring amino acid
  misc_feature (60)..(67): Xaa can be any naturally occurring amino acid
  misc_feature (70)..(83): Xaa can be any naturally occurring amino acid
  misc_feature (89)..(102): Xaa can be any naturally occurring amino acid
XXXXXXXXXXXXXXXXXXXXXXXXXXXXXXXXXXXXXPFXXXXXXXXXXXTNLAHTGLNXXXXXXXXSNXXXXXXXXXXXXXXPTSRSXXXXXXXXXXXXXXV

SEQ ID NO: 30736 - protein, 52 aa, Diabrotica virgifera
  misc_feature: Coding regions on vcDNA: vcDNA=SeqID_10433; Strand=+; Position=58-216
IHVLLAFKLLYLHKFLYSQQRSGIIRVGVLYNTTLYIVNEFLILISSNRVTM

SEQ ID NO: 30737 - protein, 62 aa, Diabrotica virgifera
  misc_feature: Coding regions on vcDNA: vcDNA=SeqID_10434; Strand=+; Position=274-462
  misc_feature (17)..(23): Xaa can be any naturally occurring amino acid
LRKCMNSGTSYHFNYSXXXXXXXYNSLYGPLLFDQIRYDNASLYRISHLYSDRQNPPESELN

SEQ ID NO: 30738 - protein, 111 aa, Diabrotica virgifera
  misc_feature: Coding regions on vcDNA: vcDNA=SeqID_10435; Strand=-; Position=800 -1135
  misc_feature (1)..(11): Xaa can be any naturally occurring amino acid
  misc_feature (41)..(47): Xaa can be any naturally occurring amino acid
  misc_feature (65)..(72): Xaa can be any naturally occurring amino acid
XXXXXXXXXXXRFCRETTFCFFLDEQKKKSNQIKTWQWRDXXXXXXXTFINFLTRVSFFCSDFQXXXXXXXXTKFIVNLLPLQSLIEIISKATNIWEVYFYLINAFNALNR

SEQ ID NO: 30739 - protein, 209 aa, Diabrotica virgifera
  misc_feature: Coding regions on vcDNA: vcDNA=SeqID_10436; Strand=-; Position=288-918
  misc_feature: Homolog annotation: Hit_ID=NP_510543.1; Match level="QueryCoverage =68%, HitCoverage=29%, E-value=1e-13, Identity=29%"; Hit description =reverse transcriptase family member (XQ19) [Caenorhabditis elegans] pir||A89723 protein
  misc_feature (48)..(48): Xaa can be any naturally occurring amino acid
  misc_feature (56)..(56): Xaa can be any naturally occurring amino acid
  misc_feature (139)..(139): Xaa can be any naturally occurring amino acid
RKSKISRGNSNFRNSKEKVTLKWAAYGALSDFFKSNLPKCLKKKIFEXCVLPVMTXGAETLSLTQATATKLRVAQRRMERSLLGLTLRDRVRNEEIRCYRASSMAEVQLGGPSSQNEDRRWTQKITVWRPRADRRSRGXPPTRSTDDVKRIAGNWLQEAQDRQNWKKLGEAYVQLWMQKAHKSLAQIMYTVTVIYLFDTKYWKAYITDI

SEQ ID NO: 30740 - protein, 262 aa, Diabrotica virgifera
  misc_feature: Coding regions on vcDNA: vcDNA=SeqID_10437; Strand=-; Position=2-790
  misc_feature (2)..(52): Xaa can be any naturally occurring amino acid
  misc_feature (59)..(196): Xaa can be any naturally occurring amino acid
  misc_feature (201)..(223): Xaa can be any naturally occurring amino acid
  misc_feature (229)..(238): Xaa can be any naturally occurring amino acid
  misc_feature (241)..(249): Xaa can be any naturally occurring amino acid
LXXXXXXXXXXXXXXXXXXXXXXXXXXXXXXXXXXXXXXXXXXXXXXXXXXXFKLIQWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFHYXXXXXXXXXXXXXXXXXXXXXXXGRSDVXXXXXXXXXXEVXXXXXXXXXREKILSRIRINYR

SEQ ID NO: 30741 - protein, 214 aa, Diabrotica virgifera
  misc_feature: Coding regions on vcDNA: vcDNA=SeqID_10438; Strand=-; Position=0-641
  misc_feature (12)..(31): Xaa can be any naturally occurring amino acid
  misc_feature (36)..(83): Xaa can be any naturally occurring amino acid
  misc_feature (88)..(107): Xaa can be any naturally occurring amino acid
  misc_feature (110)..(139): Xaa can be any naturally occurring amino acid
  misc_feature (192)..(198): Xaa can be any naturally occurring amino acid
QAAIQFNQGTEXXXXXXXXXXXXXXXXXXXXRIPLXXXXXXXXXXXXXXXXXXXXXXXXXXXXXXXXXXXXXXXXXXXXXXXXVLKYXXXXXXXXXXXXXXXXXXXXAHXXXXXXXXXXXXXXXXXXXXXXXXXXXXXXDIAITHHNSLQKNSLEDQHYNKICYIEYNKAYNSVLHNPLINLLRKKNIDTRXXXXXXXLYYEQEAVIRINNLNT

SEQ ID NO: 30742 - protein, 40 aa, Diabrotica virgifera
  misc_feature: Coding regions on vcDNA: vcDNA=SeqID_10439; Strand=-; Position=1-120
  misc_feature (6)..(40): Xaa can be any naturally occurring amino acid
FLIHPXXXXXXXXXXXXXXXXXXXXXXXXXXXXXXXXXXX

SEQ ID NO: 30743 - protein, 230 aa, Diabrotica virgifera
  misc_feature: Coding regions on vcDNA: vcDNA=SeqID_10440; Strand=-; Position=0-689
  misc_feature (1)..(228): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGT

SEQ ID NO: 30744 - protein, 286 aa, Diabrotica virgifera
  misc_feature: Coding regions on vcDNA: vcDNA=SeqID_10441; Strand=+; Position=19-879
  misc_feature: Homolog annotation: Hit_ID=AAH74365.1; Match level="QueryCoverage =94%, HitCoverage=85%, E-value=4e-63, Identity=42%"; Hit description =MGC84259 protein [Xenopus laevis]
  misc_feature: Pfam annotation: Pfam_ID=FAA_hydrolase; Match level="Score=211.1, E -value=2.2e-60, Copies=1"; Pfam description=Fumarylacetoacetate (FAA) hydrolase f
  misc_feature (230)..(230): Xaa can be any naturally occurring amino acid
MNICRRFSQYVNKNLEKMKIVQFKLNDNKVRIGVLSGDNVIDVNASDPTIPNSLVEFLQDEKALDKIKSIASNPKKEHTLTNIKLLSPITKPDKILGVASNYKDDCNMRNIPYPKEPMVFSKFASVIIGPNDPIPKSDATNALDWEVELVAIIGKKAQYVKAKDAMDYIFGYTITQDLTAKDWVMRNNGQLVMCKNFDGFCPLGPCIVTKEELGDPYNVKLKTWVNRELXQSGHSENMLQRIDTLVEYLTSVMTLLPGDLILTGTPFGVGASPIPPQYLQKGRLVK

SEQ ID NO: 30745 - protein, 262 aa, Diabrotica virgifera
  misc_feature: Coding regions on vcDNA: vcDNA=SeqID_10442; Strand=+; Position=2-787
  misc_feature: Homolog annotation: Hit_ID=XP_313256.1; Match level="QueryCoverage =100%, HitCoverage=42%, E-value=3e-94, Identity=62%"; Hit description= ENSANGP00000010460 [Anopheles gambiae]
  misc_feature: Gene Ontology Annotation: Molecular function=phenylalanine-tRNA ligase activity; Cellular component=phenylalanine-tRNA ligase complex; Biological process=phenylalanyl-tRNA aminoacylation
  misc_feature: Pfam annotation: Pfam_ID=B5; Match level="Score=92.1, E-value=1.5e -24, Copies=1"; Pfam description=tRNA synthetase B5 domain
HDYDTIKGPFIYDAKPPKDIWFVPLNQEKFSAEELMTLYSTHAQLKQYLPIIKDSPVYPVITDSNGVVLSLPPIINGNHSKITLDTKNVFIECTATDLTKAKVVLDTIVCMFSQYCSDSHNIEYCEVINPDGTSALYPDLEYRSENVSVKKSNKKIGINESPENIVQLFSKMCLTTELTNNSDIVKVTIPPTRHDVLHACDIYEDIAIAYGYNNIKRTFPKTNTVGQQFSINKLTDLLRYPIAEAGFTEALAFTLCSREDIS

SEQ ID NO: 30746 - protein, 88 aa, Diabrotica virgifera
  misc_feature: Coding regions on vcDNA: vcDNA=SeqID_10443; Strand=-; Position=79-345
  misc_feature (42)..(48): Xaa can be any naturally occurring amino acid
QKCISFSRIRYIRNCMTFRYKTIILTMDLSISILIFSFLGHXXXXXXXPYLTSPEAQGGTYGFISYINGNILVTLIVRVSINQICREL

SEQ ID NO: 30747 - protein, 100 aa, Diabrotica virgifera
  misc_feature: Coding regions on vcDNA: vcDNA=SeqID_10444; Strand=+; Position=106-408
VFFSRLSLDLKFLLRFTSPTFVLFQDLLSFVSFGVQSLFPKILTEFLYYSLPISYTGRFRSFMKNIHDMELHDPATDIMNVERSYYHNMVEVYRINGPLT

SEQ ID NO: 30748 - protein, 142 aa, Diabrotica virgifera
  misc_feature: Coding regions on vcDNA: vcDNA=SeqID_10445; Strand=+; Position=245-673
  misc_feature (3)..(10): Xaa can be any naturally occurring amino acid
  misc_feature (16)..(85): Xaa can be any naturally occurring amino acid
  misc_feature (107)..(133): Xaa can be any naturally occurring amino acid
  misc_feature (135)..(140): Xaa can be any naturally occurring amino acid
CTXXXXXXXXVFYEIXXXXXXXXXXXXXXXXXXXXXXXXXXXXXXXXXXXXXXXXXXXXXXXXXXXXXXXXXXXXXXXXXXXXXXHRFKLLNFSNDDNISINKLYIXXXXXXXXXXXXXXXXXXXXXXXXXXXNXXXXXXPD

SEQ ID NO: 30749 - protein, 276 aa, Diabrotica virgifera
  misc_feature: Coding regions on vcDNA: vcDNA=SeqID_10446; Strand=+; Position=2-829
  misc_feature (95)..(101): Xaa can be any naturally occurring amino acid
LLRPVRGLDDEFEIAESQNIASFDWVDPPLTNKKIQEYHAHESALISHGIPISPGDIITTNSDVIVGKPGRVGPRIPSIPVQQVSQENEIPIGMXXXXXXXHWKKNNHEYKRIPVTNNFEKPSEYRHEDYLGPPPPIAPFEYNAQNDKVNEISGNPVYAKNQKNYEPVHPQQHYNDQQYKFKDQQLPAFTHNHPVYAQTFNHEPPTREKPFNPNTKPVYSLQEPVPPKQHSNNRPLYVPADYHDIPINQGEILTGAIPHVQIKQYDPPDHLHVNIN

SEQ ID NO: 30750 - protein, 146 aa, Diabrotica virgifera
  misc_feature: Coding regions on vcDNA: vcDNA=SeqID_10447; Strand=+; Position=1-438
  misc_feature (79)..(87): Xaa can be any naturally occurring amino acid
  misc_feature (91)..(97): Xaa can be any naturally occurring amino acid
  misc_feature (103)..(112): Xaa can be any naturally occurring amino acid
  misc_feature (116)..(137): Xaa can be any naturally occurring amino acid
ATWTANDQLIYSDNGNLVLLDLRTNTSSMLLNSTDSILLTAFDFRLSADGLYLLEDLNYQKQFPQSYIVNNVIVEQIFXXXXXXXXXYSFXXXXXXXPNKFNXXXXXXXXXXISYXXXXXXXXXXXXXXXXXXXXXXHRKLGIKIF

SEQ ID NO: 30751 - protein, 51 aa, Diabrotica virgifera
  misc_feature: Coding regions on vcDNA: vcDNA=SeqID_10448; Strand=+; Position=371-526
YFRADLVCLSHLRKESVNVQRDIFLFCHCLRLEMCYNLRYYTRKKLDKTPS

SEQ ID NO: 30752 - protein, 196 aa, Diabrotica virgifera
  misc_feature: Coding regions on vcDNA: vcDNA=SeqID_10449; Strand=+; Position=36-626
  misc_feature: Homolog annotation: Hit_ID=NP_000190.1; Match level="QueryCoverage =92%, HitCoverage=36%, E-value=6e-65, Identity=65%"; Hit description =N-sulfoglucosamine sulfohydrolase (sulfamidase) [Homo sapiens] gb|AAH47318.1| N-sulfoglucosamine
  misc_feature: Gene Ontology Annotation: Molecular function=catalytic activity; Cellular component=lysosome; Biological process=proteoglycan metabolism
  misc_feature: Pfam annotation: Pfam_ID=Sulfatase; Match level="Score=-78.2, E-value= 0.021, Copies=1"; Pfam description=Sulfatase
MYFWIILGCCLIQIDCTIPPKKLNALVILADDGGFEMGVYRNKICQTPNLDKLARQSLIFNKAFTSVSSCSPSRAALLTGTPSHQNGMYGLHQGVHNFNSLSNVNSISNILKQNGIRTGIIGKKHVGPEEVYPFDFSETEENNSILLVGRNITHIKLLARQFLNTSDPFFLYIVFHDPHLCAHTNPEYGEKPAQNY

SEQ ID NO: 30753 - protein, 160 aa, Diabrotica virgifera
  misc_feature: Coding regions on vcDNA: vcDNA=SeqID_10450; Strand=+; Position=408-890
  misc_feature: Homolog annotation: Hit_ID=CAA10770.1; Match level="QueryCoverage =65%, HitCoverage=31%, E-value=4e-15, Identity=37%"; Hit description =reverse transcriptase-like [Bos taurus]
LNVTFWSVLLYDVEAWTLKISTINRLEAFEMWLHRRILKIPWTAMLTNVAVLKRANAARELLDNIKFRKMAYFGHVVKGDRYNILQLIMMGKIEGRRGIGRKQASWLKNIREWTGMKKAEQLFRIARDRQFHHVNRQTSGDLIGHVKKKIAVLLILPYDI

SEQ ID NO: 30754 - protein, 34 aa, Diabrotica virgifera
  misc_feature: Coding regions on vcDNA: vcDNA=SeqID_10451; Strand=-; Position=1-102
  misc_feature (1)..(6): Xaa can be any naturally occurring amino acid
  misc_feature (8)..(23): Xaa can be any naturally occurring amino acid
XXXXXXAXXXXXXXXXXXXXXXXVNSFINLMGFL

SEQ ID NO: 30755 - protein, 70 aa, Diabrotica virgifera
  misc_feature: Coding regions on vcDNA: vcDNA=SeqID_10452; Strand=+; Position=2-211
  misc_feature (1)..(40): Xaa can be any naturally occurring amino acid
  misc_feature (54)..(66): Xaa can be any naturally occurring amino acid
XXXXXXXXXXXXXXXXXXXXXXXXXXXXXXXXXXXXXXXXVRIRIISFHILRYXXXXXXXXXXXXXANLY

SEQ ID NO: 30756 - protein, 34 aa, Diabrotica virgifera; identical to SEQ ID NO: 27603
  misc_feature: Coding regions on vcDNA: vcDNA=SeqID_10453; Strand=-; Position=80-184

SEQ ID NO: 30757 - protein, 157 aa, Diabrotica virgifera
  misc_feature: Coding regions on vcDNA: vcDNA=SeqID_10454; Strand=+; Position=267-791
  misc_feature: Homolog annotation: Hit_ID=EAL29040.1; Match level="QueryCoverage =98%, HitCoverage=33%, E-value=3e-27, Identity=41%"; Hit description =GA19687-PA [Drosophila pseudoobscura]
  misc_feature: Gene Ontology Annotation: Molecular function=protein-arginine N -methyltransferase activity; Cellular component=nucleus; Biological process=protein-nucleus import
MDWYSRLHKPDPKILTESTIALWDDDVYLKPGELQPWLMYDFDDLGSAPSTPHYAIDDLTMQVKHNDLMLENYHRDMEKMKEDTRTIVEAGDSAIRKIPHNIVSSGCQSGDYFNSYSHFGIHHDMLNDKVRTESYRDAILKNSNLLSGKHVLDVGCG

SEQ ID NO: 30758 - protein, 60 aa, Diabrotica virgifera
  misc_feature: Coding regions on vcDNA: vcDNA=SeqID_10455; Strand=+; Position=1-183
EFQLEEPEEESDGEDTEEKREKRLVKEVKMIATKNAISGVTMFMLYNNSLIYLDVRIPLC

SEQ ID NO: 30759 - protein, 253 aa, Diabrotica virgifera
  misc_feature: Coding regions on vcDNA: vcDNA=SeqID_10456; Strand=-; Position=1-759
  misc_feature (4)..(253): Xaa can be any naturally occurring amino acid
SSNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30760 - protein, 93 aa, Diabrotica virgifera
  misc_feature: Coding regions on vcDNA: vcDNA=SeqID_10457; Strand=+; Position=1-282
  misc_feature (1)..(57): Xaa can be any naturally occurring amino acid
  misc_feature (62)..(67): Xaa can be any naturally occurring amino acid
XXXXXXXXXXXXXXXXXXXXXXXXXXXXXXXXXXXXXXXXXXXXXXXXXXXXXXXXXPFFLXXXXXXLRITGEFFWKVQTDKKNWDPPRWIKV

SEQ ID NO: 30761 - protein, 207 aa, Diabrotica virgifera
  misc_feature: Coding regions on vcDNA: vcDNA=SeqID_10458; Strand=+; Position=66-690
  misc_feature: Homolog annotation: Hit_ID=XP_484773.1; Match level="QueryCoverage =47%, HitCoverage=60%, E-value=3e-28, Identity=50%"; Hit description =similar to RIKEN cDNA 6330416L07 gene [Mus musculus]
  misc_feature: Gene Ontology Annotation: Molecular function=electron transporter activity; Cellular component=nucleus; Biological process=electron transport
  misc_feature: Pfam annotation: Pfam_ID=zf-C2H2; Match level="Score=79.6, E-value =8.6e-21, Copies=3"; Pfam description=Zinc finger, C2H2 type
  misc_feature (190)..(190): Xaa can be any naturally occurring amino acid
MEDKSEIKKEFTEYDQTCIEGHLSPSVGLKNFKNEPKEDHPAMEVKVENEEVAEFDQKDIDNLSTSIDLKDLKDEPEENQQGCLQNKNKMKIPENSSPKIWVDTPKKKKLNMKVQTGKGPYTCAICLKQFSQRFNLKPHMMIHTGEKPHKCQICFKQFSLKCNLKGHLKVHTGEKPYKCDICLKQFTQKXYLKSHLRIHTGEKPHHW

SEQ ID NO: 30762 - protein, 69 aa, Diabrotica virgifera
  misc_feature: Coding regions on vcDNA: vcDNA=SeqID_10459; Strand=-; Position=3-212
  misc_feature (2)..(21): Xaa can be any naturally occurring amino acid
AXXXXXXXXXXXXXXXXXXXXLHPKTSKFKKRTKLKNKLLPPIKILNPTMESPIFFTDGPSQKKFGCYP

SEQ ID NO: 30763 - protein, 79 aa, Diabrotica virgifera
  misc_feature: Coding regions on vcDNA: vcDNA=SeqID_10460; Strand=-; Position=58-297
  misc_feature (37)..(44): Xaa can be any naturally occurring amino acid
  misc_feature (66)..(72): Xaa can be any naturally occurring amino acid
ILSEFIPILFLISLLFILSIFVTLNLLLLRNSISVVXXXXXXXXYCFHTHMLYWILLGYFLSWCIXXXXXXXLFSCFFV

SEQ ID NO: 30764 - protein, 120 aa, Diabrotica virgifera
  misc_feature: Coding regions on vcDNA: vcDNA=SeqID_10461; Strand=+; Position=71-433
NKLNEAKTPIEQLNQFKYLGVDLSNYHDPVRGPRLQINKAIVRSGCLRDIVWNNPYMRTDSKVMTYGLESPIRSKVKDGFACFRFRGMHNRRTAVSTISGFMKTALPCTPLNRKTARPSI

SEQ ID NO: 30765 - protein, 34 aa, Diabrotica virgifera; identical to SEQ ID NO: 27603
  misc_feature: Coding regions on vcDNA: vcDNA=SeqID_10462; Strand=-; Position=80-184

SEQ ID NO: 30766 - protein, 213 aa, Diabrotica virgifera
  misc_feature: Coding regions on vcDNA: vcDNA=SeqID_10463; Strand=+; Position=185-826
  misc_feature (28)..(139): Xaa can be any naturally occurring amino acid
  misc_feature (141)..(167): Xaa can be any naturally occurring amino acid
  misc_feature (188)..(200): Xaa can be any naturally occurring amino acid
  misc_feature (203)..(210): Xaa can be any naturally occurring amino acid
LSKIYICSFFCTVMLFDFKDIYFFHTYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMXXXXXXXXXXXXXXXXXXXXXXXXXXXISFCFFYETRKDRGGVKKTFXXXXXXXXXXXXXVKXXXXXXXXEDP

SEQ ID NO: 30767 - protein, 57 aa, Diabrotica virgifera
  misc_feature: Coding regions on vcDNA: vcDNA=SeqID_10464; Strand=-; Position=41-214
  misc_feature (35)..(55): Xaa can be any naturally occurring amino acid
KCIFVSYPRVESIDSITLKLLALILLGTKNRFFWXXXXXXXXXXXXXXXXXXXXXFY

SEQ ID NO: 30768 - protein, 60 aa, Diabrotica virgifera
  misc_feature: Coding regions on vcDNA: vcDNA=SeqID_10465; Strand=+; Position=21-203
VCFFDNFIILRIDFSDFDQTRILRPPMPTLALLNFKNDPTVHHPAIYDIFHNVRAAPIVH

SEQ ID NO: 30769 - protein, 91 aa, Diabrotica virgifera
  misc_feature: Coding regions on vcDNA: vcDNA=SeqID_10466; Strand=-; Position=8-283
LCCIELLVRHVLGPHHKMRESSGRLPLPSMRVYRAFSANNHRNGIQNLVSASGGSRLVVVDGLVSGSVDFVSRPIVMRNLLLAIPQIHVRI

SEQ ID NO: 30770 - protein, 81 aa, Diabrotica virgifera
  misc_feature: Coding regions on vcDNA: vcDNA=SeqID_10467; Strand=-; Position=57-302
  misc_feature (33)..(60): Xaa can be any naturally occurring amino acid
  misc_feature (65)..(76): Xaa can be any naturally occurring amino acid
AFQNGIHQSPSTTSLHTTFTRDIIIEMVNLTNXXXXXXXXXXXXXXXXXXXXXXXXXXXXIKQLXXXXXXXXXXXXAYDLK

SEQ ID NO: 30771 - protein, 318 aa, Diabrotica virgifera
  misc_feature: Coding regions on vcDNA: vcDNA=SeqID_10468; Strand=-; Position=1-954
  misc_feature (9)..(22): Xaa can be any naturally occurring amino acid
  misc_feature (24)..(24): Xaa can be any naturally occurring amino acid
  misc_feature (30)..(50): Xaa can be any naturally occurring amino acid
  misc_feature (52)..(75): Xaa can be any naturally occurring amino acid
  misc_feature (79)..(79): Xaa can be any naturally occurring amino acid
  misc_feature (82)..(284): Xaa can be any naturally occurring amino acid
  misc_feature (287)..(316): Xaa can be any naturally occurring amino acid
FILKSKKWXXXXXXXXXXXXXXFXIPPINXXXXXXXXXXXXXXXXXXXXXLXXXXXXXXXXXXXXXXXXXXXXXXHPPXSIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXXXXXXXXXXXXXXXXXKK

SEQ ID NO: 30772 - protein, 179 aa, Diabrotica virgifera
  misc_feature: Coding regions on vcDNA: vcDNA=SeqID_10469; Strand=-; Position=3-539
  misc_feature (1)..(25): Xaa can be any naturally occurring amino acid
  misc_feature (27)..(93): Xaa can be any naturally occurring amino acid
  misc_feature (95)..(102): Xaa can be any naturally occurring amino acid
  misc_feature (110)..(124): Xaa can be any naturally occurring amino acid
  misc_feature (136)..(144): Xaa can be any naturally occurring amino acid
  misc_feature (148)..(161): Xaa can be any naturally occurring amino acid
  misc_feature (164)..(172): Xaa can be any naturally occurring amino acid
XXXXXXXXXXXXXXXXXXXXXXXXXVXXXXXXXXXXXXXXXXXXXXXXXXXXXXXXXXXXXXXXXXXXXXXXXXXXXXXXXXXXXXXXXXXXXKXXXXXXXXLKITIYRXXXXXXXXXXXXXXXPLITSYKQSTNXXXXXXXXXLSHXXXXXXXXXXXXXXEYXXXXXXXXXPLYRGGG

SEQ ID NO: 30773 - protein, 58 aa, Diabrotica virgifera
  misc_feature: Coding regions on vcDNA: vcDNA=SeqID_10470; Strand=+; Position=24-200
  misc_feature: Homolog annotation: Hit_ID=AAQ68240.1; Match level="QueryCoverage =89%, HitCoverage=25%, E-value=1e-09, Identity=63%"; Hit description =cytochrome c oxidase subunit I [Ophiothrix ciliaris]
  misc_feature (37)..(37): Xaa can be any naturally occurring amino acid
  misc_feature (49)..(49): Xaa can be any naturally occurring amino acid
SYNQEIDPFYNDIVTDHAFIITCYIVIPIIIGGSVNXLVPLKLVAPNRXFPPINNIRF

SEQ ID NO: 30774 - protein, 314 aa, Diabrotica virgifera
  misc_feature: Coding regions on vcDNA: vcDNA=SeqID_10471; Strand=-; Position=0-941
  misc_feature (7)..(26): Xaa can be any naturally occurring amino acid
  misc_feature (30)..(291): Xaa can be any naturally occurring amino acid
  misc_feature (294)..(313): Xaa can be any naturally occurring amino acid
ENGIQKXXXXXXXXXXXXXXXXXXXXAPNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRYXXXXXXXXXXXXXXXXXXXXR

SEQ ID NO: 30775 - protein, 48 aa, Diabrotica virgifera
  misc_feature: Coding regions on vcDNA: vcDNA=SeqID_10472; Strand=-; Position=0-143
  misc_feature (4)..(19): Xaa can be any naturally occurring amino acid
  misc_feature (23)..(45): Xaa can be any naturally occurring amino acid
ENGXXXXXXXXXXXXXXXXFLIXXXXXXXXXXXXXXXXXXXXXXXYRV

SEQ ID NO: 30776 - protein, 219 aa, Diabrotica virgifera
  misc_feature: Coding regions on vcDNA: vcDNA=SeqID_10473; Strand=+; Position=82-738
  misc_feature (26)..(36): Xaa can be any naturally occurring amino acid
  misc_feature (41)..(55): Xaa can be any naturally occurring amino acid
  misc_feature (67)..(75): Xaa can be any naturally occurring amino acid
  misc_feature (78)..(101): Xaa can be any naturally occurring amino acid
  misc_feature (110)..(171): Xaa can be any naturally occurring amino acid
  misc_feature (175)..(184): Xaa can be any naturally occurring amino acid
  misc_feature (191)..(208): Xaa can be any naturally occurring amino acid
YRETIFYFSHRRPYFLYLAYQGLFIXXXXXXXXXXXRARKXXXXXXXXXXXXXXXNEMVLVLTYLQXXXXXXXXXYQXXXXXXXXXXXXXXXXXXXXXXXXILFKLTLYXXXXXXXXXXXXXXXXXXXXXXXXXXXXXXXXXXXXXXXXXXXXXXXXXXXXXXXXXXXXXXEFGXXXXXXXXXXCLSVLHXXXXXXXXXXXXXXXXXXRSGNLILSFFY

SEQ ID NO: 30777 - protein, 74 aa, Diabrotica virgifera
  misc_feature: Coding regions on vcDNA: vcDNA=SeqID_10474; Strand=-; Position=206-430
  misc_feature (8)..(29): Xaa can be any naturally occurring amino acid
  misc_feature (31)..(55): Xaa can be any naturally occurring amino acid
KTRRPYRXXXXXXXXXXXXXXXXXXXXXXGXXXXXXXXXXXXXXXXXXXXXXXXXIRINYLRDNSVILLESSNR

SEQ ID NO: 30778 - protein, 212 aa, Diabrotica virgifera
  misc_feature: Coding regions on vcDNA: vcDNA=SeqID_10475; Strand=-; Position=1-639
  misc_feature (28)..(154): Xaa can be any naturally occurring amino acid
  misc_feature (157)..(162): Xaa can be any naturally occurring amino acid
  misc_feature (165)..(212): Xaa can be any naturally occurring amino acid
TLIQHRGRNLYYRFQLSNKIHAVLPKVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLIXXXXXXRRXXXXXXXXXXXXXXXXXXXXXXXXXXXXXXXXXXXXXXXXXXXXXXXX

SEQ ID NO: 30779 - protein, 22 aa, Diabrotica virgifera
  misc_feature: Coding regions on vcDNA: vcDNA=SeqID_10476; Strand=-; Position=0-65
  misc_feature (1)..(20): Xaa can be any naturally occurring amino acid
XXXXXXXXXXXXXXXXXXXXTP

SEQ ID NO: 30780 - protein, 190 aa, Diabrotica virgifera
  misc_feature: Coding regions on vcDNA: vcDNA=SeqID_10477; Strand=+; Position=208-777
  misc_feature: Homolog annotation: Hit_ID=XP_316863.1; Match level="QueryCoverage =100%, HitCoverage=67%, E-value=2e-54, Identity=51%"; Hit description= ENSANGP00000013091 [Anopheles gambiae]
  misc_feature: Gene Ontology Annotation: Molecular function=molecular_function unknown; Cellular component=cellular_component unknown; Biological process=biological_process unknown
  misc_feature: Pfam annotation: Pfam_ID=zf-DHHC; Match level="Score=114.3, E-value =3e-31, Copies=1"; Pfam description=DHHC zinc finger domain
MFVGEFGKIVHWGPLTALGIIKVVTAMTIHCSNMWWPRSTIGGKLNFLVFVGFSGLTLYNFLSSMYHGPGYLILNWRPEKEEHCKNLQFCLECQGYKAPRSHHCRKCGRCVLKMDHHCPWINNCVGWGNHAHFIFFLTFATAGCLQASVILGCCLYKSIHRVGYYYQGDTSVSFGVNGMIVCDLALGLSI

SEQ ID NO: 30781 - protein, 87 aa, Diabrotica virgifera
  misc_feature: Coding regions on vcDNA: vcDNA=SeqID_10478; Strand=-; Position=2-262
  misc_feature (12)..(32): Xaa can be any naturally occurring amino acid
  misc_feature (37)..(43): Xaa can be any naturally occurring amino acid
  misc_feature (60)..(70): Xaa can be any naturally occurring amino acid
  misc_feature (76)..(83): Xaa can be any naturally occurring amino acid
FLTNTTSIHINXXXXXXXXXXXXXXXXXXXXXVIFYXXXXXXXHNKQKIHYSIKSQNIFXXXXXXXXXXXLKEKKXXXXXXXXDLLI

SEQ ID NO: 30782 - protein, 24 aa, Diabrotica virgifera
  misc_feature: Coding regions on vcDNA: vcDNA=SeqID_10479; Strand=-; Position=2-73
FLSLSLSSPFLRHPHNNKNTRPSR

SEQ ID NO: 30783 - protein, 295 aa, Diabrotica virgifera
  misc_feature: Coding regions on vcDNA: vcDNA=SeqID_10480; Strand=+; Position=1-888
  misc_feature (14)..(35): Xaa can be any naturally occurring amino acid
  misc_feature (45)..(193): Xaa can be any naturally occurring amino acid
  misc_feature (206)..(206): Xaa can be any naturally occurring amino acid
  misc_feature (219)..(282): Xaa can be any naturally occurring amino acid
  misc_feature (284)..(294): Xaa can be any naturally occurring amino acid
INQFIIILSLSKSXXXXXXXXXXXXXXXXXXXXXXRNVIRFSNIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYHLGFFMEAGWKXWNEKKTVFINLIXXXXXXXXXXXXXXXXXXXXXXXXXXXXXXXXXXXXXXXXXXXXXXXXXXXXXXXXXXXXXXXXDXXXXXXXXXXXP

SEQ ID NO: 30784 - protein, 19 aa, Diabrotica virgifera
  misc_feature: Coding regions on vcDNA: vcDNA=SeqID_10481; Strand=-; Position=0-56
IQDSVNSTKNLCTFHRGVP

SEQ ID NO: 30785 - protein, 260 aa, Diabrotica virgifera
  misc_feature: Coding regions on vcDNA: vcDNA=SeqID_10482; Strand=+; Position=145-924
  misc_feature (5)..(230): Xaa can be any naturally occurring amino acid
  misc_feature (249)..(257): Xaa can be any naturally occurring amino acid
LLNTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKNPHKCLYNLYSTFLPIIXXXXXXXXXGGV

SEQ ID NO: 30786 - protein, 51 aa, Diabrotica virgifera
  misc_feature: Coding regions on vcDNA: vcDNA=SeqID_10483; Strand=+; Position=1-156
  misc_feature (5)..(15): Xaa can be any naturally occurring amino acid
  misc_feature (21)..(28): Xaa can be any naturally occurring amino acid
PPSSXXXXXXXXXXXIWSFRXXXXXXXXDRNQPGSHRFKLRSCKILKVEQT

SEQ ID NO: 30787 - protein, 79 aa, Diabrotica virgifera
  misc_feature: Coding regions on vcDNA: vcDNA=SeqID_10484; Strand=+; Position=483-721
  misc_feature: Homolog annotation: Hit_ID=XP_309915.1; Match level="QueryCoverage =98%, HitCoverage=16%, E-value=2e-10, Identity=46%"; Hit description =ENSANGP00000015117 [Anopheles gambiae]
  misc_feature (31)..(31): Xaa can be any naturally occurring amino acid
  misc_feature (41)..(41): Xaa can be any naturally occurring amino acid
IIYETVIRPTVTYAYERWILKKSETDHSERXERKMQIGSNXGGVKIQGQWRRKTNKELEELYKRPTITTTIKAQRIRYL

SEQ ID NO: 30788 - protein, 72 aa, Diabrotica virgifera
  misc_feature: Coding regions on vcDNA: vcDNA=SeqID_10485; Strand=-; Position=1-216
  misc_feature (2)..(9): Xaa can be any naturally occurring amino acid
  misc_feature (11)..(29): Xaa can be any naturally occurring amino acid
  misc_feature (32)..(72): Xaa can be any naturally occurring amino acid
GXXXXXXXXRXXXXXXXXXXXXXXXXXXXSPXXXXXXXXXXXXXXXXXXXXXXXXXXXXXXXXXXXXXXXXX

SEQ ID NO: 30789 - protein, 72 aa, Diabrotica virgifera
  misc_feature: Coding regions on vcDNA: vcDNA=SeqID_10486; Strand=+; Position=30-247
  misc_feature: Homolog annotation: Hit_ID=AAT69018.1; Match level="QueryCoverage =100%, HitCoverage=15%, E-value=9e-15, Identity=56%"; Hit description= cytochrome oxidase subunit I [Moneilema appressum]
  misc_feature (28)..(28): Xaa can be any naturally occurring amino acid
  misc_feature (35)..(35): Xaa can be any naturally occurring amino acid
  misc_feature (47)..(47): Xaa can be any naturally occurring amino acid
  misc_feature (57)..(57): Xaa can be any naturally occurring amino acid
LGMDLPFNAIVTAHVFIITCYIVIPIYXIAGFGNXLVPLKLAAPTIXFPLINNKRFXLLPPSLLLLLFRKIV

SEQ ID NO: 30790 - protein, 58 aa, Diabrotica virgifera
  misc_feature: Coding regions on vcDNA: vcDNA=SeqID_10487; Strand=+; Position=270-446
RIITGTTCEVNRDIALKENYGQAHDEYVFYPVHYYLIMGAGLKYFSISDNRGIDVGIL

SEQ ID NO: 30791 - protein, 106 aa, Diabrotica virgifera
  misc_feature: Coding regions on vcDNA: vcDNA=SeqID_10488; Strand=-; Position=0-317
  misc_feature (31)..(49): Xaa can be any naturally occurring amino acid
  misc_feature (51)..(75): Xaa can be any naturally occurring amino acid
  misc_feature (77)..(84): Xaa can be any naturally occurring amino acid
  misc_feature (86)..(86): Xaa can be any naturally occurring amino acid
  misc_feature (89)..(89): Xaa can be any naturally occurring amino acid
  misc_feature (94)..(101): Xaa can be any naturally occurring amino acid
  misc_feature (104)..(104): Xaa can be any naturally occurring amino acid
SPRGGAFFLRLDLPKKSAVSLGNLSFNQKMXXXXXXXXXXXXXXXXXXXPXXXXXXXXXXXXXXXXXXXXXXXXXLXXXXXXXXYXKIXNSYKXXXXXXXXHPXPS

SEQ ID NO: 30792 - protein, 166 aa, Diabrotica virgifera
  misc_feature: Coding regions on vcDNA: vcDNA=SeqID_10489; Strand=+; Position=3-503
YEYKNATSSPFKPLKCAAAPKSHIRFDNETEVKEETGEVNGEKEQDDVSVICIDNQKIYEYKNATSLFNWHAITGLPDVEDVVAFKVFKLTDELTPGISSEIVGTVKEVLENNWVTIFIWDGLEELQNSCAETMESDELNDELSPMKTLRWFDLIHPKRGEKITKY

SEQ ID NO: 30793 - protein, 77 aa, Diabrotica virgifera
  misc_feature: Coding regions on vcDNA: vcDNA=SeqID_10490; Strand=+; Position=3-236
  misc_feature (1)..(16): Xaa can be any naturally occurring amino acid
  misc_feature (18)..(43): Xaa can be any naturally occurring amino acid
  misc_feature (57)..(65): Xaa can be any naturally occurring amino acid
  misc_feature (69)..(75): Xaa can be any naturally occurring amino acid
XXXXXXXXXXXXXXXXHXXXXXXXXXXXXXXXXXXXXXXXXXXLKKLDIFNNEEHFXXXXXXXXXYFTXXXXXXXLF

SEQ ID NO: 30794 - protein, 327 aa, Diabrotica virgifera
  misc_feature: Coding regions on vcDNA: vcDNA=SeqID_10491; Strand=-; Position=0-980
  misc_feature (1)..(11): Xaa can be any naturally occurring amino acid
  misc_feature (14)..(24): Xaa can be any naturally occurring amino acid
  misc_feature (34)..(42): Xaa can be any naturally occurring amino acid
  misc_feature (44)..(57): Xaa can be any naturally occurring amino acid
  misc_feature (64)..(76): Xaa can be any naturally occurring amino acid
  misc_feature (78)..(323): Xaa can be any naturally occurring amino acid
XXXXXXXXXXXALXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDAGG

SEQ ID NO: 30795 - protein, 20 aa, Diabrotica virgifera
  misc_feature: Coding regions on vcDNA: vcDNA=SeqID_10492; Strand=-; Position=0-59
  misc_feature (9)..(19): Xaa can be any naturally occurring amino acid
IKFPRLSLXXXXXXXXXXXV

SEQ ID NO: 30796 - protein, 159 aa, Diabrotica virgifera
  misc_feature: Coding regions on vcDNA: vcDNA=SeqID_10493; Strand=+; Position=64-544
  misc_feature: Homolog annotation: Hit_ID=AAR22385.1; Match level="QueryCoverage =65%, HitCoverage=43%, E-value=4e-16, Identity=41%"; Hit description =cellulase II [Apriona germari]
  misc_feature: Pfam annotation: Pfam_ID=Glyco_hydro_45; Match level="Score=-83.6, E -value=0.043, Copies=1"; Pfam description=Glycosyl hydrolase family 45
  misc_feature (87)..(87): Xaa can be any naturally occurring amino acid
IVPLDEPRPELKVFALKKLDSIVGELPAHGGETYIHLEEYHVPHEIYLVLNRVDDNAKSGCEDGGTAYSCDNQLPWTEKTTMSYRVXAESFRNRIEVSLCCARVLLNFIDHTSNKIKIVQMTNTVSDFNQNHYDIALPEDAVEISTLRCHDKWNAPWIG

SEQ ID NO: 30797 - protein, 46 aa, Diabrotica virgifera
  misc_feature: Coding regions on vcDNA: vcDNA=SeqID_10494; Strand=+; Position=252-392
NEKKSAPISLPIISYLLDTNLLPPCSYLLYVYDSQIKYSYSALQYK

SEQ ID NO: 30798 - protein, 65 aa, Diabrotica virgifera
  misc_feature: Coding regions on vcDNA: vcDNA=SeqID_10495; Strand=+; Position=138-335
TRLKLPRISRTLFTDAMGIRIIHRKPDATLSAYYLSTVYVICDFDRVLLWCTSPLRSVNVACCCF

SEQ ID NO: 30799 - protein, 94 aa, Diabrotica virgifera
  misc_feature: Coding regions on vcDNA: vcDNA=SeqID_10496; Strand=-; Position=344-628
NKVLLPSKKILPIIYLISLIHTGNSDTYYTFQSRRLQNDTANIHELRSWDDPLKDSSFDYMKSTPTQEHPSQKIIACDMSPKRQPNATTAKLSR

SEQ ID NO: 30800 - protein, 216 aa, Diabrotica virgifera
  misc_feature: Coding regions on vcDNA: vcDNA=SeqID_10497; Strand=-; Position=2-650
  misc_feature: Homolog annotation: Hit_ID=AAK14815.1; Match level="QueryCoverage =86%, HitCoverage=17%, E-value=4e-25, Identity=32%"; Hit description =polyprotein [Schistosoma japonicum]
  misc_feature: Gene Ontology Annotation: Molecular function=molecular_function unknown; Cellular component=cellular_component unknown; Biological process=biological_process unknown
  misc_feature (98)..(98): Xaa can be any naturally occurring amino acid
  misc_feature (132)..(132): Xaa can be any naturally occurring amino acid
MYFDSLLNEEFDRQPVESVTVMVNTISNEEVAKALQKIKKGKAVGPDDIPGEVWRALGETGTRWLAGLFNRIMEVGQMPDEWRSSILVPVYKKQGRYXQCTNSRAIKLLSHTMKIWERVIDRRIREETEISXNQFGFMQGRSTTNAIFIIRQLMEKYKSKETNAHIVFIDLEKTYDRVPREILWWALNKKEVPGEYVKIVRDMYEGVTTSVRTGVG

SEQ ID NO: 30801 - protein, 73 aa, Diabrotica virgifera
  misc_feature: Coding regions on vcDNA: vcDNA=SeqID_10498; Strand=+; Position=273-494
  misc_feature (54)..(60): Xaa can be any naturally occurring amino acid
LIVGHHKPLPTRFTKYIHRTSQLQTAPHRCYSAQRFPKSSGPSYEYTQELQKIXXXXXXXQFIPINILVFTLQ

SEQ ID NO: 30802 - protein, 254 aa, Diabrotica virgifera
  misc_feature: Coding regions on vcDNA: vcDNA=SeqID_10499; Strand=-; Position=344 -1108
  misc_feature (3)..(46): Xaa can be any naturally occurring amino acid
  misc_feature (48)..(75): Xaa can be any naturally occurring amino acid
  misc_feature (77)..(86): Xaa can be any naturally occurring amino acid
  misc_feature (95)..(101): Xaa can be any naturally occurring amino acid
  misc_feature (103)..(109): Xaa can be any naturally occurring amino acid
  misc_feature (115)..(124): Xaa can be any naturally occurring amino acid
  misc_feature (126)..(169): Xaa can be any naturally occurring amino acid
  misc_feature (173)..(202): Xaa can be any naturally occurring amino acid
  misc_feature (204)..(213): Xaa can be any naturally occurring amino acid
  misc_feature (241)..(251): Xaa can be any naturally occurring amino acid
NTXXXXXXXXXXXXXXXXXXXXXXXXXXXXXXXXXXXXXXXXXXXXAXXXXXXXXXXXXXXXXXXXXXXXXXXXXTXXXXXXXXXXFFPRRGGGXXXXXXXPXXXXXXXFLLGGXXXXXXXXXXCXXXXXXXXXXXXXXXXXXXXXXXXXXXXXXXXXXXXXXXXXXXXFGGXXXXXXXXXXXXXXXXXXXXXXXXXXXXXXPXXXXXXXXXXFPRGKIPGPFQINKGAGGLLFLNQTGQXXXXXXXXXXXRIP

SEQ ID NO: 30803 - protein, 22 aa, Diabrotica virgifera
  misc_feature: Coding regions on vcDNA: vcDNA=SeqID_10500; Strand=-; Position=0-65
  misc_feature (4)..(21): Xaa can be any naturally occurring amino acid
KLGXXXXXXXXXXXXXXXXXXP

SEQ ID NO: 30804 - protein, 247 aa, Diabrotica virgifera
  misc_feature: Coding regions on vcDNA: vcDNA=SeqID_10501; Strand=-; Position=2-744
  misc_feature: Homolog annotation: Hit_ID=AAQ01581.1; Match level="QueryCoverage =93%, HitCoverage=37%, E-value=3e-47, Identity=42%"; Hit description =agCP7521-like protein [Aedes albopictus]
  misc_feature: Pfam annotation: Pfam_ID=rve; Match level="Score=96.2, E-value=8.4e -26, Copies=1"; Pfam description=Integrase core domain
  misc_feature (128)..(128): Xaa can be any naturally occurring amino acid
  misc_feature (168)..(168): Xaa can be any naturally occurring amino acid
  misc_feature (214)..(214): Xaa can be any naturally occurring amino acid
MGIGNRNNLYEITFEIDKHECQNVVTEHNEFLQWHKRFAHINFSDLKSLIKNKIVNGIENVRISNIEFCEPCVEGKISKRPFGTRTKSTRLLQIICSDVCGPITPICHDGSKYFVTFIDDFSNFTAVXYMIKQKNEVFQKFVEFYNMAKAKFGFGISKLRCDNGGEYXISGELRKFCLDNGVVLDYTTPYTPQQNGKAERKNRILVERARTIIXELGVPKQLWGEAIWYSNYVINRCTANTLNENKT

SEQ ID NO: 30805 - protein, 40 aa, Diabrotica virgifera
  misc_feature: Coding regions on vcDNA: vcDNA=SeqID_10502; Strand=+; Position=1-120
  misc_feature: Homolog annotation: Hit_ID=NP_572918.1; Match level="QueryCoverage =100%, HitCoverage=7%, E-value=4e-09, Identity=67%"; Hit description =CG10990-PA [Drosophila melanogaster] gb|AAF48312.2| CG10990-PA [Drosophila melanogaster]
DDLPDISMDVPLAYIILDRFVERCHTVGFLTENVIKKMPS

SEQ ID NO: 30806 - protein, 30 aa, Diabrotica virgifera
  misc_feature: Coding regions on vcDNA: vcDNA=SeqID_10503; Strand=-; Position=1-90
  misc_feature (15)..(30): Xaa can be any naturally occurring amino acid
CAFILTRGPASLYKXXXXXXXXXXXXXXXX

SEQ ID NO: 30807 - protein, 301 aa, Diabrotica virgifera
  misc_feature: Coding regions on vcDNA: vcDNA=SeqID_10504; Strand=-; Position=39-941
  misc_feature: Homolog annotation: Hit_ID=EAA60955.1; Match level="QueryCoverage =85%, HitCoverage=47%, E-value=2e-24, Identity=26%"; Hit description =hypothetical protein AN4877.2 [Aspergillus nidulans FGSC A4] ref|XP _409014.1| hypothetical protein AN4877.
  misc_feature: Pfam annotation: Pfam_ID=DDE; Match level="Score=41.4, E-value=2.7e -09, Copies=1"; Pfam description=DDE superfamily endonuclease
  misc_feature (142)..(142): Xaa can be any naturally occurring amino acid
  misc_feature (219)..(234): Xaa can be any naturally occurring amino acid
ILFTTNRPGRDWYDRFMRRHPNISLRISQNLTKQRSKVSEEQIRNWFAEISSYLKKDGFLDILLDPSRVYNCDETAFFLSPKGDKGECLTSLIMFNALGQLPPPMVVYAMQRVSKLISSSFPKGWAMGRFENAWMTQETFFXYIANVFIKQLHDNKIQRPIILFVDGHTSHLTLQLSRFCSKNGIVLISLYPNSTHIMQPLDVALFHSLKSTYKKLIQXXXXXXXXXXXXXXXXAPILNEALLKNCHFSKTIQNGFRTCGLVPFNPCYSGSATKFRYRKKKLKKSKKKRKENKAGLINKNK

SEQ ID NO: 30808 - protein, 55 aa, Diabrotica virgifera
  misc_feature: Coding regions on vcDNA: vcDNA=SeqID_10505; Strand=+; Position=3-170
AGRNSPGHPPPPRVLDIHLVCIRSSHQHDIMKPYCRNSISFLSAPRRINPLWLVT

SEQ ID NO: 30809 - protein, 79 aa, Diabrotica virgifera
  misc_feature: Coding regions on vcDNA: vcDNA=SeqID_10506; Strand=+; Position=2-238
  misc_feature (2)..(8): Xaa can be any naturally occurring amino acid
  misc_feature (12)..(67): Xaa can be any naturally occurring amino acid
  misc_feature (70)..(76): Xaa can be any naturally occurring amino acid
NXXXXXXXWNGXXXXXXXXXXXXXXXXXXXXXXXXXXXXXXXXXXXXXXXXXXXXXXXXXXXXXXXXGGXXXXXXXFFL

SEQ ID NO: 30810 - protein, 53 aa, Diabrotica virgifera
  misc_feature: Coding regions on vcDNA: vcDNA=SeqID_10507; Strand=+; Position=2-163
  misc_feature (11)..(17): Xaa can be any naturally occurring amino acid
  misc_feature (20)..(28): Xaa can be any naturally occurring amino acid
GPAPAPRSEAXXXXXXXSVXXXXXXXXXYYCEITLYCYKIKLHFIVPCVVIQY

SEQ ID NO: 30811 - protein, 48 aa, Diabrotica virgifera
  misc_feature: Coding regions on vcDNA: vcDNA=SeqID_10508; Strand=-; Position=1-144
  misc_feature (3)..(3): Xaa can be any naturally occurring amino acid
  misc_feature (5)..(48): Xaa can be any naturally occurring amino acid
RLXKXXXXXXXXXXXXXXXXXXXXXXXXXXXXXXXXXXXXXXXXXXXX

SEQ ID NO: 30812 - protein, 154 aa, Diabrotica virgifera
  misc_feature: Coding regions on vcDNA: vcDNA=SeqID_10509; Strand=+; Position=20-484
  misc_feature (5)..(5): Xaa can be any naturally occurring amino acid
  misc_feature (9)..(70): Xaa can be any naturally occurring amino acid
  misc_feature (72)..(99): Xaa can be any naturally occurring amino acid
  misc_feature (105)..(112): Xaa can be any naturally occurring amino acid
  misc_feature (132)..(142): Xaa can be any naturally occurring amino acid
  misc_feature (148)..(148): Xaa can be any naturally occurring amino acid
FFWYXMLFXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXMERYLXXXXXXXXNIYVYKGIRPNFFTCYLKHXXXXXXXXXXXLSNLMXAVFERG

SEQ ID NO: 30813 - protein, 72 aa, Diabrotica virgifera
  misc_feature: Coding regions on vcDNA: vcDNA=SeqID_10510; Strand=-; Position=2-217
  misc_feature (10)..(34): Xaa can be any naturally occurring amino acid
  misc_feature (40)..(51): Xaa can be any naturally occurring amino acid
  misc_feature (55)..(62): Xaa can be any naturally occurring amino acid
  misc_feature (67)..(72): Xaa can be any naturally occurring amino acid
KISPFFPLGXXXXXXXXXXXXXXXXXXXXXXXXXTLFLNXXXXXXXXXXXXGLKXXXXXXXXMGSSXXXXXX

SEQ ID NO: 30814 - protein, 107 aa, Diabrotica virgifera
  misc_feature: Coding regions on vcDNA: vcDNA=SeqID_10511; Strand=-; Position=264-587
RMDTLRHGLPNITIHERLQYTPLRESAVNKTRNFFHQATRRLLKTRDILARKRMQRIHRDTHKPINHPTRVQPSGCRRQPSSVVSMMVPTGGTYYGTGSTKRILIER

SEQ ID NO: 30815 - protein, 267 aa, Diabrotica virgifera
  misc_feature: Coding regions on vcDNA: vcDNA=SeqID_10512; Strand=+; Position=132-932
  misc_feature: Homolog annotation: Hit_ID=XP_394136.1; Match level="QueryCoverage =100%, HitCoverage=41%, E-value=6e-34, Identity=37%"; Hit description= similar to ENSANGP00000008467 [Apis mellifera]
  misc_feature (257)..(257): Xaa can be any naturally occurring amino acid
MFTSLKNKIREETGSDLSKLTAKITSSTVQKIESLRGRSTQGSTSSLNSIVSSEGVKEDGGIESDDFKKRLMKLEAEFVKKLDHKETEWRELLKDKDKRIQALEKDREEFQSQLGSLKESLRSAEEFNSKILLHKENNEQLENLQCQELAKVKSLVLLRDQEILEKSTALKDANTQLDKLRSEVVRLRRQEEILSDVQDDLEALRHSTSRDLAHLASELSKSEQEKNICQNVVVILRQNNNDEGVDSKSASERNFLXQRLEEAHLHL

SEQ ID NO: 30816 - protein, 194 aa, Diabrotica virgifera
  misc_feature: Coding regions on vcDNA: vcDNA=SeqID_10513; Strand=-; Position=1-582
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(188): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIYLVLS

SEQ ID NO: 30817 - protein, 171 aa, Diabrotica virgifera
  misc_feature: Coding regions on vcDNA: vcDNA=SeqID_10514; Strand=+; Position=1-513
  misc_feature (1)..(170): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXA

SEQ ID NO: 30818 - protein, 107 aa, Diabrotica virgifera
  misc_feature: Coding regions on vcDNA: vcDNA=SeqID_10515; Strand=-; Position=2-325
ELLLRQSTILFRGKAAVLLGPCCDLPHHASPHRLTTRCDAYLFMFTGELQSTVSILITFIITCLSVFSARSLFVRINPPSDKLGPSDFIFVGNLFNFSPIIKQIRGS

SEQ ID NO: 30819 - protein, 265 aa, Diabrotica virgifera
  misc_feature: Coding regions on vcDNA: vcDNA=SeqID_10516; Strand=-; Position=1-795
  misc_feature (3)..(265): Xaa can be any naturally occurring amino acid
KNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30820 - protein, 288 aa, Diabrotica virgifera
  misc_feature: Coding regions on vcDNA: vcDNA=SeqID_10517; Strand=+; Position=3-866
  misc_feature (38)..(44): Xaa can be any naturally occurring amino acid
  misc_feature (177)..(182): Xaa can be any naturally occurring amino acid
  misc_feature (259)..(266): Xaa can be any naturally occurring amino acid
PAHVTIINNNNYHHQVIPPTVHYNSYGPPPVGISITTXXXXXXXSSRYHTTYHYSSQDTGSTALGFFLGWQLGKITRPSYYYHSTSYVNNEYVPRYDHYTVHHYYHNSESVPQEAPIQPNAVVVCAGDSSSICPPGTIPFCTNNGVVMCVVNAIDTSPCSTNKQLKCTTSTISCEGXXXXXXRQKSSTAVAIPCVSTATIPAGVGVRDNSLVVTDPNDSSLITFCVTGLATPTNNEIKSGRKDQSVTQINENFHYTTNXXXXXXXXYYLGHKLQKLLHPRFSFLNMTK

SEQ ID NO: 30821 - protein, 278 aa, Diabrotica virgifera
  misc_feature: Coding regions on vcDNA: vcDNA=SeqID_10518; Strand=-; Position=1-834
  misc_feature (3)..(278): Xaa can be any naturally occurring amino acid
LRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30822 - protein, 134 aa, Diabrotica virgifera
  misc_feature: Coding regions on vcDNA: vcDNA=SeqID_10519; Strand=-; Position=56-460
LNRDILNRGIEETIYSPHNHPVTSAHSFPLFPARSLSMVRIIMFIGSGIVPLWFFPHYPYGHNTLVARRSRCSPSQLTATISIISSRKPNHCTKNHNTVKNFDGLKLKHPTNRQIALKAKEEIAFIDGIVFTFH

SEQ ID NO: 30823 - protein, 120 aa, Diabrotica virgifera
  misc_feature: Coding regions on vcDNA: vcDNA=SeqID_10520; Strand=+; Position=175-534
KKLNSKMSAKLRMRTPSPKTVTFDPSPPTTLERPRKLIFRSRAEWERYLDALLADLQNTVSGSSGIGSNYSGYGQRNVRYSPDSDGHYSKTDSYSVKSGSYGKVPPNSGNRSPSYALNAT

SEQ ID NO: 30824 - protein, 129 aa, Diabrotica virgifera
  misc_feature: Coding regions on vcDNA: vcDNA=SeqID_10521; Strand=+; Position=3-389
  misc_feature (4)..(44): Xaa can be any naturally occurring amino acid
  misc_feature (97)..(103): Xaa can be any naturally occurring amino acid
  misc_feature (106)..(123): Xaa can be any naturally occurring amino acid
FLVXXXXXXXXXXXXXXXXXXXXXXXXXXXXXXXXXXXXXXXXXYPKDTADFFLGRSIEKKRGPPRGWLKVFKLGGPFFFKIWCPLFKFLYGVGVIXXXXXXXRGXXXXXXXXXXXXXXXXXXRGGAHP

SEQ ID NO: 30825 - protein, 35 aa, Diabrotica virgifera
  misc_feature: Coding regions on vcDNA: vcDNA=SeqID_10522; Strand=-; Position=1-105
  misc_feature (1)..(5): Xaa can be any naturally occurring amino acid
  misc_feature (7)..(33): Xaa can be any naturally occurring amino acid
XXXXXLXXXXXXXXXXXXXXXXXXXXXXXXXXXIL

SEQ ID NO: 30826 - protein, 188 aa, Diabrotica virgifera
  misc_feature: Coding regions on vcDNA: vcDNA=SeqID_10523; Strand=+; Position=169-732
  misc_feature (27)..(35): Xaa can be any naturally occurring amino acid
  misc_feature (45)..(176): Xaa can be any naturally occurring amino acid
RAPMKLQFLLYNHHFKYFFCTDLLFVXXXXXXXXXYTPNLFISTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSILISLFNASWN

SEQ ID NO: 30827 - protein, 316 aa, Diabrotica virgifera
  misc_feature: Coding regions on vcDNA: vcDNA=SeqID_10524; Strand=-; Position=1-948
  misc_feature (2)..(316): Xaa can be any naturally occurring amino acid
YXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30828 - protein, 77 aa, Diabrotica virgifera
  misc_feature: Coding regions on vcDNA: vcDNA=SeqID_10525; Strand=-; Position=159-392
QANSGLDWGKGLRSQIQVIAHSLIPTGRRNWLENQNLNKYHFLISAVTFLVKFGLLGHQYGNRSVIKTCDALMRHDR

SEQ ID NO: 30829 - protein, 231 aa, Diabrotica virgifera
  misc_feature: Coding regions on vcDNA: vcDNA=SeqID_10526; Strand=-; Position=2-694
  misc_feature (8)..(15): Xaa can be any naturally occurring amino acid
  misc_feature (28)..(39): Xaa can be any naturally occurring amino acid
  misc_feature (42)..(50): Xaa can be any naturally occurring amino acid
  misc_feature (52)..(231): Xaa can be any naturally occurring amino acid
LKKRINIXXXXXXXXDLSKKYKLSNVNXXXXXXXXXXXXLSXXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30830 - protein, 206 aa, Diabrotica virgifera
  misc_feature: Coding regions on vcDNA: vcDNA=SeqID_10527; Strand=+; Position=295-911
  misc_feature: Homolog annotation: Hit_ID=NP_510543.1; Match level="QueryCoverage =87%, HitCoverage=32%, E-value=1e-25, Identity=37%"; Hit description =reverse transcriptase family member (XQ19) [Caenorhabditis elegans] pir||A89723 protein
  misc_feature (67)..(67): Xaa can be any naturally occurring amino acid
  misc_feature (84)..(84): Xaa can be any naturally occurring amino acid
  misc_feature (121)..(121): Xaa can be any naturally occurring amino acid
  misc_feature (125)..(125): Xaa can be any naturally occurring amino acid
MSTQKYLLPNIESFGIKQVMAQLKNNKAPDLDGILSEILKEGSEIILEELKNPPNECLHRGEVPDDXNESLTIILFKKGDRENXEKNYRPIFLLSQIYKLFMRVITNRLTLKLDNYQLVEXAGFXKDYNTADHLLIVRTLIEKANEYQLNLYIGFVDYEKAFGYIELWAIVTAVNNCRIYSRYRMLFTYMYKKATMKIQIDGNTKD

SEQ ID NO: 30831 - protein, 66 aa, Diabrotica virgifera
  misc_feature: Coding regions on vcDNA: vcDNA=SeqID_10528; Strand=-; Position=2-199
  misc_feature (2)..(13): Xaa can be any naturally occurring amino acid
  misc_feature (21)..(21): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PXXXXXXXXXXXXTNLAHTGXNXXXXXXXXSNXXXXXXXXXXXXXXPTSRSXXXXXXXXXXXXXXV

SEQ ID NO: 30832 - protein, 275 aa, Diabrotica virgifera
  misc_feature: Coding regions on vcDNA: vcDNA=SeqID_10529; Strand=-; Position=1-825
  misc_feature: Homolog annotation: Hit_ID=AAT38797.1; Match level="QueryCoverage =99%, HitCoverage=13%, E-value=9e-33, Identity=30%"; Hit description =putative polyprotein [Solanum demissum]
MVYTGSKKNKNEWCLDTGASEHMCWNQDLFEELIEINYKKQVKVGNGEKLPVKGIGKITLWAFNGKKFIKSTLSDVLFVPDLQFNLFSAGCALDKGYKMFSNNEKCEFYNDKGEIRALATRDNKLYKMLFSQEQNTETFANILISERTPNENLSDGQVQENSCLVDVFLSECNSAKTTESLRVWHCRLAHQNTTYVRNFLRQNNIDFIDEKFVCEQCLTGKQHRIPFKLSESRASEPLQLVHTDVCGPMEEESLGGNRYFLLLKDDYTNYRYAYF

SEQ ID NO: 30833 - protein, 42 aa, Diabrotica virgifera
  misc_feature: Coding regions on vcDNA: vcDNA=SeqID_10530; Strand=-; Position=21-149
ICTSCFSAHTSSPSGLTFSRPSLPVLDQSRSPLLRDLFLIIR

SEQ ID NO: 30834 - protein, 41 aa, Diabrotica virgifera
  misc_feature: Coding regions on vcDNA: vcDNA=SeqID_10531; Strand=-; Position=2-124
  misc_feature (2)..(25): Xaa can be any naturally occurring amino acid
  misc_feature (31)..(40): Xaa can be any naturally occurring amino acid
SXXXXXXXXXXXXXXXXXXXXXXXXHPTPFXXXXXXXXXXI

SEQ ID NO: 30835 - protein, 20 aa, Diabrotica virgifera
  misc_feature: Coding regions on vcDNA: vcDNA=SeqID_10532; Strand=-; Position=1-60
  misc_feature (2)..(20): Xaa can be any naturally occurring amino acid
FXXXXXXXXXXXXXXXXXXX

SEQ ID NO: 30836 - protein, 127 aa, Diabrotica virgifera
  misc_feature: Coding regions on vcDNA: vcDNA=SeqID_10533; Strand=+; Position=403-786
FLHCSRLLSILNFFFLCHSCRRLEIIKVMLTLFTADLKVSLVVQPNHSLSNSATLTFFYGLDSVLSLFFLALYFEVMRIYVLSSGDLNIRVFFVLSVSFICFCIFVLYVLFYRKISGSFDILRIILN

SEQ ID NO: 30837 - protein, 67 aa, Diabrotica virgifera
  misc_feature: Coding regions on vcDNA: vcDNA=SeqID_10534; Strand=+; Position=27-230
QVKKLQYQSLNDVKLPTYLFHNFIPGALRYVPCYRLQITARQIGFCRTCHSNKYGKCIIGCLSANIP

SEQ ID NO: 30838 - protein, 35 aa, Diabrotica virgifera
  misc_feature: Coding regions on vcDNA: vcDNA=SeqID_10535; Strand=-; Position=2-106
  misc_feature (5)..(32): Xaa can be any naturally occurring amino acid
  misc_feature (35)..(35): Xaa can be any naturally occurring amino acid
KNVAXXXXXXXXXXXXXXXXXXXXXXXXXXXXVNX

SEQ ID NO: 30839 - protein, 56 aa, Diabrotica virgifera
  misc_feature: Coding regions on vcDNA: vcDNA=SeqID_10536; Strand=-; Position=545-715
NVKFFPSDGNHYSEIGIWKVEGELISLFLEWVLPKLVEFNPFVQSDKVVTTNLHSE

SEQ ID NO: 30840 - protein, 201 aa, Diabrotica virgifera
  misc_feature: Coding regions on vcDNA: vcDNA=SeqID_10537; Strand=+; Position=44-649
  misc_feature: Homolog annotation: Hit_ID=XP_394986.1; Match level="QueryCoverage =83%, HitCoverage=98%, E-value=2e-34, Identity=44%"; Hit description =similar to RIKEN cDNA 2900091E11 [Apis mellifera]
MCFFIISFLSMEVEFPSIDPNEDLTQILPIQQKRTIAFVNHFIMNTVSHLNNFAQSCESRFMEFDYKIQKIEASLSILESQLSSISGLDNVESKKDNLDHVDNSSQNVVEVELPEIKQQKEEEPTIVVEPDPPQKTQGIAAKDDPRFKKFFKMLQFGVPEPAVKLKMKNEGIDPSILEKPHDVVPGLTEDLIQNESEEKSD

SEQ ID NO: 30841 - protein, 64 aa, Diabrotica virgifera
  misc_feature: Coding regions on vcDNA: vcDNA=SeqID_10538; Strand=-; Position=625-819
  misc_feature (2)..(2): Xaa can be any naturally occurring amino acid
  misc_feature (6)..(13): Xaa can be any naturally occurring amino acid
  misc_feature (15)..(22): Xaa can be any naturally occurring amino acid
IXINYXXXXXXXXSXXXXXXXXDKLNRSTSMKALKYNMRLFGCVRIIKVAVNTRSKIRKSTLHN

SEQ ID NO: 30842 - protein, 76 aa, Diabrotica virgifera
  misc_feature: Coding regions on vcDNA: vcDNA=SeqID_10539; Strand=-; Position=1-228
  misc_feature (1)..(76): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXX

SEQ ID NO: 30843 - protein, 285 aa, Diabrotica virgifera
  misc_feature: Coding regions on vcDNA: vcDNA=SeqID_10540; Strand=+; Position=106 -1038
  misc_feature: Homolog annotation: Hit_ID=AAH73028.1; Match level="QueryCoverage =100%, HitCoverage=87%, E-value=2e-69, Identity=45%"; Hit description= LOC443610 protein [Xenopus laevis]
  misc_feature: Gene Ontology Annotation: Molecular function=molecular_function unknown; Cellular component=extracellular space; Biological process =lipid metabolism
  misc_feature: Pfam annotation: Pfam_ID=UPF0160; Match level="Score=270.2, E-value =3.5e-78, Copies=1"; Pfam description=Uncharacterised protein family (UPF01
  misc_feature (214)..(214): Xaa can be any naturally occurring amino acid
  misc_feature (224)..(224): Xaa can be any naturally occurring amino acid
  misc_feature (245)..(245): Xaa can be any naturally occurring amino acid
  misc_feature (258)..(258): Xaa can be any naturally occurring amino acid
  misc_feature (270)..(270): Xaa can be any naturally occurring amino acid
MATDAKTPRILKRIGTHSGVFHCDEYADAEIIRTRDPKILDECDIVVDVGGEYNPKKHRYDHHQRGFEETISTVRPDLIKNKSIKLSSAGLVYAHFGFEGFVEELDAIDNGVPMFTEGKPKYRINTHLSARIHRLNPEWNSPNPVPSNETFFKAMELVGTEFNERVIDSATVWWPAREIVKKSIESRNQVHENGQIVLLNERCPWKDHLLALEXKDLGISGQIXFVIFHDAGDSWRVQAIPIPPXVLYARVFLHKDWXRAFRDDQLSPIXSGIKKCIFWHANGFL

SEQ ID NO: 30844 - protein, 150 aa, Diabrotica virgifera
  misc_feature: Coding regions on vcDNA: vcDNA=SeqID_10541; Strand=+; Position=494-943
  misc_feature (15)..(23): Xaa can be any naturally occurring amino acid
  misc_feature (44)..(72): Xaa can be any naturally occurring amino acid
  misc_feature (77)..(84): Xaa can be any naturally occurring amino acid
  misc_feature (91)..(107): Xaa can be any naturally occurring amino acid
  misc_feature (109)..(122): Xaa can be any naturally occurring amino acid
  misc_feature (128)..(138): Xaa can be any naturally occurring amino acid
  misc_feature (143)..(150): Xaa can be any naturally occurring amino acid
HKFTLFRLSSDDDIXXXXXXXXXKYVGSREELGNIVLACLLITXXXXXXXXXXXXXXXXXXXXXXXXXXXXXSLVLXXXXXXXXWMKKECXXXXXXXXXXXXXXXXXVXXXXXXXXXXXXXXIKLFQXXXXXXXXXXXLLGGXXXXXXXX

SEQ ID NO: 30845 - protein, 49 aa, Diabrotica virgifera
  misc_feature: Coding regions on vcDNA: vcDNA=SeqID_10542; Strand=+; Position=191-340
IHIISSMQKNISRIRFIKHYHSVNHISKNISSSHELICINSIIIVRLSP

SEQ ID NO: 30846 - protein, 66 aa, Diabrotica virgifera; identical to SEQ ID NO: 26808
  misc_feature: Coding regions on vcDNA: vcDNA=SeqID_10543; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 30847 - protein, 336 aa, Diabrotica virgifera
  misc_feature: Coding regions on vcDNA: vcDNA=SeqID_10544; Strand=-; Position=1-1008
  misc_feature (1)..(335): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXV

SEQ ID NO: 30848 - protein, 76 aa, Diabrotica virgifera
  misc_feature: Coding regions on vcDNA: vcDNA=SeqID_10545; Strand=+; Position=87-317
LLLKKMLRRYQSFERKLNYYYKPSDLDYILCDEWLCWFSVYLTLGDINMENIVASKLDSHMFISATVDEYWQRADK

SEQ ID NO: 30849 - protein, 48 aa, Diabrotica virgifera
  misc_feature: Coding regions on vcDNA: vcDNA=SeqID_10546; Strand=-; Position=65-211
NSRARPISFDLFQPPRLSPYLSSFSLYLSYIAHIHCSMYYGWLLLTHA

SEQ ID NO: 30850 - protein, 66 aa, Diabrotica virgifera
  misc_feature: Coding regions on vcDNA: vcDNA=SeqID_10547; Strand=-; Position=1-198
  misc_feature (2)..(13): Xaa can be any naturally occurring amino acid
  misc_feature (21)..(21): Xaa can be any naturally occurring amino acid
  misc_feature (23)..(30): Xaa can be any naturally occurring amino acid
  misc_feature (33)..(45): Xaa can be any naturally occurring amino acid
  misc_feature (52)..(64): Xaa can be any naturally occurring amino acid
LXXXXXXXXXXXXPTWLTPVXTXXXXXXXXRTXXXXXXXXXXXXXIQHRGRXXXXXXXXXXXXXLL

SEQ ID NO: 30851 - protein, 19 aa, Diabrotica virgifera
  misc_feature: Coding regions on vcDNA: vcDNA=SeqID_10548; Strand=-; Position=1-57
  misc_feature (2)..(17): Xaa can be any naturally occurring amino acid
  misc_feature (19)..(19): Xaa can be any naturally occurring amino acid
TXXXXXXXXXXXXXXXXLX

SEQ ID NO: 30852 - protein, 57 aa, Diabrotica virgifera
  misc_feature: Coding regions on vcDNA: vcDNA=SeqID_10549; Strand=-; Position=795-968
  misc_feature (1)..(1): Xaa can be any naturally occurring amino acid
  misc_feature (11)..(11): Xaa can be any naturally occurring amino acid
  misc_feature (32)..(32): Xaa can be any naturally occurring amino acid
XPLLKECDYSXEMIQIVGDDCIFHHLISYFLXNFYEDIFLRLLFLLRRVISSFNVLT

SEQ ID NO: 30853 - protein, 165 aa, Diabrotica virgifera
  misc_feature: Coding regions on vcDNA: vcDNA=SeqID_10550; Strand=+; Position=134-631
  misc_feature (153)..(158): Xaa can be any naturally occurring amino acid
IRLYKIMKLLGKVLVILLIGYSKMENIDSNKFDPQNIDFDRFDRHKFDIDRFDMPNIDFEEIHKRINDIQENKLNIPEFNFKPYDINQYKPISLDGSNFWEDVPKDPNAYLEYLQEECSNAGHPDILNMNSEIYRQAKICLGSRALSRNDREXXXXXXTHCYQPN

SEQ ID NO: 30854 - protein, 221 aa, Diabrotica virgifera
  misc_feature: Coding regions on vcDNA: vcDNA=SeqID_10551; Strand=+; Position=168-830
  misc_feature: Homolog annotation: Hit_ID=AAH56221.1; Match level="QueryCoverage =71%, HitCoverage=60%, E-value=2e-26, Identity=36%"; Hit description =Zfp583 protein [Mus musculus]
  misc_feature: Gene Ontology Annotation: Molecular function=transcriptional repressor activity; Cellular component=nucleus; Biological process =neuroblast cell fate determination
  misc_feature: Pfam annotation: Pfam_ID=zf-C2H2; Match level="Score=93.4, E-value=6e- 25, Copies=3"; Pfam description=Zinc finger, C2H2 type
MFIGNEVKQEDAELTCKREIANEVDEITEDSLKIEIKEEAVWEDTTDTFDYLDVKKCSIKAEIEPDDGFPCKDVKTDASSLLTNHDRSGGNFNQHMTSTTKVKTEEQHFICIICKKSLSNNDRLEHMCIQTEEKSFACEICTKQFSTKNYLKRHMKAHTDEKPFECEICTKQFSLKAYLRKHMKLHSDEKSFKCEICTKQFPKKRYLETHIRMHSGKKSFE

SEQ ID NO: 30855 - protein, 171 aa, Diabrotica virgifera
  misc_feature: Coding regions on vcDNA: vcDNA=SeqID_10552; Strand=+; Position=128-643
  misc_feature: Homolog annotation: Hit_ID=XP_310846.1; Match level="QueryCoverage =78%, HitCoverage=83%, E-value=3e-16, Identity=36%"; Hit description =ENSANGP00000013007 [Anopheles gambiae]
  misc_feature: Pfam annotation: Pfam_ID=Destabilase; Match level="Score=20.5, E -value=4.2e-08, Copies=1"; Pfam description=Destabilase
MSAMKFVVLAFCLAFMALTAVEGQQTNWLKHDLYDCVRCLCHARSGCWIRQNCARYSISEDYWKKGGSLTVSPNEKSTDPSAYSNCMKDENCIVGTIIQYTGRFGEDMDCNCDGVFDCKDRAAIHLMGASCENPKFGGTFARRFNECSNMVGTKNMLSQEGNDKCTVPTVF

SEQ ID NO: 30856 - protein, 64 aa, Diabrotica virgifera
  misc_feature: Coding regions on vcDNA: vcDNA=SeqID_10553; Strand=+; Position=3-197
  misc_feature (4)..(15): Xaa can be any naturally occurring amino acid
  misc_feature (22)..(29): Xaa can be any naturally occurring amino acid
  misc_feature (42)..(48): Xaa can be any naturally occurring amino acid
YQGXXXXXXXXXXXXYKEELMXXXXXXXXLLELHLFIAMCMXXXXXXXPRIIKMRVIYYVLTLY

SEQ ID NO: 30857 - protein, 66 aa, Diabrotica virgifera; identical to SEQ ID NO: 26808
  misc_feature: Coding regions on vcDNA: vcDNA=SeqID_10554; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 30858 - protein, 269 aa, Diabrotica virgifera
  misc_feature: Coding regions on vcDNA: vcDNA=SeqID_10555; Strand=-; Position=1-807
  misc_feature (4)..(11): Xaa can be any naturally occurring amino acid
  misc_feature (17)..(249): Xaa can be any naturally occurring amino acid
  misc_feature (256)..(269): Xaa can be any naturally occurring amino acid
LKNXXXXXXXXYGGFSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSQGSKYXXXXXXXXXXXXXX

SEQ ID NO: 30859 - protein, 314 aa, Diabrotica virgifera
  misc_feature: Coding regions on vcDNA: vcDNA=SeqID_10556; Strand=+; Position=2-943
  misc_feature (294)..(294): Xaa can be any naturally occurring amino acid
  misc_feature (306)..(306): Xaa can be any naturally occurring amino acid
PRAQDSFAQPTSDKIPNAKTNLITQETCKENLENSPEPMVDVKVEQKMAVPSIDRELSECVMESMYIIMSRVSSFKTKLFVEKVTKERTRQIMADYINEIVAQKILFEKPGWKPTSANCTRKSLQWRCAQEIIQQLVYNTTIVRVQLFRFIGVDKFVRLMKQEIDKYLKIPNIHEWIFPVDDKPREIKINLNIKHKRPNYSKKYDSLFGPDIKDYCHLILTPEEINSLDTTPLQSANISTSFKPTDTDRENTSPSNPEKLSTDTECIPSSSSLSPVQGNQTKSKDLVNNKSDAXEENTGLAKQSYXKSVVIKIP

SEQ ID NO: 30860 - protein, 101 aa, Diabrotica virgifera
  misc_feature: Coding regions on vcDNA: vcDNA=SeqID_10557; Strand=-; Position=32-337
YFTTRISLLFFYLVSIRLYTTLHFFLMSSLPFPSLSKFPVIFLSTLISAVSSNLCVVTVSGFVSDAYIIIIEILDFISVLICRFRHIVLLRHPASLFAFCS

SEQ ID NO: 30861 - protein, 43 aa, Diabrotica virgifera
  misc_feature: Coding regions on vcDNA: vcDNA=SeqID_10558; Strand=+; Position=76-204
  misc_feature (8)..(13): Xaa can be any naturally occurring amino acid
  misc_feature (32)..(41): Xaa can be any naturally occurring amino acid
LVKQLYYXXXXXXKILHEFEFKPVGSQVGFNXXXXXXXXXXKA

SEQ ID NO: 30862 - protein, 158 aa, Diabrotica virgifera
  misc_feature: Coding regions on vcDNA: vcDNA=SeqID_10559; Strand=+; Position=439-912
  misc_feature (24)..(33): Xaa can be any naturally occurring amino acid
  misc_feature (35)..(141): Xaa can be any naturally occurring amino acid
  misc_feature (144)..(157): Xaa can be any naturally occurring amino acid
SIVIYYHYYCLYIIYDNMNLHYLXXXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFFXXXXXXXXXXXXXXG

SEQ ID NO: 30863 - protein, 194 aa, Diabrotica virgifera
  misc_feature: Coding regions on vcDNA: vcDNA=SeqID_10560; Strand=+; Position=120-701
  misc_feature: Homolog annotation: Hit_ID=XP_543768.1; Match level="QueryCoverage =98%, HitCoverage=30%, E-value=2e-35, Identity=42%"; Hit description =PREDICTED: similar to RecQ protein-like isoform 1 [Canis familiaris]
  misc_feature: Gene Ontology Annotation: Molecular function=ATP dependent DNA helicase activity; Cellular component=nucleus; Biological process =DNA repair
  misc_feature: Pfam annotation: Pfam_ID=DEAD; Match level="Score=-9.3, E-value =0.00012, Copies=1"; Pfam description=DEAD/DEAH box helicase
  misc_feature (157)..(165): Xaa can be any naturally occurring amino acid
MDEEEYLTRQAHLEKNIRELRLKQKEIAHQIAILTAEKEELQKEHYVSKIKTQANSSKWIEKEFPWTRQVKEILKNTFKFDNFRLKQLAAINATLSKKDVLLLMPTGGGKSLVYHLPALVNNNVTLVVSPLISLIEDQLMALQQLGINANTLNSGSXXXXXXXXXTDMDSYNPKLRLFVCNSKMGTKSKTFMTH

SEQ ID NO: 30864 - protein, 63 aa, Diabrotica virgifera
  misc_feature: Coding regions on vcDNA: vcDNA=SeqID_10561; Strand=+; Position=72-263
IQVYFLDNPTYVRTYHKSTVLFKIVCLFSTFFCYPDSGITEQNISSPLYFYLLLCLVIGIHLL

SEQ ID NO: 30865 - protein, 145 aa, Diabrotica virgifera
  misc_feature: Coding regions on vcDNA: vcDNA=SeqID_10562; Strand=+; Position=35-472
  misc_feature: Homolog annotation: Hit_ID=XP_319027.1; Match level="QueryCoverage =70%, HitCoverage=15%, E-value=5e-24, Identity=55%"; Hit description =ENSANGP00000013312 [Anopheles gambiae]
  misc_feature: Gene Ontology Annotation: Molecular function=zinc ion binding; Cellular component=cellular_component unknown; Biological process =lipid metabolism
HHYSIFNSLARVVAQTCIILCLLDLKFSIALFRLTSHWNNSLYKGFTMLVERKIISRLVSPQMQDFDAYTGISDLKEAIEVLGADSPLTNLIVDLKGVHPDEAFSTVPYEKGHTFLRYLEKTVGGPDKVEPFLRSYFDTFKYKIN

SEQ ID NO: 30866 - protein, 64 aa, Diabrotica virgifera
  misc_feature: Coding regions on vcDNA: vcDNA=SeqID_10563; Strand=+; Position=17-211
  misc_feature (4)..(11): Xaa can be any naturally occurring amino acid
DLNXXXXXXXXFKIPISIETLPFLTYMIMCILYQLFSYPIDSTLFRLRSDEGITITRLYIYENM

SEQ ID NO: 30867 - protein, 89 aa, Diabrotica virgifera
  misc_feature: Coding regions on vcDNA: vcDNA=SeqID_10564; Strand=-; Position=104-373
  misc_feature: Homolog annotation: Hit_ID=EAL27073.1; Match level="QueryCoverage =93%, HitCoverage=41%, E-value=2e-24, Identity=62%"; Hit description =GA11487-PA [Drosophila pseudoobscura]
GAPPRYKKVIDETKAMQEQIQNELKLEPVEKEIVVLYEGEKNDKPAEFFEGKRIVEMNKPRPQWFSKNLLQETTQKNATTKEVKPSDLG

SEQ ID NO: 30868 - protein, 310 aa, Diabrotica virgifera
  misc_feature: Coding regions on vcDNA: vcDNA=SeqID_10565; Strand=-; Position=0-929
  misc_feature (2)..(308): Xaa can be any naturally occurring amino acid
TXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGR

SEQ ID NO: 30869 - protein, 94 aa, Diabrotica virgifera
  misc_feature: Coding regions on vcDNA: vcDNA=SeqID_10566; Strand=-; Position=261-545
  misc_feature (55)..(60): Xaa can be any naturally occurring amino acid
IRSGNYHMVTNIFKRPSRVSHQYHKITSISTDKHPSIQGERGETHQTFRLYNTRXXXXXXLLLFDLHLFPRYGVLFFLQTDDSLIAPKPVEVCK

SEQ ID NO: 30870 - protein, 62 aa, Diabrotica virgifera
  misc_feature: Coding regions on vcDNA: vcDNA=SeqID_10567; Strand=+; Position=2-190
KFNYYIQLQKKFYIYRLRILTLGIHAHCNVIIVIYSVTSISRINRDRGLYGLSKIRVSRRLW

SEQ ID NO: 30871 - protein, 126 aa, Diabrotica virgifera
  misc_feature: Coding regions on vcDNA: vcDNA=SeqID_10568; Strand=-; Position=186-566
  misc_feature (102)..(111): Xaa can be any naturally occurring amino acid
AAVCQTLSSLPFLSLIKMTSALYDHLRRGECHFFNLRIHYHNYRIEKDSAAILFLNFYPLIRSYSSLEPDFSPLISLSHLDSVGILNHLVHIGHTMLTFIVXXXXXXXXXXSWNVSDFSHTSNHQI

SEQ ID NO: 30872 - protein, 31 aa, Diabrotica virgifera
  misc_feature: Coding regions on vcDNA: vcDNA=SeqID_10569; Strand=-; Position=0-92
  misc_feature (2)..(24): Xaa can be any naturally occurring amino acid
RXXXXXXXXXXXXXXXXXXXXXXXSSNPFIP

SEQ ID NO: 30873 - protein, 157 aa, Diabrotica virgifera
  misc_feature: Coding regions on vcDNA: vcDNA=SeqID_10570; Strand=+; Position=131-601
  misc_feature: Homolog annotation: Hit_ID=LUFF9; Match level="QueryCoverage=85%, HitCoverage=45%, E-value=2e-20, Identity=42%"; Hit description =annexin IX - fruit fly (Drosophila melanogaster) (fragment) gb|AAA28370.1| annexin IX
  misc_feature: Pfam annotation: Pfam_ID=Annexin; Match level="Score=-0.9, E-value =0.043, Copies=1"; Pfam description=Annexin
  misc_feature (47)..(47): Xaa can be any naturally occurring amino acid
  misc_feature (72)..(72): Xaa can be any naturally occurring amino acid
  misc_feature (89)..(89): Xaa can be any naturally occurring amino acid
  misc_feature (116)..(116): Xaa can be any naturally occurring amino acid
MMNVMIRFGSDNKSVFQSQDLKCFIQHIYIIKYFYISYIKYLDCKLXSKLWDKFLDVMETLMTPLPLLYAMXLHNAVYEMCTDDRNYHXILCSLSIYGIRAVTLIIEQLYIKPLYXRLKGDTPRHFLQLCVSLVPAIIYYKRCVCELLDLNDREILI

SEQ ID NO: 30874 - protein, 197 aa, Diabrotica virgifera
  misc_feature: Coding regions on vcDNA: vcDNA=SeqID_10571; Strand=+; Position=329-919
  misc_feature (5)..(11): Xaa can be any naturally occurring amino acid
  misc_feature (21)..(159): Xaa can be any naturally occurring amino acid
  misc_feature (167)..(197): Xaa can be any naturally occurring amino acid
YYRMXXXXXXXGGGYKETFIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEKSLDFFXXXXXXXXXXXXXXXXXXXXXXXXXXXXXXX

SEQ ID NO: 30875 - protein, 101 aa, Diabrotica virgifera; identical to SEQ ID NO: 29675
  misc_feature: Coding regions on vcDNA: vcDNA=SeqID_10572; Strand=-; Position=159-464
  misc_feature (2)..(20): Xaa can be any naturally occurring amino acid
  misc_feature (23)..(29): Xaa can be any naturally occurring amino acid
  misc_feature (35)..(56): Xaa can be any naturally occurring amino acid
  misc_feature (58)..(82): Xaa can be any naturally occurring amino acid

SEQ ID NO: 30876 - protein, 61 aa, Diabrotica virgifera
  misc_feature: Coding regions on vcDNA: vcDNA=SeqID_10573; Strand=+; Position=1-186
  misc_feature (29)..(38): Xaa can be any naturally occurring amino acid
ILWRITFFRCLYNRIDINRFQVDKTYCIXXXXXXXXXXKHLVGQGILSERLYPHYFRINNR

SEQ ID NO: 30877 - protein, 66 aa, Diabrotica virgifera
  misc_feature: Coding regions on vcDNA: vcDNA=SeqID_10574; Strand=-; Position=1-198
  misc_feature (3)..(12): Xaa can be any naturally occurring amino acid
  misc_feature (15)..(15): Xaa can be any naturally occurring amino acid
  misc_feature (23)..(30): Xaa can be any naturally occurring amino acid
  misc_feature (33)..(40): Xaa can be any naturally occurring amino acid
  misc_feature (52)..(64): Xaa can be any naturally occurring amino acid
YLXXXXXXXXXXRNXPGSHRLNXXXXXXXXSTXXXXXXXXPIINLIHHRGRXXXXXXXXXXXXXLL

SEQ ID NO: 30878 - protein, 74 aa, Diabrotica virgifera
  misc_feature: Coding regions on vcDNA: vcDNA=SeqID_10575; Strand=+; Position=50-274
KLRMILCRYSNHFISVSLKTTQNQQQCWENTPKNYRGTLWYKYKQIQCLSPSNHIGVINVKVLECPLSFYPLTL

SEQ ID NO: 30879 - protein, 26 aa, Diabrotica virgifera
  misc_feature: Coding regions on vcDNA: vcDNA=SeqID_10576; Strand=-; Position=0-77
CSLFLVHKHLLSMAIIVISGLQMIST

SEQ ID NO: 30880 - protein, 44 aa, Diabrotica virgifera
  misc_feature: Coding regions on vcDNA: vcDNA=SeqID_10577; Strand=-; Position=339-473
QTRCKIFKLLSTLIHNNTVSYQSTSGITSKLYLYSLIIGVDTVR

SEQ ID NO: 30881 - protein, 250 aa, Diabrotica virgifera
  misc_feature: Coding regions on vcDNA: vcDNA=SeqID_10578; Strand=-; Position=2-751
  misc_feature (3)..(12): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(249): Xaa can be any naturally occurring amino acid
AFXXXXXXXXXXETNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXV

SEQ ID NO: 30882 - protein, 294 aa, Diabrotica virgifera
  misc_feature: Coding regions on vcDNA: vcDNA=SeqID_10579; Strand=+; Position=2-882
  misc_feature: Homolog annotation: Hit_ID=XP_319893.1; Match level="QueryCoverage =98%, HitCoverage=57%, E-value=1e-146, Identity=89%"; Hit description= ENSANGP00000010638 [Anopheles gambiae]
  misc_feature: Gene Ontology Annotation: Molecular function=RNA helicase activity; Cellular component=cytoplasm; Biological process=anti-apoptosis
  misc_feature: Pfam annotation: Pfam_ID=DEAD; Match level="Score=205.9, E-value=7.7e- 59, Copies=1"; Pfam description=DEAD/DEAH box helicase
  misc_feature (273)..(273): Xaa can be any naturally occurring amino acid
RSGRIQTSDVTDTRGNEFEEFCLKRELLMGIFEKGWEKPSPIQEASIPIALSGKDVLARAKNGTGKTGAYSIPVLEQIDPKKDCIQALIIVPTRELALQTSQICIELAKYLEVRVMVTTGGTNLRDDIMRIYQKVQVIIATPGRILDLMEKGVAVMDQCKILVLDEADKLLSQDFKGMLDTVIKNLPQERQILLFSATFPLTVEQFMRKHLRDPYEINLMEELTLKGVTQYYAFVQERQKVHCLNTLFSKLQINQSIIFCNSTQRVELLAKKXTELGYSCYYIHAKMAQAHRNR

SEQ ID NO: 30883 - protein, 208 aa, Diabrotica virgifera
  misc_feature: Coding regions on vcDNA: vcDNA=SeqID_10580; Strand=+; Position=124-750
  misc_feature: Homolog annotation: Hit_ID=CAD38261.1; Match level="QueryCoverage =63%, HitCoverage=60%, E-value=2e-12, Identity=35%"; Hit description =hypothetical protein [Plasmodium falciparum]
  misc_feature (168)..(168): Xaa can be any naturally occurring amino acid
MVFSLLYYNRRFFFIIPYTIILKSKIDDPIFPLWTTFFTRIQSTKKNLCGCFPKTLLEKLFPETVNLPCDICNSHGFIHFEEDIANLRTNLTFMVKEELKRNLEIKLNTTKNDKISACVPSLTGHNIEGNIENNIESNIERNIESNLESNIESNIESNIESNYESFIXSNIDNEFFQFFKEFDYIYKLEPNEHSVEFQRIQQRSATYK

SEQ ID NO: 30884 - protein, 241 aa, Diabrotica virgifera
  misc_feature: Coding regions on vcDNA: vcDNA=SeqID_10581; Strand=+; Position=217-942
  misc_feature: Homolog annotation: Hit_ID=XP_218638.2; Match level="QueryCoverage =71%, HitCoverage=37%, E-value=1e-25, Identity=35%"; Hit description =similar to RIKEN cDNA 4933405K07 [Rattus norvegicus]
  misc_feature: Gene Ontology Annotation: Molecular function=protein binding; Cellular component=nucleus; Biological process=photoreceptor fate commitment (sensu Drosophila)
  misc_feature: Pfam annotation: Pfam_ID=zf-C2H2; Match level="Score=58.8, E-value =1.6e-14, Copies=2"; Pfam description=Zinc finger, C2H2 type
  misc_feature (108)..(114): Xaa can be any naturally occurring amino acid
  misc_feature (129)..(142): Xaa can be any naturally occurring amino acid
  misc_feature (188)..(197): Xaa can be any naturally occurring amino acid
  misc_feature (224)..(224): Xaa can be any naturally occurring amino acid
  misc_feature (227)..(227): Xaa can be any naturally occurring amino acid
METKQEASGKTCKIETDIETYDGSLDVFKIEITEEPKRECAYDAFDYVDEVEDEYKLTLFEERKKSEEGCSQEENRMQIMETLHSSDKGKYTGQQVEVVATVQRRYNXXXXXXXFTHISTLKNHLRTHXXXXXXXXXXXXXXFSQAGTLKKHLRVHTGEKSYMCEICLKQFIQAGDLKKHLRVHTGEXXXXXXXXXXQFSQGHLKTHLRVHTGEKPYKCDICFXAFXSKSTFENHLRMHTG

SEQ ID NO: 30885 - protein, 328 aa, Diabrotica virgifera
  misc_feature: Coding regions on vcDNA: vcDNA=SeqID_10582; Strand=+; Position=1-987
  misc_feature (3)..(277): Xaa can be any naturally occurring amino acid
  misc_feature (281)..(304): Xaa can be any naturally occurring amino acid
  misc_feature (306)..(307): Xaa can be any naturally occurring amino acid
  misc_feature (310)..(310): Xaa can be any naturally occurring amino acid
  misc_feature (315)..(316): Xaa can be any naturally occurring amino acid
  misc_feature (323)..(323): Xaa can be any naturally occurring amino acid
SIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNYLXXXXXXXXXXXXXXXXXXXXXXXXIXXDIXNNYLXXYSVFLIXRVNRL

SEQ ID NO: 30886 - protein, 42 aa, Diabrotica virgifera
  misc_feature: Coding regions on vcDNA: vcDNA=SeqID_10583; Strand=+; Position=74-199
  misc_feature (12)..(19): Xaa can be any naturally occurring amino acid
  misc_feature (31)..(38): Xaa can be any naturally occurring amino acid
LGSSYIIKSVRXXXXXXXXLNRWRPGWVSIXXXXXXXXYKGT

SEQ ID NO: 30887 - protein, 61 aa, Diabrotica virgifera
  misc_feature: Coding regions on vcDNA: vcDNA=SeqID_10584; Strand=-; Position=264-449
MEAFIISLEEFRWCEWVIVVISSISIHIFSGLNILQAFGDSKLKVVNYSASYALVVLYVQL

SEQ ID NO: 30888 - protein, 84 aa, Diabrotica virgifera
  misc_feature: Coding regions on vcDNA: vcDNA=SeqID_10585; Strand=+; Position=2-256
  misc_feature (6)..(12): Xaa can be any naturally occurring amino acid
  misc_feature (54)..(60): Xaa can be any naturally occurring amino acid
VTVFGXXXXXXXERTRTDTQCMSCIHQMTILGTLVPVQQIDANPRTANSPLLRXXXXXXXKQLMHVTNYVLQKGHNTYKRRYLG

SEQ ID NO: 30889 - protein, 122 aa, Diabrotica virgifera
  misc_feature: Coding regions on vcDNA: vcDNA=SeqID_10586; Strand=+; Position=826 -1191
  misc_feature (3)..(4): Xaa can be any naturally occurring amino acid
  misc_feature (36)..(43): Xaa can be any naturally occurring amino acid
  misc_feature (65)..(73): Xaa can be any naturally occurring amino acid
  misc_feature (75)..(82): Xaa can be any naturally occurring amino acid
  misc_feature (89)..(99): Xaa can be any naturally occurring amino acid
  misc_feature (107)..(117): Xaa can be any naturally occurring amino acid
PVXXVSARPQLMPKNHRPSRGNFKGWGPKFLYPGAXXXXXXXXSKFYSPPHQRPQKRGYWLQYPXXXXXXXXXFXXXXXXXXKWKVFCXXXXXXXXXXXGATFCKGXXXXXXXXXXXIFKGV

SEQ ID NO: 30890 - protein, 235 aa, Diabrotica virgifera
  misc_feature: Coding regions on vcDNA: vcDNA=SeqID_10587; Strand=+; Position=224-928
  misc_feature (166)..(166): Xaa can be any naturally occurring amino acid
MAYKYFGVIPIFSNEDLQKALSSQLERKFIKYLSEIQISMNKIAENNEKEKKITERYIVRGMGVFSGEQYKMAEFYVYLDENCDDDNESNIIIQIRGPFGSFGEAISPKLINRKRKFTRKIKSRRRSSIKLIENLQSFQWNFSRSQKKVPSEEIDVEATLENDRIXVCYIPKNYGMYEINMIAGGELIKGCPFNVHIFVNEKNESEVNFKSLRHSRTVRKVIDSSEEKMSSTISQ

SEQ ID NO: 30891 - protein, 147 aa, Diabrotica virgifera
  misc_feature: Coding regions on vcDNA: vcDNA=SeqID_10588; Strand=+; Position=2-445
  misc_feature: Homolog annotation: Hit_ID=XP_315923.1; Match level="QueryCoverage =100%, HitCoverage=23%, E-value=1e-69, Identity=80%"; Hit description= ENSANGP00000013487 [Anopheles gambiae]
  misc_feature: Gene Ontology Annotation: Molecular function=electron acceptor activity; Cellular component=mitochondrial inner membrane; Biological process=NADH catabolism
  misc_feature: Pfam annotation: Pfam_ID=ETF_QO; Match level="Score=357.6, E-value =1.7e-104, Copies=1"; Pfam description=Electron transfer flavoprotein- ubiquin
HSGISIALGGREPWTLKHGDPDNKRLKPAKECKPIEYPKPDGKISFDLLTSVALTGTNHEGDQPAHLTLLNDDVPVNVNLNTYDGPEGRFCPAGVYEYVPLESGDGMRLQINAQNCIHCKTCDIKDPTQNINWVVPEGGGGPAYNGM

SEQ ID NO: 30892 - protein, 66 aa, Diabrotica virgifera; identical to SEQ ID NO: 26808
  misc_feature: Coding regions on vcDNA: vcDNA=SeqID_10589; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 30893 - protein, 178 aa, Diabrotica virgifera
  misc_feature: Coding regions on vcDNA: vcDNA=SeqID_10590; Strand=-; Position=72-608
  misc_feature: Homolog annotation: Hit_ID=CAH04348.1; Match level="QueryCoverage =26%, HitCoverage=30%, E-value=1e-20, Identity=93%"; Hit description =ubiquitin/S27Ae ribosomal protein [Biphyllus lunatus] emb|CAH04347.1| ubiquitin/S27Ae ribosomal protein [C
  misc_feature: Pfam annotation: Pfam_ID=Ribosomal_S27; Match level="Score=86.4, E -value=7.4e-23, Copies=1"; Pfam description=Ribosomal protein S27a
LQDIRRCRGENGKCSEESESKCTNTNWGPWSSCSVSCGKGVKRRLRLPSENDKDNDEKGEDEEDSCSTSEIVKCHIPCNDRESLIVEQGPDGRVVNCKTTNWSIWSKCDTRGSPCGKGSKKRYRQITRHPENGKIHRLRRECPAEQCGAGVFMAAMEDRHYCGKCGYTLVFSKPGDEK

SEQ ID NO: 30894 - protein, 338 aa, Diabrotica virgifera
  misc_feature: Coding regions on vcDNA: vcDNA=SeqID_10591; Strand=+; Position=55-1068
  misc_feature: Homolog annotation: Hit_ID=EAL40808.1; Match level="QueryCoverage =86%, HitCoverage=90%, E-value=1e-23, Identity=26%"; Hit description =ENSANGP00000028148 [Anopheles gambiae str. PEST] ref|XP_563202.1| ENSANGP00000028148 [Anopheles gambiae st
  misc_feature: Gene Ontology Annotation: Molecular function=DNA binding; Cellular component=nucleus; Biological process=negative regulation of transcription from Pol II promoter
  misc_feature: Pfam annotation: Pfam_ID=zf-C2H2; Match level="Score=95.1, E-value =1.8e-25, Copies=5"; Pfam description=Zinc finger, C2H2 type
  misc_feature (13)..(20): Xaa can be any naturally occurring amino acid
  misc_feature (163)..(171): Xaa can be any naturally occurring amino acid
  misc_feature (228)..(228): Xaa can be any naturally occurring amino acid
  misc_feature (245)..(246): Xaa can be any naturally occurring amino acid
MNLTCRICLKISXXXXXXXXLIIHKDNTSAVEFIRKMTDLKLLYSDTLPSNICSECTQAVFTAFDFVEICLASDARLRTQETRRMLREIEAEALELEDEDPLKCDTPSELEHCSKQDGLVKTGKSEERSQIVQEKVNPLPKELQFTTARIKDKYKCDVCKKKXXXXXXXXXHKRIHEDNAFKCMTCSLSFSRKLNLKAHLTTHLENKDKKFECKECNKFFVFEYLLKXHELRHSNVKPFPCTSCXXGCLTAESLKRHMRTHDKNYTKCYTCYVCNKSFANPSFFSRTHEKSHWKRKHPYVTGGGERVFNKRGGLSFSPKNPPREKNPFLCKPVSLCFS

SEQ ID NO: 30895 - protein, 98 aa, Diabrotica virgifera
  misc_feature: Coding regions on vcDNA: vcDNA=SeqID_10592; Strand=+; Position=3-299
INKLSRYNKVWVIQFDHSFRRFSKFILSFWQIFTKIKRLKRELCLFYADRNLKNGNLQEIVIKLQPIKDIVTEAYNLLCLIPTIPSNTVSVEREVFRA

SEQ ID NO: 30896 - protein, 123 aa, Diabrotica virgifera
  misc_feature: Coding regions on vcDNA: vcDNA=SeqID_10593; Strand=+; Position=1-372
  misc_feature: Homolog annotation: Hit_ID=XP_321957.1; Match level="QueryCoverage =95%, HitCoverage=7%, E-value=3e-43, Identity=66%"; Hit description =ENSANGP00000013922 [Anopheles gambiae]
  misc_feature: Gene Ontology Annotation: Molecular function=4-alpha -glucanotransferase activity; Cellular component=cellular_component unknown; Biological process=glycogen catabolism
EDWAYKGDYDNSNQSEDPSVSHGFNYHQGPEWVWPIGFFLRAKLIFAAQNGALRETVASTKLILSKHFVELQTSDWRGLPELTNKDGAYCNDSSRTQAWSMSCVLEVLHDLKKIESSIDLLGN

SEQ ID NO: 30897 - protein, 105 aa, Diabrotica virgifera
  misc_feature: Coding regions on vcDNA: vcDNA=SeqID_10594; Strand=+; Position=10-327
  misc_feature (3)..(34): Xaa can be any naturally occurring amino acid
  misc_feature (43)..(80): Xaa can be any naturally occurring amino acid
  misc_feature (85)..(94): Xaa can be any naturally occurring amino acid
NDXXXXXXXXXXXXXXXXXXXXXXXXXXXXXXXXLNFRILVAXXXXXXXXXXXXXXXXXXXXXXXXXXXXXXXXXXXXXXFQLLXXXXXXXXXXVHCIFSKLISA

SEQ ID NO: 30898 - protein, 149 aa, Diabrotica virgifera
  misc_feature: Coding regions on vcDNA: vcDNA=SeqID_10595; Strand=-; Position=50-499
  misc_feature: Homolog annotation: Hit_ID=XP_316970.1; Match level="QueryCoverage =99%, HitCoverage=98%, E-value=1e-64, Identity=76%"; Hit description =ENSANGP00000019353 [Anopheles gambiae]
MEQFFTLPFTILEIPQMRIKKPSWVKQPSAMTVFSIVLVSYFLVTGGIIYDVIVEPPSVGSTTDEHGHSRPVAFMPYRVNGQYIMEGLASSFLFSLGGLGFIVLDHIHTTSTPKLNRLLLTTVGFICVLVSFFTTWIFMRMKLPGYLQS

SEQ ID NO: 30899 - protein, 264 aa, Diabrotica virgifera
  misc_feature: Coding regions on vcDNA: vcDNA=SeqID_10596; Strand=+; Position=19-810
  misc_feature (221)..(229): Xaa can be any naturally occurring amino acid
  misc_feature (237)..(246): Xaa can be any naturally occurring amino acid
HNRNVNTVLLNFVIIINMGDIEARREARRKKILQNSESRLQRITGVENKSKIEIEGISSSPDQFQPDAVATEAIPRTIHTTENHTFFNNVDEPTNFNIQTNNFNNDVQTIFYNTRINEDTSVAQIVPPPQTNSRHLYILLIPILWSLLIAVCDIINVDISVFYINKIFLPLIAFEIHDFYFSPDIPVSSTVLSSILLLSGRPYSRKLNIFIQYFMRLVQDXXXXXXXXXVSRLCMIXXXXXXXXXXRIKEYCGYLYYNKEIVFT

SEQ ID NO: 30900 - protein, 252 aa, Diabrotica virgifera
  misc_feature: Coding regions on vcDNA: vcDNA=SeqID_10597; Strand=+; Position=129-887
  misc_feature: Homolog annotation: Hit_ID=XP_391872.1; Match level="QueryCoverage =67%, HitCoverage=67%, E-value=6e-10, Identity=26%"; Hit description =similar to ENSANGP00000017475 [Apis mellifera]
  misc_feature: Pfam annotation: Pfam_ID=DUF233; Match level="Score=-19.1, E-value =0.077, Copies=1"; Pfam description=Odorant binding protein
  misc_feature (124)..(130): Xaa can be any naturally occurring amino acid
  misc_feature (187)..(187): Xaa can be any naturally occurring amino acid
  misc_feature (200)..(200): Xaa can be any naturally occurring amino acid
  misc_feature (225)..(225): Xaa can be any naturally occurring amino acid
  misc_feature (238)..(238): Xaa can be any naturally occurring amino acid
MSRTYALFVCLFAGFLLVDTQFNVDIQEPKLTTFLNRITNTTFDLIKSGISVFGQTIENIITTFSKIIELIRDQLIKGVPELSIPVLDPLHVNKIEFDVRHEAAILKGKAEDITIRQISKFIVXXXXXXXLGKLRFRLDLNLTFPSIKVNGTYQVNGLIGQTFRIFGNGPFKLNIIYLKVATTTILXFNLPGQLQVERIXINPRIRKLENNFENMMNDPDTGALXHKAISGLAPEALXILWPELKKPIEIHF

SEQ ID NO: 30901 - protein, 74 aa, Diabrotica virgifera
  misc_feature: Coding regions on vcDNA: vcDNA=SeqID_10598; Strand=-; Position=1-222
  misc_feature (3)..(40): Xaa can be any naturally occurring amino acid
  misc_feature (43)..(72): Xaa can be any naturally occurring amino acid
VSXXXXXXXXXXXXXXXXXXXXXXXXXXXXXXXXXXXXXXEVXXXXXXXXXXXXXXXXXXXXXXXXXXXXXXEK

SEQ ID NO: 30902 - protein, 86 aa, Diabrotica virgifera
  misc_feature: Coding regions on vcDNA: vcDNA=SeqID_10599; Strand=+; Position=3-263
  misc_feature (2)..(51): Xaa can be any naturally occurring amino acid
RXXXXXXXXXXXXXXXXXXXXXXXXXXXXXXXXXXXXXXXXXXXXXXXXXXIITLGIRVFLLESQSKIRCATPGWIKFIFGEQLFF

SEQ ID NO: 30903 - protein, 61 aa, Diabrotica virgifera
  misc_feature: Coding regions on vcDNA: vcDNA=SeqID_10600; Strand=-; Position=1-183
  misc_feature (4)..(60): Xaa can be any naturally occurring amino acid
KKLXXXXXXXXXXXXXXXXXXXXXXXXXXXXXXXXXXXXXXXXXXXXXXXXXXXXXXXXXK

SEQ ID NO: 30904 - protein, 55 aa, Diabrotica virgifera
  misc_feature: Coding regions on vcDNA: vcDNA=SeqID_10601; Strand=-; Position=29-196
QAICSSHSIADNKNRIDICTGPVLRVNNKNSFLGSTLLCSKGRLIGIYGHNEGGG

SEQ ID NO: 30905 - protein, 251 aa, Diabrotica virgifera
  misc_feature: Coding regions on vcDNA: vcDNA=SeqID_10602; Strand=-; Position=1-753
  misc_feature (3)..(3): Xaa can be any naturally occurring amino acid
  misc_feature (9)..(20): Xaa can be any naturally occurring amino acid
  misc_feature (24)..(24): Xaa can be any naturally occurring amino acid
  misc_feature (31)..(54): Xaa can be any naturally occurring amino acid
  misc_feature (57)..(194): Xaa can be any naturally occurring amino acid
  misc_feature (197)..(234): Xaa can be any naturally occurring amino acid
  misc_feature (237)..(251): Xaa can be any naturally occurring amino acid
LVXKKLKLXXXXXXXXXXXXPVFXSSNPFIXXXXXXXXXXXXXXXXXXXXXXXXQWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDFXXXXXXXXXXXXXXXXXXXXXXXXXXXXXXXXXXXXXXEVXXXXXXXXXXXXXXX

SEQ ID NO: 30906 - protein, 184 aa, Diabrotica virgifera
  misc_feature: Coding regions on vcDNA: vcDNA=SeqID_10603; Strand=+; Position=2-556
  misc_feature: Homolog annotation: Hit_ID=XP_313296.1; Match level="QueryCoverage =83%, HitCoverage=16%, E-value=7e-31, Identity=44%"; Hit description =ENSANGP00000010461 [Anopheles gambiae]
  misc_feature: Gene Ontology Annotation: Molecular function=molecular_function unknown; Cellular component=nucleus; Biological process=nucleotide -excision repair
FEISLKLHKEKILEMKLEFVYIVLTLVDGERDPRNLLFLFKWMKVFLDHFDLKHLTEDIFDVLACYFPVDFRAPPSESSITREALSEALTPCLCAKPEFGDSCITLALEKLDSSLEIAKTDSLKLLTGGCVTFPTSIYLEKAPEIWSLLQKEILTNTPDNIRQECLTTLTIIISKISEGRTDEF

SEQ ID NO: 30907 - protein, 66 aa, Diabrotica virgifera
  misc_feature: Coding regions on vcDNA: vcDNA=SeqID_10604; Strand=+; Position=469-666
SSFVLFLKPFFYNRVKNTIFITPYESYRCYFKALELYNMFKALTCRIDRIGDFDVMSNRYKNVMSD

SEQ ID NO: 30908 - protein, 113 aa, Diabrotica virgifera
  misc_feature: Coding regions on vcDNA: vcDNA=SeqID_10605; Strand=+; Position=43-384
VHEIKLNNMEISQVNEQLCKIETTNHEVGETLLDTFKIEITEEPKRESVYDDAFGYFDLKELPVKTEIEQNEYKFSLFEEKEANKERNGKHESNGPCFKKEDYTPSPTSINGI

SEQ ID NO: 30909 - protein, 79 aa, Diabrotica virgifera
  misc_feature: Coding regions on vcDNA: vcDNA=SeqID_10606; Strand=+; Position=627-866
  misc_feature (71)..(71): Xaa can be any naturally occurring amino acid
VPERIFPGPGDLPFFNCLHMVSTSLSFTLIGDPINLTPCIPLDYICLKGSLVSVSKSSKYPSQVCGDTQGXRRGMSGPR

SEQ ID NO: 30910 - protein, 71 aa, Diabrotica virgifera
  misc_feature: Coding regions on vcDNA: vcDNA=SeqID_10607; Strand=-; Position=2-214
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PFXXXXXXXXXXXTNLAHTGLNXXXXXXXXSNXXXXXXXXXXXXXXPTSRSXXXXXXXXXXXXXXVIPKVI

SEQ ID NO: 30911 - protein, 68 aa, Diabrotica virgifera
  misc_feature: Coding regions on vcDNA: vcDNA=SeqID_10608; Strand=+; Position=1-207
ALHGPSLHIDLIECHKLVVCYHRQVMQRKEYILLKKQIWHVPGGQGPGRRSLQNVCSLVLCLFEPGEF

SEQ ID NO: 30912 - protein, 76 aa, Diabrotica virgifera
  misc_feature: Coding regions on vcDNA: vcDNA=SeqID_10609; Strand=-; Position=90-320
IFNCNNIEKYNYRYNVNIYILCIYLQYIYMVEANLFAVQIIYLKQLLFYNIEFDLQFDIIEIIYIQAPFFAHLYSI

SEQ ID NO: 30913 - protein, 67 aa, Diabrotica virgifera
  misc_feature: Coding regions on vcDNA: vcDNA=SeqID_10610; Strand=-; Position=1-201
VSRSDKFETSHDLISQPLAPWDMNVQKIRAYLIGIVYSFIKISYCHLVELNSAYTLNFIKESVRMKK

SEQ ID NO: 30914 - protein, 27 aa, Diabrotica virgifera
  misc_feature: Coding regions on vcDNA: vcDNA=SeqID_10611; Strand=-; Position=1-81
  misc_feature (8)..(27): Xaa can be any naturally occurring amino acid
GGILSQYXXXXXXXXXXXXXXXXXXXX

SEQ ID NO: 30915 - protein, 38 aa, Diabrotica virgifera
  misc_feature: Coding regions on vcDNA: vcDNA=SeqID_10612; Strand=-; Position=14-130
  misc_feature (23)..(31): Xaa can be any naturally occurring amino acid
RVQIDNKDCDLDVGLKFIIGVAXXXXXXXXXPTWLTPV

SEQ ID NO: 30916 - protein, 79 aa, Diabrotica virgifera
  misc_feature: Coding regions on vcDNA: vcDNA=SeqID_10613; Strand=+; Position=11-251
  misc_feature: Homolog annotation: Hit_ID=XP_316510.1; Match level="QueryCoverage =91%, HitCoverage=13%, E-value=1e-18, Identity=56%"; Hit description =ENSANGP00000013532 [Anopheles gambiae]
  misc_feature (43)..(43): Xaa can be any naturally occurring amino acid
MQEQQKKVEEPPPVVAPKPIPIFGKRRGGKVLKTGMVQKPKPXSEESSSRDAWSMYMSEVRKYKAACCDDDSKSRPLVK

SEQ ID NO: 30917 - protein, 99 aa, Diabrotica virgifera
  misc_feature: Coding regions on vcDNA: vcDNA=SeqID_10614; Strand=-; Position=545-844
CRVLPFQNTQTKTGILRLKELYTISSRSITRSTISYFLFFKDKTNQPGVSLFCTLFSKTRLRLSIAQNILTLLAHSFSSFQIPLPAFKINQSKATFNYP

SEQ ID NO: 30918 - protein, 78 aa, Diabrotica virgifera
  misc_feature: Coding regions on vcDNA: vcDNA=SeqID_10615; Strand=+; Position=307-543
FPRSFYYYICYKSYINGSLVLRVYILSILCLQYLTCTHIEKKEFTLLDHVYIDIPSFSRAINSMTIKLSIQNNATRLY

SEQ ID NO: 30919 - protein, 82 aa, Diabrotica virgifera
  misc_feature: Coding regions on vcDNA: vcDNA=SeqID_10616; Strand=+; Position=3-248
  misc_feature (2)..(22): Xaa can be any naturally occurring amino acid
  misc_feature (24)..(33): Xaa can be any naturally occurring amino acid
GXXXXXXXXXXXXXXXXXXXXXPXXXXXXXXXXLRDNPRHFYWRSSKCKNKNWEPPRLELKLINLGGTPYFFISRVTSLKFF

SEQ ID NO: 30920 - protein, 126 aa, Diabrotica virgifera
  misc_feature: Coding regions on vcDNA: vcDNA=SeqID_10617; Strand=+; Position=40-420
  misc_feature: Homolog annotation: Hit_ID=NP_956807.1; Match level="QueryCoverage =100%, HitCoverage=100%, E-value=4e-28, Identity=47%"; Hit description=hypothetical protein MGC66282 [Danio rerio] gb|AAH55580.1| Hypothetical protein MGC66282 [Danio
  misc_feature: Gene Ontology Annotation: Molecular function=tubulin binding; Cellular component=cytoplasm; Biological process=tubulin folding
  misc_feature: Pfam annotation: Pfam_ID=KE2; Match level="Score=99.1, E-value=1.1e -26, Copies=1"; Pfam description=KE2 family protein
MSEDIQRKLQNELENYKKTQKELQRTIQTRQQLDGQLNENEIVKQELDLLPSDGKVYKSVGPVLIKTELIEAKQNVSKRMDYISKELKRVDDLINTLDKKQDVHREALQKLQHQFQQAQVKAALHA

SEQ ID NO: 30921 - protein, 53 aa, Diabrotica virgifera
  misc_feature: Coding regions on vcDNA: vcDNA=SeqID_10618; Strand=-; Position=175-336
CFMMIASDGSSYIYDSYFGPSSYKHIIPKSADLYSSQRIIILRLHPLDIHTLA

SEQ ID NO: 30922 - protein, 79 aa, Diabrotica virgifera
  misc_feature: Coding regions on vcDNA: vcDNA=SeqID_10619; Strand=-; Position=0-236
  misc_feature (38)..(78): Xaa can be any naturally occurring amino acid
RVQFNFHNPLIIIGIYIMKNYNKCMICTNNIRYFKLQXXXXXXXXXXXXXXXXXXXXXXXXXXXXXXXXXXXXXXXXXA

SEQ ID NO: 30923 - protein, 89 aa, Diabrotica virgifera
  misc_feature: Coding regions on vcDNA: vcDNA=SeqID_10620; Strand=+; Position=3-272
  misc_feature: Homolog annotation: Hit_ID=XP_396302.1; Match level="QueryCoverage =82%, HitCoverage=6%, E-value=9e-17, Identity=57%"; Hit description =similar to ENSANGP00000014757 [Apis mellifera]
DDKVFDSDEDSDVEISYELTGDRKKVFDFFQSATLNELQLISTCSKKKAEAIVDLRPFADWKYLMTIIQNSKNLGCIRPVNGHLVETKV

SEQ ID NO: 30924 - protein, 108 aa, Diabrotica virgifera
  misc_feature: Coding regions on vcDNA: vcDNA=SeqID_10621; Strand=+; Position=161-487
  misc_feature: Homolog annotation: Hit_ID=AAB30031.1; Match level="QueryCoverage =80%, HitCoverage=14%, E-value=5e-11, Identity=43%"; Hit description =electron transfer flavoprotein-ubiquinone oxidoreductase, ETF-QO {EC 1.5.5.1} [swine, fetal liver, Peptide
  misc_feature: Gene Ontology Annotation: Molecular function=electron acceptor activity; Cellular component=mitochondrial inner membrane
TVTTRELDQPDHLILLYENVPGNENLSNEEVPEVRDCPALENYLEPLEYRDIYILQILAHNCFFCNACDLIDPTRILTDLYHTVDGGPSSPNRRKDPHTSRYPRIYVT

SEQ ID NO: 30925 - protein, 130 aa, Diabrotica virgifera
  misc_feature: Coding regions on vcDNA: vcDNA=SeqID_10622; Strand=+; Position=23-415
  misc_feature (22)..(43): Xaa can be any naturally occurring amino acid
  misc_feature (45)..(54): Xaa can be any naturally occurring amino acid
  misc_feature (60)..(73): Xaa can be any naturally occurring amino acid
  misc_feature (86)..(105): Xaa can be any naturally occurring amino acid
  misc_feature (112)..(118): Xaa can be any naturally occurring amino acid
SAYYPSKIAPKNIQGRRLLIAXXXXXXXXXXXXXXXXXXXXXXLXXXXXXXXXXTELKNXXXXXXXXXXXXXXVLKWYSILDISKXXXXXXXXXXXXXXXXXXXXIIIVTYXXXXXXXYVLLKFMFLNTD

SEQ ID NO: 30926 - protein, 305 aa, Diabrotica virgifera
  misc_feature: Coding regions on vcDNA: vcDNA=SeqID_10623; Strand=+; Position=36-954
  misc_feature: Homolog annotation: Hit_ID=XP_314784.1; Match level="QueryCoverage =95%, HitCoverage=66%, E-value=1e-109, Identity=67%"; Hit description= ENSANGP00000014187 [Anopheles gambiae]
  misc_feature: Gene Ontology Annotation: Molecular function=protein binding; Cellular component=SWI/SNF complex; Biological process=chromatin assembly/disassembly
  misc_feature: Pfam annotation: Pfam_ID=Actin; Match level="Score=25.4, E-value=1.4e- 08, Copies=1"; Pfam description=Actin
  misc_feature (263)..(263): Xaa can be any naturally occurring amino acid
  misc_feature (272)..(272): Xaa can be any naturally occurring amino acid
  misc_feature (282)..(282): Xaa can be any naturally occurring amino acid
  misc_feature (285)..(285): Xaa can be any naturally occurring amino acid
RSPWNQRQKREKLTEIMFEKYKVPAFFLVKNAPLAAFANGRATALVIDSGATHTTAVPVLDGYVLANAVVKSPLGGDLLVLRARELLESMGIDLTPTPMIASKEVVREKEAPKFTKKKLSFQPTNSWLNYMIKKTIQDFQQTVLQVSENPYDERAATNIPAVHYEFPTGYHQDFGPERFKLAEGLFDHAMLGAGYIAATSAGMCDVDIRPALYSAVVVTGGNSLVQGFSDRLSRDLSSRTPGSLRMKMIAANGTVERRFGAWXGGSILASIXTFPAMWISMXEYXECGNPQSIEVPLNVVYHRTL

SEQ ID NO: 30927 - protein, 90 aa, Diabrotica virgifera
  misc_feature: Coding regions on vcDNA: vcDNA=SeqID_10624; Strand=+; Position=1-273
QLDKVEFKMICDYILKDLPSYLKDLLSDTDLDKVQVAGEKRSWIITIYLRSPYHQYLKNHIAACAIVTAVTSPVSKCLSYLNISSFLINT

SEQ ID NO: 30928 - protein, 153 aa, Diabrotica virgifera
  misc_feature: Coding regions on vcDNA: vcDNA=SeqID_10625; Strand=-; Position=2-460
  misc_feature (47)..(145): Xaa can be any naturally occurring amino acid
CMRIIIYIYNVSRSAFSFWYKTDNIMNRILDITSLTKDAIMIYRVVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNDDNISIK

SEQ ID NO: 30929 - protein, 125 aa, Diabrotica virgifera
  misc_feature: Coding regions on vcDNA: vcDNA=SeqID_10626; Strand=+; Position=3-380
  misc_feature (1)..(57): Xaa can be any naturally occurring amino acid
  misc_feature (60)..(60): Xaa can be any naturally occurring amino acid
  misc_feature (63)..(83): Xaa can be any naturally occurring amino acid
  misc_feature (95)..(108): Xaa can be any naturally occurring amino acid
XXXXXXXXXXXXXXXXXXXXXXXXXXXXXXXXXXXXXXXXXXXXXXXXXXXXXXXXXGDXKIXXXXXXXXXXXXXXXXXXXXXFIRNKLPLGITXXXXXXXXXXXXXXGDLDGWDKVLYLVKQLI

SEQ ID NO: 30930 - protein, 56 aa, Diabrotica virgifera
  misc_feature: Coding regions on vcDNA: vcDNA=SeqID_10627; Strand=-; Position=3-170
  misc_feature (3)..(10): Xaa can be any naturally occurring amino acid
  misc_feature (38)..(38): Xaa can be any naturally occurring amino acid
  misc_feature (47)..(56): Xaa can be any naturally occurring amino acid
FKXXXXXXXXSNRLNYIAATPIINLIQHRGRNLYYRLXLSNKITLLXXXXXXXXXX

SEQ ID NO: 30931 - protein, 339 aa, Diabrotica virgifera
  misc_feature: Coding regions on vcDNA: vcDNA=SeqID_10628; Strand=+; Position=1-1017
  misc_feature (1)..(15): Xaa can be any naturally occurring amino acid
  misc_feature (18)..(55): Xaa can be any naturally occurring amino acid
  misc_feature (58)..(133): Xaa can be any naturally occurring amino acid
  misc_feature (135)..(183): Xaa can be any naturally occurring amino acid
  misc_feature (185)..(198): Xaa can be any naturally occurring amino acid
  misc_feature (200)..(200): Xaa can be any naturally occurring amino acid
  misc_feature (202)..(208): Xaa can be any naturally occurring amino acid
  misc_feature (210)..(219): Xaa can be any naturally occurring amino acid
  misc_feature (226)..(252): Xaa can be any naturally occurring amino acid
  misc_feature (254)..(280): Xaa can be any naturally occurring amino acid
  misc_feature (283)..(303): Xaa can be any naturally occurring amino acid
  misc_feature (306)..(314): Xaa can be any naturally occurring amino acid
  misc_feature (330)..(336): Xaa can be any naturally occurring amino acid
XXXXXXXXXXXXXXXYLXXXXXXXXXXXXXXXXXXXXXXXXXXXXXXXXXXXXXXETXXXXXXXXXXXXXXXXXXXXXXXXXXXXXXXXXXXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXTXXXXXXXXXXXXXXIXLXXXXXXXAXXXXXXXXXXKLEMRGXXXXXXXXXXXXXXXXXXXXXXXXXXXQXXXXXXXXXXXXXXXXXXXXXXXXXXXGGXXXXXXXXXXXXXXXXXXXXXPHXXXXXXXXXPQGKTPAIFFWGEGQXXXXXXXAPP

SEQ ID NO: 30932 - protein, 121 aa, Diabrotica virgifera
  misc_feature: Coding regions on vcDNA: vcDNA=SeqID_10629; Strand=+; Position=77-442
  misc_feature (38)..(47): Xaa can be any naturally occurring amino acid
SLLYKRLIHCLNPVVCIASLLNNYILIILTLRTAIASXXXXXXXXXXYLFCFEMILTPKYTFIIYQIDIFYVLAIYVLSNILILFLSTVFMKALNNKCLFLFDLSADVKTSNVHILRRGLL

SEQ ID NO: 30933 - protein, 120 aa, Diabrotica virgifera
  misc_feature: Coding regions on vcDNA: vcDNA=SeqID_10630; Strand=+; Position=624 -1113
  misc_feature: Gene Ontology Annotation: Molecular function=actin binding; Cellular component=actin cytoskeleton; Biological process=G-protein signaling, coupled to cAMP nucleotide second messenger
IPPPPLLHLDPTYSTHPSCRPGTPPHPRYQPLSPRKAHARAPLPPLSPPPLPQRSAASPSPHMSFSMKPHPSRHPRPPTRGGTNPGPPLIPLPTTPPRPRPPSRGPPPYTFPPPLPPHPP

SEQ ID NO: 30934 - protein, 38 aa, Diabrotica virgifera
  misc_feature: Coding regions on vcDNA: vcDNA=SeqID_10631; Strand=-; Position=5-121
TIIYISLLIHNPVLRTRQKIIFFCIKRRFSLSQLLSSR

SEQ ID NO: 30935 - protein, 38 aa, Diabrotica virgifera
  misc_feature: Coding regions on vcDNA: vcDNA=SeqID_10632; Strand=-; Position=1-114
  misc_feature (3)..(36): Xaa can be any naturally occurring amino acid
KKXXXXXXXXXXXXXXXXXXXXXXXXXXXXXXXXXXLK

SEQ ID NO: 30936 - protein, 195 aa, Diabrotica virgifera
  misc_feature: Coding regions on vcDNA: vcDNA=SeqID_10633; Strand=+; Position=232-816
  misc_feature (13)..(35): Xaa can be any naturally occurring amino acid
  misc_feature (79)..(89): Xaa can be any naturally occurring amino acid
  misc_feature (94)..(101): Xaa can be any naturally occurring amino acid
  misc_feature (103)..(142): Xaa can be any naturally occurring amino acid
  misc_feature (152)..(160): Xaa can be any naturally occurring amino acid
  misc_feature (173)..(182): Xaa can be any naturally occurring amino acid
TVIRFYIYLISYXXXXXXXXXXXXXXXXXXXXXXXIPTDELINNILLTFNFSLKITIHHYHIFKYVIIHFYISLFPFSXXXXXXXXXXXSKLRXXXXXXXXTXXXXXXXXXXXXXXXXXXXXXXXXXXXXXXXXXXXXXXXXSEWPRHFDRXXXXXXXXXLLEAVMKGWMNTXXXXXXXXXXYFLAKKLNFFNRR

SEQ ID NO: 30937 - protein, 51 aa, Diabrotica virgifera
  misc_feature: Coding regions on vcDNA: vcDNA=SeqID_10634; Strand=+; Position=65-220
GLVREKILVLSNKNILLCTFRLKYNILLVLTRQTLNWKTGGLSKYYGRQPI

SEQ ID NO: 30938 - protein, 97 aa, Diabrotica virgifera
  misc_feature: Coding regions on vcDNA: vcDNA=SeqID_10635; Strand=+; Position=63-357
  misc_feature: Homolog annotation: Hit_ID=NP_611074.1; Match level="QueryCoverage =97%, HitCoverage=57%, E-value=2e-37, Identity=73%"; Hit description =CG8386-PA [Drosophila melanogaster] gb|AAF58080.1| CG8386-PA [Drosophila melanogaster]
  misc_feature (9)..(9): Xaa can be any naturally occurring amino acid
  misc_feature (16)..(16): Xaa can be any naturally occurring amino acid
FRKCWFIHXMLKYVFXVELDIPISYPTTAPEIALPELDGQSATMYRGGKIRLRDHFEPLWARNAPIFGIGHAMALGLGPWLDEEIPDLIAKGVISLQ

SEQ ID NO: 30939 - protein, 151 aa, Diabrotica virgifera
  misc_feature: Coding regions on vcDNA: vcDNA=SeqID_10636; Strand=-; Position=642 -1097
  misc_feature (45)..(63): Xaa can be any naturally occurring amino acid
  misc_feature (70)..(126): Xaa can be any naturally occurring amino acid
  misc_feature (129)..(139): Xaa can be any naturally occurring amino acid
PKLIDLYSQAGGRAIFFFDLNFSKKKIRLFFPKGNLFSYIQKKWXXXXXXXXXXXXXXXXXXXSFLVTPXXXXXXXXXXXXXXXXXXXXXXXXXXXXXXXXXXXXXXXXXXXXXXXXXXXXXXXXXFIXXXXXXXXXXXTLARSKCRGHSN

SEQ ID NO: 30940 - protein, 311 aa, Diabrotica virgifera
  misc_feature: Coding regions on vcDNA: vcDNA=SeqID_10637; Strand=-; Position=1-933
  misc_feature (5)..(309): Xaa can be any naturally occurring amino acid
  misc_feature (311)..(311): Xaa can be any naturally occurring amino acid
FNPPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTX

SEQ ID NO: 30941 - protein, 136 aa, Diabrotica virgifera
  misc_feature: Coding regions on vcDNA: vcDNA=SeqID_10638; Strand=+; Position=259-669
  misc_feature: Homolog annotation: Hit_ID=EAL40921.1; Match level="QueryCoverage =52%, HitCoverage=94%, E-value=5e-09, Identity=46%"; Hit description =ENSANGP00000026493 [Anopheles gambiae str. PEST] ref|XP_563719.1| ENSANGP00000026493 [Anopheles gambiae st
MVGSNGTMIAIRLVRSKLRKREEHSNSVHPTDVVLQTTPNATQLNHQNTSPHILQSDLTYRGQFLWTQPPPPANQYPYNHNQDTLVQNSGDRPGFVRGFRKNLGGKWRRLVKRKPSQEVYTIPAELKPQLKQIYVY

SEQ ID NO: 30942 - protein, 119 aa, Diabrotica virgifera
  misc_feature: Coding regions on vcDNA: vcDNA=SeqID_10639; Strand=+; Position=183-542
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(86): Xaa can be any naturally occurring amino acid
  misc_feature (88)..(88): Xaa can be any naturally occurring amino acid
  misc_feature (98)..(105): Xaa can be any naturally occurring amino acid
NYAVIPKVIYSYXXXXXXXXXXXXXXXXXXXXXXXXXPXXXXXXXXXXXXXXXXXXXXXXSIGSSXXXXXXXLFXXXXXXXXXXXXTXFFFIQPFIPXXXXXXXXYATLARSKYRGHSN

SEQ ID NO: 30943 - protein, 85 aa, Diabrotica virgifera
  misc_feature: Coding regions on vcDNA: vcDNA=SeqID_10640; Strand=-; Position=2-256
FQKYREIHHFTLIKYVCILFLIILNPNMVLQFENSYTEALIQYVCVARNHMETFLLSILRKKVILHKMLWIVKKLKLNHQISNFI

SEQ ID NO: 30944 - protein, 143 aa, Diabrotica virgifera
  misc_feature: Coding regions on vcDNA: vcDNA=SeqID_10641; Strand=-; Position=1-429
  misc_feature (6)..(58): Xaa can be any naturally occurring amino acid
  misc_feature (62)..(143): Xaa can be any naturally occurring amino acid
KKKFGXXXXXXXXXXXXXXXXXXXXXXXXXXXXXXXXXXXXXXXXXXXXXXXXXXXXXLSSXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30945 - protein, 46 aa, Diabrotica virgifera
  misc_feature: Coding regions on vcDNA: vcDNA=SeqID_10642; Strand=+; Position=2-142
PSSVPFILSFLSNRCIHFISQISESLRKENGVPTIVQLTICDFYSE

SEQ ID NO: 30946 - protein, 90 aa, Diabrotica virgifera
  misc_feature: Coding regions on vcDNA: vcDNA=SeqID_10643; Strand=+; Position=19-290
  misc_feature: Homolog annotation: Hit_ID=AAM88581.1; Match level="QueryCoverage =96%, HitCoverage=78%, E-value=1e-17, Identity=49%"; Hit description =NADH dehydrogenase subunit I [Parasbecesta ruwensorica]
  misc_feature (49)..(49): Xaa can be any naturally occurring amino acid
PISSLILIVCALVSIAFTVLCYIQIRNGPNKDGFLWLFRPCGDAIKIIXTRNSTDPVISNSNIYYVSPIIKILIHLYLRVSIPYITISEI

SEQ ID NO: 30947 - protein, 84 aa, Diabrotica virgifera
  misc_feature: Coding regions on vcDNA: vcDNA=SeqID_10644; Strand=-; Position=21-275
  misc_feature (11)..(20): Xaa can be any naturally occurring amino acid
  misc_feature (67)..(76): Xaa can be any naturally occurring amino acid
KIHIFDKLDIXXXXXXXXXXWIFPPYVVATSHVHLCFTISLFIPYYFYCYSELLVVELKYIYNSIVXXXXXXXXXXLVNSLLVD

SEQ ID NO: 30948 - protein, 84 aa, Diabrotica virgifera
  misc_feature: Coding regions on vcDNA: vcDNA=SeqID_10645; Strand=-; Position=2-253
  misc_feature (8)..(15): Xaa can be any naturally occurring amino acid
  misc_feature (21)..(28): Xaa can be any naturally occurring amino acid
GQPSRRIXXXXXXXXPERHLXXXXXXXXGFNSNASCIHGWTGGQYISIKISGIIIVRIVLVSVSRGRTAGCSNKVQANAGKRVE

SEQ ID NO: 30949 - protein, 304 aa, Diabrotica virgifera
  misc_feature: Coding regions on vcDNA: vcDNA=SeqID_10646; Strand=+; Position=2-913
  misc_feature (5)..(227): Xaa can be any naturally occurring amino acid
  misc_feature (229)..(242): Xaa can be any naturally occurring amino acid
  misc_feature (254)..(261): Xaa can be any naturally occurring amino acid
  misc_feature (264)..(271): Xaa can be any naturally occurring amino acid
  misc_feature (281)..(292): Xaa can be any naturally occurring amino acid
  misc_feature (296)..(304): Xaa can be any naturally occurring amino acid
LLRPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXRPRWWIRVYNWXXXXXXXXVRXXXXXXXXSLNRCEPGWXXXXXXXXXXXXKNQXXXXXXXXX

SEQ ID NO: 30950 - protein, 49 aa, Diabrotica virgifera
  misc_feature: Coding regions on vcDNA: vcDNA=SeqID_10647; Strand=-; Position=88-237
  misc_feature (34)..(40): Xaa can be any naturally occurring amino acid
IILHFVFTCIHTHLSNISSQLCNIYKIILHPSIXXXXXXXLNALLPGYV

SEQ ID NO: 30951 - protein, 271 aa, Diabrotica virgifera
  misc_feature: Coding regions on vcDNA: vcDNA=SeqID_10648; Strand=+; Position=1-813
  misc_feature: Homolog annotation: Hit_ID=XP_393750.1; Match level="QueryCoverage =99%, HitCoverage=20%, E-value=4e-75, Identity=49%"; Hit description =similar to ENSANGP00000004277 [Apis mellifera]
  misc_feature: Gene Ontology Annotation: Molecular function=15-hydroxyprostaglandin dehydrogenase (NAD+) activity; Cellular component=cellular_component unknown; Biological process=biological_process unknown
  misc_feature: Pfam annotation: Pfam_ID=ABC_membrane; Match level="Score=-21.7, E -value=0.0049, Copies=1"; Pfam description=ABC transporter transmembrane region
  misc_feature (87)..(92): Xaa can be any naturally occurring amino acid
  misc_feature (180)..(180): Xaa can be any naturally occurring amino acid
  misc_feature (251)..(251): Xaa can be any naturally occurring amino acid
ASTNVHNAMFRKIISSPMLFFNSNPSGRILNRFSKDIGILDELLPLATADSTWVGLTVVATTIVISLLNPWILIPTAVIVCIFYKIXXXXXXSSRNIKRIEAVTRSPIFTHLAASLQGLPTIRAFGAEQILTQEFDNFQDAYTSSYFMFLTASRGFGFWLDLHCAFYISLVVISIVFFPXGSLGGNVGLSLTQAITLSGMFQWVMREWSELENQMTSVERTQEYTDLPIESDNERKQPPADWPSSGSLTFXNMSLRYSLEAPCVLKNLNFE

SEQ ID NO: 30952 - protein, 61 aa, Diabrotica virgifera
  misc_feature: Coding regions on vcDNA: vcDNA=SeqID_10649; Strand=-; Position=1-183
  misc_feature (1)..(46): Xaa can be any naturally occurring amino acid
  misc_feature (53)..(60): Xaa can be any naturally occurring amino acid
XXXXXXXXXXXXXXXXXXXXXXXXXXXXXXXXXXXXXXXXXXXXXXSNPFHSXXXXXXXXL

SEQ ID NO: 30953 - protein, 189 aa, Diabrotica virgifera
  misc_feature: Coding regions on vcDNA: vcDNA=SeqID_10650; Strand=+; Position=2-570
  misc_feature: Homolog annotation: Hit_ID=BAB92074.1; Match level="QueryCoverage =98%, HitCoverage=28%, E-value=2e-48, Identity=55%"; Hit description =heat shock cognate protein [Bombyx mori]
  misc_feature: Gene Ontology Annotation: Molecular function=protein binding; Biological process=reproduction
  misc_feature (121)..(121): Xaa can be any naturally occurring amino acid
  misc_feature (155)..(155): Xaa can be any naturally occurring amino acid
EELNVDLYGSTMEPANKDITDAKMEKALIHNLELRVVSTGIPHERILSEDFFDGIELNNSMKPDDAAAYDASVLVCILHVYKPEEIPDLIMLDVTPLSLLIETAGGAMAALILRHLPYPTXKSQSFSTHSEYQPAILNLVYECELGMTSDNNLLXKFELTVFPPAPRGVSHTEQCSNIDVICIMNIMVH

SEQ ID NO: 30954 - protein, 58 aa, Diabrotica virgifera
  misc_feature: Coding regions on vcDNA: vcDNA=SeqID_10651; Strand=+; Position=92-265
MKLYYRTKKAHYEHKSKGIYATDRETVLIYMSHFPEMTMTITSESREHAEIAESLTKY

SEQ ID NO: 30955 - protein, 118 aa, Diabrotica virgifera
  misc_feature: Coding regions on vcDNA: vcDNA=SeqID_10652; Strand=-; Position=46-402
  misc_feature (24)..(30): Xaa can be any naturally occurring amino acid
  misc_feature (43)..(49): Xaa can be any naturally occurring amino acid
  misc_feature (58)..(69): Xaa can be any naturally occurring amino acid
  misc_feature (72)..(78): Xaa can be any naturally occurring amino acid
  misc_feature (92)..(111): Xaa can be any naturally occurring amino acid
LEGPRRFMKKIKFSICKIAPLLKXXXXXXXEKNRPREINNYLXXXXXXXEFNSSFIRXXXXXXXXXXXXFIXXXXXXXNSIGYFHLIQNLNXXXXXXXXXXXXXXXXXXXXPLHSSLQ

SEQ ID NO: 30956 - protein, 45 aa, Diabrotica virgifera
  misc_feature: Coding regions on vcDNA: vcDNA=SeqID_10653; Strand=-; Position=121-258
  misc_feature (4)..(20): Xaa can be any naturally occurring amino acid
PFSXXXXXXXXXXXXXXXXXPGAPPPGFKTPGFMLKIFKSRTRLN

SEQ ID NO: 30957 - protein, 318 aa, Diabrotica virgifera
  misc_feature: Coding regions on vcDNA: vcDNA=SeqID_10654; Strand=+; Position=2-957
  misc_feature: Homolog annotation: Hit_ID=XP_392152.1; Match level="QueryCoverage =99%, HitCoverage=19%, E-value=3e-97, Identity=52%"; Hit description =similar to ENSANGP00000011094 [Apis mellifera]
  misc_feature: Gene Ontology Annotation: Molecular function=protein binding; Cellular component=intracellular; Biological process=cell differentiation
  misc_feature (282)..(282): Xaa can be any naturally occurring amino acid
  misc_feature (292)..(292): Xaa can be any naturally occurring amino acid
  misc_feature (298)..(298): Xaa can be any naturally occurring amino acid
MTGPQQRVLSGYHALSGLKAPPGVEHFEDVVHKKCSNFTLPEIQHNLDLLVDMCEQDIIRIDRSSRLNEDKIVALEQEEKMLRDVLNKEGELMENIQEVISVVDKLMDSTQTYSLGQIASIFKELQDKHSEEYTMYELGELAPGLIGPLITSALANWNPLLQPHQHVDVFKQWQDILTSQHRGNLEGNKMGIQPYDSFIWHTWMPVMRTCVSSWSPRDCDPLITLLEAWKPVLSQWILENVLSQLVLPKILKEVNEWNPLTDTTPIHVWIHPWIPLLDDKLXSTIYPVISEXLGSALXNWHPSDRSAKVMLQPWAEEW

SEQ ID NO: 30958 - protein, 83 aa, Diabrotica virgifera
  misc_feature: Coding regions on vcDNA: vcDNA=SeqID_10655; Strand=-; Position=1-249
  misc_feature (1)..(26): Xaa can be any naturally occurring amino acid
  misc_feature (29)..(83): Xaa can be any naturally occurring amino acid
XXXXXXXXXXXXXXXXXXXXXXXXXXIKXXXXXXXXXXXXXXXXXXXXXXXXXXXXXXXXXXXXXXXXXXXXXXXXXXXXXXX

SEQ ID NO: 30959 - protein, 272 aa, Diabrotica virgifera
  misc_feature: Coding regions on vcDNA: vcDNA=SeqID_10656; Strand=+; Position=119-934
  misc_feature: Homolog annotation: Hit_ID=NP_780461.1; Match level="QueryCoverage =97%, HitCoverage=78%, E-value=6e-34, Identity=36%"; Hit description =RIKEN cDNA 6720457D02 [Mus musculus] dbj|BAC27132.1| unnamed protein product [Mus musculus]
  misc_feature: Gene Ontology Annotation: Molecular function=DNA binding; Cellular component=nucleus; Biological process=regulation of transcription, DNA-dependent
  misc_feature: Pfam annotation: Pfam_ID=zf-C2H2; Match level="Score=129.5, E-value =8.2e-36, Copies=6"; Pfam description=Zinc finger, C2H2 type
  misc_feature (246)..(246): Xaa can be any naturally occurring amino acid
  misc_feature (254)..(255): Xaa can be any naturally occurring amino acid
  misc_feature (267)..(267): Xaa can be any naturally occurring amino acid
MSLSDHCCSDDIKIEDDTLKYEVTDNTMEDVKVEIKSEMEEYNVIYDEKPCISGKKSSLLSKLSIERFLKREQGIEIVETVSEISCKEEHVNEQPEEKTINSAIHFFRPFKCEICSQEFSNAVQVERHMRTHNGGKSFRCEICFKSKRFSQADDLQLHIRTHHNRKKPFKCEICSKSFVKKTNLCKHMEMHSERFKDKVNKRFHDFGDLTKHLKTHNGEHLFKCHICSKQCSQSDDLKKHMKTHTXEKPFKCEXXPKSFGKKTNLCXHMEMH

SEQ ID NO: 30960 - protein, 115 aa, Diabrotica virgifera
  misc_feature: Coding regions on vcDNA: vcDNA=SeqID_10657; Strand=+; Position=219-567
  misc_feature: Homolog annotation: Hit_ID=AAK94897.1; Match level="QueryCoverage =61%, HitCoverage=33%, E-value=5e-12, Identity=50%"; Hit description =mRNA cap-binding protein eIF4E [Spodoptera frugiperda]
  misc_feature: Pfam annotation: Pfam_ID=IF4E; Match level="Score=-125.4, E-value =0.082, Copies=1"; Pfam description=Eukaryotic initiation factor 4E
  misc_feature (94)..(94): Xaa can be any naturally occurring amino acid
DSRELRKRQKAELGSRTKKKLPLSQLRRTAGAFRTPSNLLSDVRQGTDNSLLKIGIRTMREDDANKTGRTRLLSLQKIRLRHDLHRHWLNIILXLIGEALENSEDICEADDIIWL

SEQ ID NO: 30961 - protein, 23 aa, Diabrotica virgifera
  misc_feature: Coding regions on vcDNA: vcDNA=SeqID_10658; Strand=-; Position=0-68
  misc_feature (1)..(22): Xaa can be any naturally occurring amino acid
XXXXXXXXXXXXXXXXXXXXXXT

SEQ ID NO: 30962 - protein, 254 aa, Diabrotica virgifera
  misc_feature: Coding regions on vcDNA: vcDNA=SeqID_10659; Strand=-; Position=2-763
  misc_feature (2)..(9): Xaa can be any naturally occurring amino acid
  misc_feature (11)..(33): Xaa can be any naturally occurring amino acid
  misc_feature (36)..(254): Xaa can be any naturally occurring amino acid
GXXXXXXXXGXXXXXXXXXXXXXXXXXXXXXXXPFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30963 - protein, 87 aa, Diabrotica virgifera
  misc_feature: Coding regions on vcDNA: vcDNA=SeqID_10660; Strand=+; Position=112-375
  misc_feature (46)..(46): Xaa can be any naturally occurring amino acid
  misc_feature (64)..(64): Xaa can be any naturally occurring amino acid
DGVALLPTVPRLTSGLAILYEVNSQQEPKDVQIRVYVHTQGEGPLXVLIAASEIFSLFSEHNLXPELRGDFPGGRIDKTIDAIPLVS

SEQ ID NO: 30964 - protein, 63 aa, Diabrotica virgifera
  misc_feature: Coding regions on vcDNA: vcDNA=SeqID_10661; Strand=-; Position=242-433
  misc_feature (32)..(38): Xaa can be any naturally occurring amino acid
YNHESLALQQVQTLYVFNVVNGIIIVSCQERXXXXXXXVKAMIPFFHLVLNPSRSLKVLKVLS

SEQ ID NO: 30965 - protein, 76 aa, Diabrotica virgifera
  misc_feature: Coding regions on vcDNA: vcDNA=SeqID_10662; Strand=-; Position=182-412
  misc_feature (13)..(19): Xaa can be any naturally occurring amino acid
KLTSNNYFSLELXXXXXXXESYQAYLCMDVGAINKLNKLVKNLDLFTKEQQICAKQLLKHISLTECVIHLLPRHTW

SEQ ID NO: 30966 - protein, 299 aa, Diabrotica virgifera
  misc_feature: Coding regions on vcDNA: vcDNA=SeqID_10663; Strand=+; Position=20-919
  misc_feature: Homolog annotation: Hit_ID=YP_100780.1; Match level="QueryCoverage =70%, HitCoverage=98%, E-value=1e-26, Identity=37%"; Hit description =uracil-DNA glycosylase [Bacteroides fragilis YCH46] dbj|BAD50246.1| uracil-DNA
  misc_feature: Gene Ontology Annotation: Molecular function=uracil DNA N-glycosylase activity; Cellular component=nucleus; Biological process=base -excision repair
  misc_feature: Pfam annotation: Pfam_ID=UDG; Match level="Score=119.3, E-value=9.4e -33, Copies=1"; Pfam description=Uracil DNA glycosylase superfamily
MANNNHKFEYFVQEYPILFEKNKVPEVWQDLMATVFNNQFDSLKNVALHLKEDQKWYPSSDKMWNFTNFCCPQCIKVIIVGQDPTSEPTGLAFSSRGKIYNSTINILKEVKADIGIQNLRPEFQGDYGNLEYWAKQGVLLLNSTLTKRIGDDSHFKIGWKGITGELIKQLHFNNEKLVCMFWGQRAKDVINLCNVLTTGHPSRNPKKNFFGCKHFSQANKWLKDHDIAEIDWCPVPKTCPIPTTCVHLSGDSSELDNSRNYMANNNHKFEYFVEYPIFESKVPEVWQDLMATGFHTSIV

SEQ ID NO: 30967 - protein, 275 aa, Diabrotica virgifera
  misc_feature: Coding regions on vcDNA: vcDNA=SeqID_10664; Strand=+; Position=95-919
  misc_feature (38)..(51): Xaa can be any naturally occurring amino acid
  misc_feature (57)..(252): Xaa can be any naturally occurring amino acid
  misc_feature (256)..(274): Xaa can be any naturally occurring amino acid
DSKEAKGLGLGNVSSGDEDARTMYVRFSNEEDLEDYNXXXXXXXXXXXXXXKCYSYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFTNXXXXXXXXXXXXXXXXXXXG

SEQ ID NO: 30968 - protein, 348 aa, Diabrotica virgifera
  misc_feature: Coding regions on vcDNA: vcDNA=SeqID_10665; Strand=-; Position=0-1043
  misc_feature (24)..(347): Xaa can be any naturally occurring amino acid
PMGGPIFYFGVEPPQKKIPCFPLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXT

SEQ ID NO: 30969 - protein, 59 aa, Diabrotica virgifera
  misc_feature: Coding regions on vcDNA: vcDNA=SeqID_10666; Strand=+; Position=44-223
LVSTPSFVCNAISARAVYHSSSSSCNRTYITRRIFCSHTSNLLFRLGDGLVISRDLLFT

SEQ ID NO: 30970 - protein, 105 aa, Diabrotica virgifera
  misc_feature: Coding regions on vcDNA: vcDNA=SeqID_10667; Strand=-; Position=537-854
  misc_feature (3)..(20): Xaa can be any naturally occurring amino acid
  misc_feature (22)..(75): Xaa can be any naturally occurring amino acid
GMXXXXXXXXXXXXXXXXXXIXXXXXXXXXXXXXXXXXXXXXXXXXXXXXXXXXXXXXXXXXXXXXXXXXXXXXXLIKEFGNIFFTCLLKTCLFVLNIKSRLPTD

SEQ ID NO: 30971 - protein, 127 aa, Diabrotica virgifera
  misc_feature: Coding regions on vcDNA: vcDNA=SeqID_10668; Strand=+; Position=464-847
  misc_feature (31)..(40): Xaa can be any naturally occurring amino acid
  misc_feature (118)..(126): Xaa can be any naturally occurring amino acid
QFIQKSLRTQKLLVWSIITMIIIIWTFVASXXXXXXXXXXDNDNPSTNENHFYDIQPICLVRDIRKEENTKVYTELKPLPLIDGTKDGSQNDTDVNNECHKEKSVDVIDVCQHNKGYXXXXXXXXXI

SEQ ID NO: 30972 - protein, 130 aa, Diabrotica virgifera
  misc_feature: Coding regions on vcDNA: vcDNA=SeqID_10669; Strand=+; Position=1-393
  misc_feature: Pfam annotation: Pfam_ID=PBP_GOBP; Match level="Score=40.2, E-value =6.2e-09, Copies=1"; Pfam description=PBP/GOBP family
DLCNHEGTIFFVLIACILSAVIADVAQHLKASSIVQQCQGTDGPVNLIKQIRSGQKLNVEEAGQIALCMNIKAGVMNENGDILTDNLKPKLERRLGNSKATNVINDCGTRNGNSAKEVALNFVKCMQKYI

SEQ ID NO: 30973 - protein, 76 aa, Diabrotica virgifera
  misc_feature: Coding regions on vcDNA: vcDNA=SeqID_10670; Strand=-; Position=364-594
FSSTVIYSVLIHSNLGLTQVPIQRVKEVNSPVFSFFLDSEKAIAIVRHERFITIYRSLVSFKISQQRSWHRVTFVP

SEQ ID NO: 30974 - protein, 49 aa, Diabrotica virgifera
  misc_feature: Coding regions on vcDNA: vcDNA=SeqID_10671; Strand=+; Position=3-152
PAILNVMFIYILIARIQSCICERAAQYHLLLTAYCYKGNGLTLHYCRII

SEQ ID NO: 30975 - protein, 240 aa, Diabrotica virgifera
  misc_feature: Coding regions on vcDNA: vcDNA=SeqID_10672; Strand=-; Position=1-723
  misc_feature (9)..(17): Xaa can be any naturally occurring amino acid
  misc_feature (27)..(34): Xaa can be any naturally occurring amino acid
  misc_feature (37)..(50): Xaa can be any naturally occurring amino acid
  misc_feature (56)..(69): Xaa can be any naturally occurring amino acid
  misc_feature (71)..(240): Xaa can be any naturally occurring amino acid
YIFAPVVLXXXXXXXXXNNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30976 - protein, 71 aa, Diabrotica virgifera
  misc_feature: Coding regions on vcDNA: vcDNA=SeqID_10673; Strand=-; Position=88-303
LFSLIMEIYSQMKTQCGHHSSSYHTYVLSYSVMLYFSSFRRIICGLLMSNLVLSAGFTYSTIDDCKMYNIR

SEQ ID NO: 30977 - protein, 252 aa, Diabrotica virgifera
  misc_feature: Coding regions on vcDNA: vcDNA=SeqID_10674; Strand=+; Position=144-902
  misc_feature: Homolog annotation: Hit_ID=XP_310265.1; Match level="QueryCoverage =82%, HitCoverage=52%, E-value=5e-49, Identity=45%"; Hit description =ENSANGP00000015314 [Anopheles gambiae]
  misc_feature: Gene Ontology Annotation: Molecular function=tocopherol binding; Cellular component=cytosol; Biological process=transport
  misc_feature (94)..(105): Xaa can be any naturally occurring amino acid
  misc_feature (203)..(203): Xaa can be any naturally occurring amino acid
MEQKGNTQNTKYLHPFYHGLRNVPEGRIKELQKVRTWVAAQPHLPEVSDDYIYVFLSSCNFSVDRAKSCIEHYFTIKTNHPAIFGNRDPEDDKXXXXXXXXXXXXLPKLTPEGYRMVMYAVRDGDPTKMVFGDCVKTFCMFNDIVLSEDGIEDGYIVIFDMKGVQLGHLARISLPALRCFFLYIQEAHPVKIKGVHVLNTASXVHHIMRIVIPLVKSELLSLVKFHKGNIPEGLSFGIMPKEYGGETSSMED

SEQ ID NO: 30978 - protein, 79 aa, Diabrotica virgifera
  misc_feature: Coding regions on vcDNA: vcDNA=SeqID_10675; Strand=+; Position=24-263
DPGSLNHPLRRCHLPTDNSYNNSLLIDTSVHQRQHISYSANPSHLTQYLSRTTPTRLVAATPMHKSLDLTKMNDPYPSS

SEQ ID NO: 30979 - protein, 93 aa, Diabrotica virgifera
  misc_feature: Coding regions on vcDNA: vcDNA=SeqID_10676; Strand=+; Position=199-477
LRETRVRRGDGTRWHTNGYQDIAGSRMPVKREGRGCSALYRNGFGHERLGVLGKLLEGGRGVKGEKIPERYIAVEMSMVWQFGGGRSRDVRMM

SEQ ID NO: 30980 - protein, 25 aa, Diabrotica virgifera
  misc_feature: Coding regions on vcDNA: vcDNA=SeqID_10677; Strand=-; Position=1-75
  misc_feature (3)..(3): Xaa can be any naturally occurring amino acid
  misc_feature (8)..(25): Xaa can be any naturally occurring amino acid
KKXDQKLXXXXXXXXXXXXXXXXXX

SEQ ID NO: 30981 - protein, 258 aa, Diabrotica virgifera
  misc_feature: Coding regions on vcDNA: vcDNA=SeqID_10678; Strand=+; Position=89-865
  misc_feature: Homolog annotation: Hit_ID=XP_310335.1; Match level="QueryCoverage =98%, HitCoverage=47%, E-value=5e-47, Identity=39%"; Hit description =ENSANGP00000015052 [Anopheles gambiae]
  misc_feature: Gene Ontology Annotation: Biological process=reproduction
  misc_feature: Pfam annotation: Pfam_ID=GMC_oxred_N; Match level="Score=65.0, E -value=2.1e-16, Copies=1"; Pfam description=GMC oxidoreductase
  misc_feature (243)..(243): Xaa can be any naturally occurring amino acid
MDIGSLLQDTCPGNLQGISGYFFLTLLNSLLSSKCKLGNTNDYTEDYAPRLKDGDEFDFIVVGSGSAGAVVANKLSENPNWKVLVLEAGGYPSATSDIPGLVFSGLREDWQYRTEPSSQYCLGFKDGQCIWPRGKGLGGSSILNGMMYIRGNKRDYDTWEQMGNTGWGWDTVKEYFKKLENMQAKGVSDQYGRDGYMTLNRYPSDQPIASALHEAFKKMKLPLLDEENPTNPLGILTSFQCIXDGIRFNTGRAFFGSK

SEQ ID NO: 30982 - protein, 79 aa, Diabrotica virgifera
  misc_feature: Coding regions on vcDNA: vcDNA=SeqID_10679; Strand=+; Position=330-569
  misc_feature (61)..(70): Xaa can be any naturally occurring amino acid
ASLNCKTYFSLSYSSFSLPNSRSQNSSSSKPLCTLNYCILNNFSGYNQIFNKLIHTFSHEXXXXXXXXXXLEVAIFDFL

SEQ ID NO: 30983 - protein, 73 aa, Diabrotica virgifera
  misc_feature: Coding regions on vcDNA: vcDNA=SeqID_10680; Strand=-; Position=3-224
  misc_feature (42)..(69): Xaa can be any naturally occurring amino acid
IFKSETNFNKKVVPQLKIYPNMGVQFLFRFELSKKIRGYPKXXXXXXXXXXXXXXXXXXXXXXXXXXXXTPII

SEQ ID NO: 30984 - protein, 273 aa, Diabrotica virgifera
  misc_feature: Coding regions on vcDNA: vcDNA=SeqID_10681; Strand=+; Position=93-911
  misc_feature: Homolog annotation: Hit_ID=XP_315659.1; Match level="QueryCoverage =100%, HitCoverage=29%, E-value=1e-113, Identity=75%"; Hit description=ENSANGP00000007291 [Anopheles gambiae] gb|EAA11732.1| ENSANGP00000007291 [Anopheles gambiae
  misc_feature: Gene Ontology Annotation: Molecular function=pre-mRNA splicing factor activity; Cellular component=intracellular; Biological process=RNA processing
  misc_feature: Pfam annotation: Pfam_ID=PRP1_N; Match level="Score=312.2, E-value =8.2e-91, Copies=1"; Pfam description=PRP1 splicing factor, N-terminal
  misc_feature (70)..(79): Xaa can be any naturally occurring amino acid
  misc_feature (194)..(221): Xaa can be any naturally occurring amino acid
MAAAPPQALVNRNKKHFLGVPAPLGYVAGVGRGATGFTTRSDIGPARDANDVSDDRHAPPAAKRTKKKDXXXXXXXXXXLNDSNYDEFSGYGGSLFSKDPYDKDDAEADAIYEAIDKRMDEKRKEYREKRLREELEKYRQERPKIQQQFSDLKRDLAQVTEDEWKTVPEVGDARNKKQRNPRAEEFTPLPDSVXXXXXXXXXXXXXXXXXXXXXXXXXXXXPGMLTPTGDMDLRKIGQARNTLMNVKLSQVSDSVTGQTVVDPKGYLTDLQSM

SEQ ID NO: 30985 - protein, 38 aa, Diabrotica virgifera
  misc_feature: Coding regions on vcDNA: vcDNA=SeqID_10682; Strand=+; Position=91-207
AEIYKALSLFFCTLHLMIYHRLTRYHMYYQNVWELHYE

SEQ ID NO: 30986 - protein, 134 aa, Diabrotica virgifera
  misc_feature: Coding regions on vcDNA: vcDNA=SeqID_10683; Strand=-; Position=826 -1230
  misc_feature (19)..(29): Xaa can be any naturally occurring amino acid
  misc_feature (35)..(42): Xaa can be any naturally occurring amino acid
  misc_feature (52)..(64): Xaa can be any naturally occurring amino acid
  misc_feature (124)..(124): Xaa can be any naturally occurring amino acid
  misc_feature (126)..(126): Xaa can be any naturally occurring amino acid
  misc_feature (133)..(133): Xaa can be any naturally occurring amino acid
NFYTKTGRRYFCGGGDCGXXXXXXXXXXXGGALSXXXXXXXXFLSKKMGELXXXXXXXXXXXXXHKNQPLFLFSRWLVSKKGTDFLGLHPSKYSSRLRVFYIWTSEVKIHYGIRATVFSVCLHXSXEHLVLIXI

SEQ ID NO: 30987 - protein, 254 aa, Diabrotica virgifera
  misc_feature: Coding regions on vcDNA: vcDNA=SeqID_10684; Strand=+; Position=60-824
  misc_feature: Homolog annotation: Hit_ID=EAL28180.1; Match level="QueryCoverage =100%, HitCoverage=100%, E-value=2e-97, Identity=71%"; Hit description=GA16317-PA [Drosophila pseudoobscura]
  misc_feature: Gene Ontology Annotation: Cellular component=mitochondrion
  misc_feature: Pfam annotation: Pfam_ID=adh_short; Match level="Score=274.9, E-value= 1.4e-79, Copies=1"; Pfam description=short chain dehydrogenase
MAFTGKVILITGASSGIGAATAKQFASLGATLALAGRNVDNLKQVASDCSTKSIPLLLQGELTNEKDTKAILDKTIEHFGRLDVLVNNAGILETGSIENTTLEQYDRLMNTNVRSVYHLSMLAVPHLVKTKGNIVNVSSVNGMRAFPNVLAYCMSKAAVDQFTRCVALELADKQVRVNSVNPGVTLTNLQKRGGMNDEQYEAFLQRTKDTHALGRPGNPDEVAKAITYLASEDASFITGASLPVDGGRHAMCPR

SEQ ID NO: 30988 - protein, 72 aa, Diabrotica virgifera
  misc_feature: Coding regions on vcDNA: vcDNA=SeqID_10685; Strand=+; Position=178-396
  misc_feature: Homolog annotation: Hit_ID=AAK94897.1; Match level="QueryCoverage =84%, HitCoverage=29%, E-value=1e-11, Identity=52%"; Hit description =mRNA cap-binding protein eIF4E [Spodoptera frugiperda]
MSRTTENLYNLLKTSNDIKQGNDYSLLKKGIKTMREDDANKRGGTRLLSLQKKQLNHDLHRSWLYTILEPHW

SEQ ID NO: 30989 - protein, 54 aa, Diabrotica virgifera
  misc_feature: Coding regions on vcDNA: vcDNA=SeqID_10686; Strand=-; Position=313-477
  misc_feature (9)..(15): Xaa can be any naturally occurring amino acid
  misc_feature (33)..(39): Xaa can be any naturally occurring amino acid
CQLLIKMSXXXXXXXPQFSETNFLRGIDSFKIXXXXXXXTSPTLGTKLQYNSEF

SEQ ID NO: 30990 - protein, 124 aa, Diabrotica virgifera
  misc_feature: Coding regions on vcDNA: vcDNA=SeqID_10687; Strand=-; Position=1-372
  misc_feature (6)..(17): Xaa can be any naturally occurring amino acid
  misc_feature (19)..(27): Xaa can be any naturally occurring amino acid
  misc_feature (35)..(41): Xaa can be any naturally occurring amino acid
  misc_feature (49)..(49): Xaa can be any naturally occurring amino acid
  misc_feature (52)..(52): Xaa can be any naturally occurring amino acid
  misc_feature (55)..(55): Xaa can be any naturally occurring amino acid
  misc_feature (60)..(62): Xaa can be any naturally occurring amino acid
  misc_feature (64)..(64): Xaa can be any naturally occurring amino acid
  misc_feature (66)..(67): Xaa can be any naturally occurring amino acid
  misc_feature (74)..(75): Xaa can be any naturally occurring amino acid
  misc_feature (78)..(85): Xaa can be any naturally occurring amino acid
  misc_feature (88)..(88): Xaa can be any naturally occurring amino acid
  misc_feature (90)..(90): Xaa can be any naturally occurring amino acid
  misc_feature (92)..(92): Xaa can be any naturally occurring amino acid
  misc_feature (95)..(98): Xaa can be any naturally occurring amino acid
  misc_feature (100)..(101): Xaa can be any naturally occurring amino acid
  misc_feature (103)..(107): Xaa can be any naturally occurring amino acid
  misc_feature (112)..(122): Xaa can be any naturally occurring amino acid
LPPLLXXXXXXXXXXXXPXXXXXXXXXPPLFFLLXXXXXXXLLSSFSSXPFXFLXPSFPXXXLXLXXLSSPSFXXLPXXXXXXXXLSXPXLXFLXXXXSXXLXXXXXLFRFXXXXXXXXXXXLL

SEQ ID NO: 30991 - protein, 66 aa, Diabrotica virgifera
  misc_feature: Coding regions on vcDNA: vcDNA=SeqID_10688; Strand=-; Position=1-198
  misc_feature (2)..(11): Xaa can be any naturally occurring amino acid
  misc_feature (27)..(27): Xaa can be any naturally occurring amino acid
  misc_feature (29)..(29): Xaa can be any naturally occurring amino acid
  misc_feature (33)..(40): Xaa can be any naturally occurring amino acid
  misc_feature (52)..(64): Xaa can be any naturally occurring amino acid
PXXXXXXXXXXIETNLAHTGLNSDHVXFXKSTXXXXXXXXPIINLIQHRGRXXXXXXXXXXXXXLL

SEQ ID NO: 30992 - protein, 73 aa, Diabrotica virgifera
  misc_feature: Coding regions on vcDNA: vcDNA=SeqID_10689; Strand=-; Position=3-221
  misc_feature (39)..(71): Xaa can be any naturally occurring amino acid
KSRPRFNKFRCPPQLKPLSHPGGRILYYRLDFPKKIRGXXXXXXXXXXXXXXXXXXXXXXXXXXXXXXXXXPQ

SEQ ID NO: 30993 - protein, 73 aa, Diabrotica virgifera
  misc_feature: Coding regions on vcDNA: vcDNA=SeqID_10690; Strand=-; Position=0-218
RKRTVKNSDPRNNVFVVKILYLQIELMMACYHIMYRSMTSLIQFPNIFLHIFILHKMYAGLGVMNRIVSNLVS

SEQ ID NO: 30994 - protein, 44 aa, Diabrotica virgifera
  misc_feature: Coding regions on vcDNA: vcDNA=SeqID_10691; Strand=-; Position=37-171
  misc_feature (1)..(7): Xaa can be any naturally occurring amino acid
  misc_feature (22)..(31): Xaa can be any naturally occurring amino acid
XXXXXXXSFNKKSKNKNEFIMXXXXXXXXXXAILNPEKLYNIYY

SEQ ID NO: 30995 - protein, 18 aa, Diabrotica virgifera
  misc_feature: Coding regions on vcDNA: vcDNA=SeqID_10692; Strand=-; Position=1-54
  misc_feature (1)..(11): Xaa can be any naturally occurring amino acid
  misc_feature (13)..(18): Xaa can be any naturally occurring amino acid
XXXXXXXXXXXSXXXXXX

SEQ ID NO: 30996 - protein, 25 aa, Diabrotica virgifera
  misc_feature: Coding regions on vcDNA: vcDNA=SeqID_10693; Strand=-; Position=19-96
KMSKFVEQCRRIVGRNHRISEIIGL

SEQ ID NO: 30997 - protein, 85 aa, Diabrotica virgifera
  misc_feature: Coding regions on vcDNA: vcDNA=SeqID_10694; Strand=-; Position=190-447
  misc_feature (17)..(23): Xaa can be any naturally occurring amino acid
IPYHISYIITPYSQISXXXXXXXYLKFSLPRRQYIITITIDNIERYGIHIRRDIIHCRLHMSCHDVQNFPQGIWKVCIIHTCISK

SEQ ID NO: 30998 - protein, 23 aa, Diabrotica virgifera
  misc_feature: Coding regions on vcDNA: vcDNA=SeqID_10695; Strand=-; Position=0-68
  misc_feature (1)..(16): Xaa can be any naturally occurring amino acid
  misc_feature (18)..(18): Xaa can be any naturally occurring amino acid
  misc_feature (20)..(22): Xaa can be any naturally occurring amino acid
XXXXXXXXXXXXXXXXLXIXXXT

SEQ ID NO: 30999 - protein, 237 aa, Diabrotica virgifera
  misc_feature: Coding regions on vcDNA: vcDNA=SeqID_10696; Strand=+; Position=14-727
  misc_feature: Homolog annotation: Hit_ID=EAA07709.3; Match level="QueryCoverage =100%, HitCoverage=100%, E-value=5e-89, Identity=67%"; Hit description=ENSANGP00000016225 [Anopheles gambiae str. PEST] ref|XP _563331.1| ENSANGP00000016225 [Anopheles gambiae
  misc_feature: Gene Ontology Annotation: Molecular function=molecular_function unknown; Cellular component=cellular_component unknown; Biological process=biological_process unknown
  misc_feature: Pfam annotation: Pfam_ID=Mra1; Match level="Score=283.4, E-value=3.7e- 82, Copies=1"; Pfam description=Suppressor Mra1
MSRKRKLSKNKQDEFEFDPIPKHLVVAHLKDQEKRLIIILEGAQLETVKVRDKFELLNCDDHLHILKSNNRDVGSCRPDITHQCLLMLFDSPLNRAGLLQVYVHTANNILIEINPQTRIPRTFKRFSGLMVQLLHKFSVRADDGPKLLKVIKNPVTDHLPVGVKKICTSFAAKQVHNCKELVPKNEEPIVFVIGALARGNVNVDYTEDTVSISNYPLSAALTCTKLCSAFEEVWNVI

SEQ ID NO: 31000 - protein, 61 aa, Diabrotica virgifera
  misc_feature: Coding regions on vcDNA: vcDNA=SeqID_10697; Strand=-; Position=1-183
  misc_feature (6)..(6): Xaa can be any naturally occurring amino acid
  misc_feature (10)..(60): Xaa can be any naturally occurring amino acid
QKKLDXKNYXXXXXXXXXXXXXXXXXXXXXXXXXXXXXXXXXXXXXXXXXXXXXXXXXXXF

SEQ ID NO: 31001 - protein, 86 aa, Diabrotica virgifera
  misc_feature: Coding regions on vcDNA: vcDNA=SeqID_10698; Strand=-; Position=3-260
  misc_feature (1)..(21): Xaa can be any naturally occurring amino acid
  misc_feature (25)..(35): Xaa can be any naturally occurring amino acid
  misc_feature (45)..(53): Xaa can be any naturally occurring amino acid
  misc_feature (73)..(85): Xaa can be any naturally occurring amino acid
XXXXXXXXXXXXXXXXXXXXXALWXXXXXXXXXXXPTCSPPGFNXXXXXXXXXTDLIIYCYNNYKLYPTSRSXXXXXXXXXXXXXC

SEQ ID NO: 31002 - protein, 162 aa, Diabrotica virgifera
  misc_feature: Coding regions on vcDNA: vcDNA=SeqID_10699; Strand=+; Position=3-491
  misc_feature (4)..(114): Xaa can be any naturally occurring amino acid
  misc_feature (125)..(157): Xaa can be any naturally occurring amino acid
DAWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMMIKLVLINCXXXXXXXXXXXXXXXXXXXXXXXXXXXXXXXXXRLPTD

SEQ ID NO: 31003 - protein, 129 aa, Diabrotica virgifera
  misc_feature: Coding regions on vcDNA: vcDNA=SeqID_10700; Strand=-; Position=64-453
  misc_feature (58)..(80): Xaa can be any naturally occurring amino acid
  misc_feature (95)..(110): Xaa can be any naturally occurring amino acid
  misc_feature (113)..(125): Xaa can be any naturally occurring amino acid
AQSPCPAGRPGCRRDSIRHAHNQQVKKLVPKSLPNPVIIPKIFYYIFLILTPILSSYXXXXXXXXXXXXXXXXXXXXXXXTYIITCYLISLFFIXXXXXXXXXXXXXXXXSIXXXXXXXXXXXXXLLII

SEQ ID NO: 31004 - protein, 177 aa, Diabrotica virgifera
  misc_feature: Coding regions on vcDNA: vcDNA=SeqID_10701; Strand=+; Position=330-860
  misc_feature: Pfam annotation: Pfam_ID=THAP; Match level="Score=-12.8, E-value =0.092, Copies=1"; Pfam description=THAP domain
ILWLKAAIREDLLSKDVNELHKNYRMCEKHFQPHFISKGGNVRKNLFIQAHPTIFPYNQDVQSADEPLRKIIRLETQIEDKTEIDIMQPVANKTDASHSMHSIPDTLMEESLVTDVDVNTEVSTRPHTPAHTVSTQTPPKLSSSSPRKVKLKCKSDMCDKLLQPLAQIVKSSALLKS

SEQ ID NO: 31005 - protein, 44 aa, Diabrotica virgifera
  misc_feature: Coding regions on vcDNA: vcDNA=SeqID_10702; Strand=+; Position=259-393
PTFYILKICKYVCQYHNFNNSRKSCCNKLGLKYYRIYRYIIYYT

SEQ ID NO: 31006 - protein, 172 aa, Diabrotica virgifera
  misc_feature: Coding regions on vcDNA: vcDNA=SeqID_10703; Strand=+; Position=59-574
  misc_feature (30)..(36): Xaa can be any naturally occurring amino acid
NAHINMESISVSANINPTIIEPPVISSNDXXXXXXXGGENEGDTTIHAFNMSASQFHITVVENPALKKSSQCEGSDSGVEVVENVENQDPVVYQRNISSNSGMSQDYDNINSARSCDSSIISCYDEAYNILVRKNSTLLEDYRRHEDVTSENGSESSSLSGSNVRTNRRTSV

SEQ ID NO: 31007 - protein, 105 aa, Diabrotica virgifera
  misc_feature: Coding regions on vcDNA: vcDNA=SeqID_10704; Strand=-; Position=1-315
  misc_feature (3)..(10): Xaa can be any naturally occurring amino acid
  misc_feature (15)..(48): Xaa can be any naturally occurring amino acid
  misc_feature (50)..(105): Xaa can be any naturally occurring amino acid
FEXXXXXXXXCFSLXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXX

SEQ ID NO: 31008 - protein, 84 aa, Diabrotica virgifera
  misc_feature: Coding regions on vcDNA: vcDNA=SeqID_10705; Strand=-; Position=2-253
  misc_feature (23)..(81): Xaa can be any naturally occurring amino acid
GWPNPYYRFGLLQLKITPVSPKXXXXXXXXXXXXXXXXXXXXXXXXXXXXXXXXXXXXXXXXXXXXXXXXXXXXXXXXXXXLSS

SEQ ID NO: 31009 - protein, 94 aa, Diabrotica virgifera
  misc_feature: Coding regions on vcDNA: vcDNA=SeqID_10706; Strand=-; Position=2-283
  misc_feature (3)..(79): Xaa can be any naturally occurring amino acid
  misc_feature (85)..(93): Xaa can be any naturally occurring amino acid
KMXXXXXXXXXXXXXXXXXXXXXXXXXXXXXXXXXXXXXXXXXXXXXXXXXXXXXXXXXXXXXXXXXXXXXXXXXXXXXIQPPPXXXXXXXXXI

SEQ ID NO: 31010 - protein, 54 aa, Diabrotica virgifera
  misc_feature: Coding regions on vcDNA: vcDNA=SeqID_10707; Strand=-; Position=3-164
  misc_feature (8)..(15): Xaa can be any naturally occurring amino acid
  misc_feature (38)..(54): Xaa can be any naturally occurring amino acid
MPGPLQIXXXXXXXXLLNTKKTMFFVTQGKKNAAEIPXXXXXXXXXXXXXXXXX

SEQ ID NO: 31011 - protein, 92 aa, Diabrotica virgifera
  misc_feature: Coding regions on vcDNA: vcDNA=SeqID_10708; Strand=-; Position=2-277
  misc_feature (14)..(26): Xaa can be any naturally occurring amino acid
  misc_feature (29)..(39): Xaa can be any naturally occurring amino acid
  misc_feature (49)..(56): Xaa can be any naturally occurring amino acid
  misc_feature (59)..(72): Xaa can be any naturally occurring amino acid
  misc_feature (78)..(91): Xaa can be any naturally occurring amino acid
LCCYFYAYIDYFLXXXXXXXXXXXXXPFXXXXXXXXXXXTNLAHTGLNXXXXXXXXSNXXXXXXXXXXXXXXPTSRSXXXXXXXXXXXXXXV

SEQ ID NO: 31012 - protein, 267 aa, Diabrotica virgifera
  misc_feature: Coding regions on vcDNA: vcDNA=SeqID_10709; Strand=+; Position=40-842
  misc_feature: Homolog annotation: Hit_ID=XP_311836.1; Match level="QueryCoverage =97%, HitCoverage=55%, E-value=1e-60, Identity=39%"; Hit description =ENSANGP00000017608 [Anopheles gambiae]
  misc_feature: Gene Ontology Annotation: Molecular function=organic cation transporter activity; Cellular component=integral to plasma membrane; Biological process=organic cation transport
  misc_feature (244)..(244): Xaa can be any naturally occurring amino acid
  misc_feature (250)..(250): Xaa can be any naturally occurring amino acid
METEEKQNEASGLLQTVQNGKEKETATPIIQKCIGVLGRWHIWLCFIIFLVKFGVSWHQLSIVFLAPPIKYYCINNATETCLSNCTHYLYDTFGRKLPLVLAVALQGLSGLGAAFSPWFTLFIILKFLSAVATGGTMITSFVLIMEIIGTEWRTVLGILYQIPFNLGHLLMPLFSYYLRNWRHFQIMISVPSLFLISYYWILPESPRWQLAVGKEKQAIETLKKAARRNKLPTEKIEHDVNLYXRTQTSXSKGSSSGNILDLVRRRL

SEQ ID NO: 31013 - protein, 67 aa, Diabrotica virgifera; identical to SEQ ID NO: 28735
  misc_feature: Coding regions on vcDNA: vcDNA=SeqID_10710; Strand=-; Position=2-202
  misc_feature (4)..(14): Xaa can be any naturally occurring amino acid
  misc_feature (24)..(31): Xaa can be any naturally occurring amino acid
  misc_feature (34)..(47): Xaa can be any naturally occurring amino acid
  misc_feature (53)..(66): Xaa can be any naturally occurring amino acid

SEQ ID NO: 31014 - protein, 216 aa, Diabrotica virgifera
  misc_feature: Coding regions on vcDNA: vcDNA=SeqID_10711; Strand=-; Position=115-765
  misc_feature: Homolog annotation: Hit_ID=NP_611140.3; Match level="QueryCoverage =96%, HitCoverage=40%, E-value=2e-49, Identity=43%"; Hit description =CG8306-PA [Drosophila melanogaster] gb|AAF57977.2| CG8306-PA [Drosophila melanogaster]
  misc_feature: Pfam annotation: Pfam_ID=Sterile; Match level="Score=70.8, E-value =3.9e-18, Copies=1"; Pfam description=Male sterility protein
MLVIPKHKVEVYHATSSTREPFRWSSVENKITEYLHKYPLKSAVWYPHLKFLPTITWYKVSAFFVHFFPAILLDTVTRLTGGRPILMKLHRNVNNSLGMLSKFIFTEWTFPAVKTVELQNWLTKSDQQEFNVDLQGLCWPEYFVDLTLGARVYLNKDPRKTLDAARSKDKVLLVIHILWHLMIFSLLWYIFASITGMTMSASIFIVPLLHILFQML

SEQ ID NO: 31015 - protein, 80 aa, Diabrotica virgifera
  misc_feature: Coding regions on vcDNA: vcDNA=SeqID_10712; Strand=-; Position=2-244
  misc_feature (13)..(22): Xaa can be any naturally occurring amino acid
  misc_feature (26)..(57): Xaa can be any naturally occurring amino acid
  misc_feature (60)..(61): Xaa can be any naturally occurring amino acid
  misc_feature (64)..(64): Xaa can be any naturally occurring amino acid
  misc_feature (67)..(67): Xaa can be any naturally occurring amino acid
  misc_feature (69)..(69): Xaa can be any naturally occurring amino acid
  misc_feature (71)..(79): Xaa can be any naturally occurring amino acid
LLPLKFTLLFLSXXXXXXXXXXIKKXXXXXXXXXXXXXXXXXXXXXXXXXXXXXXXXKNXXLIXYKXLXGXXXXXXXXXF

SEQ ID NO: 31016 - protein, 94 aa, Diabrotica virgifera
  misc_feature: Coding regions on vcDNA: vcDNA=SeqID_10713; Strand=-; Position=251-535
LHRRRIKENLKNRAKLHSIGSWNGPAYSPDLNPIEQLWDELKQRIRVRRHTPNSIPELIDAVEEEWLNIPQETTANLIRSTPNHMREVINAGRG

SEQ ID NO: 31017 - protein, 203 aa, Diabrotica virgifera
  misc_feature: Coding regions on vcDNA: vcDNA=SeqID_10714; Strand=+; Position=76-687
EVLSVMTVEVKFSSRSTIMKRFLVIAVVFILFSITESSVKHENGCLDNICYKDNTYPHKEIEIMWKSSSNKLTKTFGDIQHVSDNENDELVSKATCELCPTSIRSKVQILSIIGDNNMRLYIARTSKYHPEIRVEVCGDEAKCNPKDKRDNYETFCQQQTSTISLLAYNKTSKQFQTHQVDYPSGCECVLSVSDPPTRNIPKN

SEQ ID NO: 31018 - protein, 58 aa, Diabrotica virgifera
  misc_feature: Coding regions on vcDNA: vcDNA=SeqID_10715; Strand=-; Position=159-335
GSPSIITTDVPSGEYHESFHPIIHSFLYAGLTGKREIFQKSLSNYCTLNSTATFLKDF

SEQ ID NO: 31019 - protein, 265 aa, Diabrotica virgifera
  misc_feature: Coding regions on vcDNA: vcDNA=SeqID_10716; Strand=-; Position=1-795
  misc_feature (3)..(265): Xaa can be any naturally occurring amino acid
LVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31020 - protein, 246 aa, Diabrotica virgifera
  misc_feature: Coding regions on vcDNA: vcDNA=SeqID_10717; Strand=+; Position=29-769
  misc_feature: Homolog annotation: Hit_ID=XP_396489.1; Match level="QueryCoverage =85%, HitCoverage=64%, E-value=3e-20, Identity=29%"; Hit description =similar to ENSANGP00000015774 [Apis mellifera]
  misc_feature: Pfam annotation: Pfam_ID=dsrm; Match level="Score=59.4, E-value=9.8e -15, Copies=1"; Pfam description=Double-stranded RNA binding motif
MREFKASIIQKQCELDAGAAIPSSVNFVAPLKDICAEKKIQDPVFKELSDVGPPHCREFTYECGIGSVKTVATSTTKKMAKQLAAREMLEKLNDILQDLLLECPREEEEFEQLPSTIRDRMCAESALNQKILHRYNKLFGQVIPNKKGKLKDFSTCFRELLNKFEKTRDDFVEDLCEKTEESLVRILDKMELQHDVIAVQEGIPIIVCLCINTDVSLTTSGVGQTFKEAKEEALETAFMMLDMYIE

SEQ ID NO: 31021 - protein, 182 aa, Diabrotica virgifera
  misc_feature: Coding regions on vcDNA: vcDNA=SeqID_10718; Strand=+; Position=1-544
  misc_feature: Homolog annotation: Hit_ID=AAD40314.1; Match level="QueryCoverage =80%, HitCoverage=38%, E-value=2e-24, Identity=45%"; Hit description =actin [Mytilus galloprovincialis]
  misc_feature: Gene Ontology Annotation: Biological process=reproduction
  misc_feature (57)..(57): Xaa can be any naturally occurring amino acid
  misc_feature (80)..(80): Xaa can be any naturally occurring amino acid
  misc_feature (101)..(101): Xaa can be any naturally occurring amino acid
  misc_feature (108)..(108): Xaa can be any naturally occurring amino acid
  misc_feature (142)..(142): Xaa can be any naturally occurring amino acid
  misc_feature (155)..(155): Xaa can be any naturally occurring amino acid
GETTKQRDWARTREPRRARGGRTRKEERRGRNRTNAGSKRKQGDTGGRGRTETHARXEAQSKTAKRTEEDPREDRPITKXDVMNRIGHLTIDNELREAPEXHPIHIIXAPLNTKAHIINMTQILLETFNTHVMRISMHCALXSLYACGRTTGFVXYSDHDVKRSVQSYQGYALLHKNLCPDM

SEQ ID NO: 31022 - protein, 260 aa, Diabrotica virgifera
  misc_feature: Coding regions on vcDNA: vcDNA=SeqID_10719; Strand=+; Position=114-893
  misc_feature: Homolog annotation: Hit_ID=XP_320408.1; Match level="QueryCoverage =88%, HitCoverage=41%, E-value=4e-77, Identity=63%"; Hit description =ENSANGP00000016946 [Anopheles gambiae]
  misc_feature: Gene Ontology Annotation: Molecular function=molecular_function unknown; Cellular component=nucleoplasm; Biological process=cell organization and biogenesis
  misc_feature: Pfam annotation: Pfam_ID=RIO1; Match level="Score=16.6, E-value=3.4e -08, Copies=1"; Pfam description=RIO1 family
  misc_feature (140)..(146): Xaa can be any naturally occurring amino acid
  misc_feature (216)..(216): Xaa can be any naturally occurring amino acid
  misc_feature (231)..(235): Xaa can be any naturally occurring amino acid
MSSLTEEELFCDAEEEDQILIEKVKIKSDEEYAGDDYDDDYEDDIDYNTDEEYWQQNSSHSNQQQSSGKVSNYQPSENLFKKYTHKINVEKYEVNALPQHTTNLLMENQKRMENERNRTKDKHDRATAEQVMDPRTRMIXXXXXXXNLISEINGCISTGKEANVYHASSKTDQDFAIKIYKTSILVFKDRDKYVSGEFRFRHGYCKHNPRKMVRTXAEKEMRNLVRMHSNXXXXXEPILLRSHVLVMTFIGKEGWPAPKL

SEQ ID NO: 31023 - protein, 247 aa, Diabrotica virgifera
  misc_feature: Coding regions on vcDNA: vcDNA=SeqID_10720; Strand=+; Position=80-823
  misc_feature: Homolog annotation: Hit_ID=AAL60239.1; Match level="QueryCoverage =96%, HitCoverage=95%, E-value=4e-19, Identity=29%"; Hit description =takeout [Aedes aegypti]
  misc_feature: Gene Ontology Annotation: Molecular function=molecular_function unknown; Biological process=male courtship behavior
  misc_feature: Pfam annotation: Pfam_ID=DUF233; Match level="Score=85.4, E-value =1.5e-22, Copies=1"; Pfam description=Odorant binding protein
  misc_feature (211)..(211): Xaa can be any naturally occurring amino acid
MTRFFICAIICLFANVVIASKSLPSYITPCKKTDPKLSECAKQRAIEALPSLIKGDRAYKIPSFDPYVIPAVETSGTSGINLNLKNLRLSGLDTTVIRAVKVDLKNNQIVVDVFIPETRTEADYTVAGKLFAIDINGEGPASIRGENSSVICTVDYKLITKKDGKRYVDPDTLKSHLDLNVDKTHYHFGNLFGGNKVLEDSFNNVLNENSXEVDDISKETNRSIVSSIVVTVLKSIFRVPFDDIFVD

SEQ ID NO: 31024 - protein, 20 aa, Diabrotica virgifera
  misc_feature: Coding regions on vcDNA: vcDNA=SeqID_10721; Strand=-; Position=17-79
IYIFKIYNVLILHVIILTKF

SEQ ID NO: 31025 - protein, 305 aa, Diabrotica virgifera
  misc_feature: Coding regions on vcDNA: vcDNA=SeqID_10722; Strand=-; Position=3-917
  misc_feature (3)..(14): Xaa can be any naturally occurring amino acid
  misc_feature (40)..(305): Xaa can be any naturally occurring amino acid
RTXXXXXXXXXXXXIQHRGRNLYYRFDFSNKNTLLSLRVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31026 - protein, 79 aa, Diabrotica virgifera
  misc_feature: Coding regions on vcDNA: vcDNA=SeqID_10723; Strand=-; Position=121-360
SEYGPVLFQRYQAPLSSLGRLCYVYLALHKLQVGPKPPRSGDRSPISEDDFCAVDSSLPRVERICTLNHFQKHRSHVVP

SEQ ID NO: 31027 - protein, 93 aa, Diabrotica virgifera
  misc_feature: Coding regions on vcDNA: vcDNA=SeqID_10724; Strand=-; Position=178-459
  misc_feature (29)..(88): Xaa can be any naturally occurring amino acid
YWSINVFLITNGLITCIALFVICKLNLDXXXXXXXXXXXXXXXXXXXXXXXXXXXXXXXXXXXXXXXXXXXXXXXXXXXXXXXXXXXXKNKLP

SEQ ID NO: 31028 - protein, 318 aa, Diabrotica virgifera
  misc_feature: Coding regions on vcDNA: vcDNA=SeqID_10725; Strand=+; Position=23-976
  misc_feature: Homolog annotation: Hit_ID=AAF87756.1; Match level="QueryCoverage =99%, HitCoverage=72%, E-value=1e-117, Identity=71%"; Hit description= cytochrome oxidase subunit I [Diabrotica lemniscata]
  misc_feature: Pfam annotation: Pfam_ID=COX1; Match level="Score=144.3, E-value=2.8e- 40, Copies=1"; Pfam description=Cytochrome C and Quinol oxidase polyp
  misc_feature (3)..(3): Xaa can be any naturally occurring amino acid
  misc_feature (30)..(30): Xaa can be any naturally occurring amino acid
  misc_feature (75)..(83): Xaa can be any naturally occurring amino acid
  misc_feature (87)..(93): Xaa can be any naturally occurring amino acid
  misc_feature (104)..(111): Xaa can be any naturally occurring amino acid
  misc_feature (132)..(132): Xaa can be any naturally occurring amino acid
  misc_feature (167)..(167): Xaa can be any naturally occurring amino acid
  misc_feature (184)..(184): Xaa can be any naturally occurring amino acid
  misc_feature (187)..(193): Xaa can be any naturally occurring amino acid
  misc_feature (220)..(226): Xaa can be any naturally occurring amino acid
  misc_feature (240)..(240): Xaa can be any naturally occurring amino acid
  misc_feature (248)..(264): Xaa can be any naturally occurring amino acid
  misc_feature (294)..(294): Xaa can be any naturally occurring amino acid
  misc_feature (310)..(310): Xaa can be any naturally occurring amino acid
PLXGAINSITTVINIRPIGITFDRIPLFVXAVVITAILLLLSLPVLAGAITILLTDRNLNTSFFDPAGGGDPILXXXXXXXXXHPEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIESLISLMGVXKKLFLFNE

SEQ ID NO: 31029 - protein, 240 aa, Diabrotica virgifera
  misc_feature: Coding regions on vcDNA: vcDNA=SeqID_10726; Strand=-; Position=107-829
  misc_feature: Homolog annotation: Hit_ID=NP_727555.1; Match level="QueryCoverage =99%, HitCoverage=39%, E-value=3e-35, Identity=35%"; Hit description =CG1841-PB, isoform B [Drosophila melanogaster] ref|NP_572743.1| CG1841-PA, isoform A [Drosophila
LKKFLTFIRFPMMSPRELADLVLSPVLKLHKEFYMDRMSISMNYHSGYTELIKQYFNTDEGKRLFTPRLYTCDSCSALLTIDNFNSIPNYHTSTFVFSSCLSTAEHQSGNINEWLVDLYPKGVWFKKCFLIVWQGTLEVPEEILTTVRLSLTSRELSESTSRVKISVLIYGMQGGVEHVMEVKEVIHHFSDQDRTVNIDNLIPFYELNKQAASQDQSEPVYLVGPNRDSLKLNLVIAPVT

SEQ ID NO: 31030 - protein, 154 aa, Diabrotica virgifera
  misc_feature: Coding regions on vcDNA: vcDNA=SeqID_10727; Strand=+; Position=103-565
  misc_feature: Homolog annotation: Hit_ID=NP_524297.1; Match level="QueryCoverage =100%, HitCoverage=34%, E-value=1e-36, Identity=54%"; Hit description= CG9476-PA [Drosophila melanogaster] gb|AAF54433.1| CG9476-PA [Drosophila melanogaster]
  misc_feature: Gene Ontology Annotation: Molecular function=GTP binding; Cellular component=microtubule; Biological process=microtubule-based process
  misc_feature (23)..(23): Xaa can be any naturally occurring amino acid
  misc_feature (35)..(35): Xaa can be any naturally occurring amino acid
  misc_feature (46)..(46): Xaa can be any naturally occurring amino acid
  misc_feature (60)..(60): Xaa can be any naturally occurring amino acid
  misc_feature (62)..(62): Xaa can be any naturally occurring amino acid
  misc_feature (107)..(107): Xaa can be any naturally occurring amino acid
  misc_feature (115)..(115): Xaa can be any naturally occurring amino acid
  misc_feature (145)..(145): Xaa can be any naturally occurring amino acid
AGVQIGNARWELNWQKHGIQPDXHMPSYFTVCRKXESCKTDNSETXAGKHVPTAVFVNVXHXTINEKPTESYRDEFHPELLFPGEKEAASRYTTGHYTFGKEIIRLXVLDLIPKXLINVSGLQRLPIFYSFKGANECGLTSLLMXRISDDYGKK

SEQ ID NO: 31031 - protein, 317 aa, Diabrotica virgifera
  misc_feature: Coding regions on vcDNA: vcDNA=SeqID_10728; Strand=+; Position=1-955
  misc_feature: Homolog annotation: Hit_ID=XP_317731.1; Match level="QueryCoverage =98%, HitCoverage=40%, E-value=1e-127, Identity=72%"; Hit description= ENSANGP00000010297 [Anopheles gambiae]
  misc_feature: Gene Ontology Annotation: Molecular function=enoyl-CoA hydratase activity; Cellular component=mitochondrion; Biological process=growth
  misc_feature: Pfam annotation: Pfam_ID=3HCDH; Match level="Score=130.4, E-value =4.2e-36, Copies=1"; Pfam description=3-hydroxyacyl-CoA dehydrogenase, C-te
  misc_feature (281)..(281): Xaa can be any naturally occurring amino acid
DINIKHKVLKEVESVVKPDCIFATNTSALPISQIAVASKRPENVIGMHYFSPVDKMQLLEIITTDKTSKEATAIAVDIGLKQGKVVITVGDGPGFYTTRILSAMMAESIRLLQEGVDPKDLDSLTKKFGFPVGAATLADEVGLDVAAHIGPNLAQAFGERFSGGDLGVMRDIVQAGFLGRKSGKGVYIYEKGSKNRDVNAEALEIVKKYSLEPRGSFEDEDKTLRMVTRFVNEAVLCLEEKILANPLEGDIGAVFGLGFPPFTGGPFRWVDQYGAAKLVSXMEKLRNVPTGLPFQPAQTLIDMAKDPSKKIHPKVPS

SEQ ID NO: 31032 - protein, 93 aa, Diabrotica virgifera
  misc_feature: Coding regions on vcDNA: vcDNA=SeqID_10729; Strand=+; Position=3-284
KVFYDDICINDIRVLYSLMVRYRKLYISYKTRRRAIGRQSDENPAMYKYLFCVINKGKETRASHNYQPIGNRFKLPTISKTSHGRSCAQKLST

SEQ ID NO: 31033 - protein, 52 aa, Diabrotica virgifera
  misc_feature: Coding regions on vcDNA: vcDNA=SeqID_10730; Strand=+; Position=3-161
  misc_feature (6)..(6): Xaa can be any naturally occurring amino acid
  misc_feature (11)..(17): Xaa can be any naturally occurring amino acid
ITNSMXGVLMXXXXXXXLRTSTFYSNMTSNIVAITLTPMGQRSQVHKECRKM

SEQ ID NO: 31034 - protein, 70 aa, Diabrotica virgifera
  misc_feature: Coding regions on vcDNA: vcDNA=SeqID_10731; Strand=+; Position=236-448
TVSPHLSPEGNAVSAAYSAVSISHNGSTTPLPLPLLTISILKYTNTNLNAYAKKRIRMYTRQNTRMVLPP

SEQ ID NO: 31035 - protein, 67 aa, Diabrotica virgifera
  misc_feature: Coding regions on vcDNA: vcDNA=SeqID_10732; Strand=+; Position=735-935
  misc_feature (27)..(32): Xaa can be any naturally occurring amino acid
  misc_feature (49)..(49): Xaa can be any naturally occurring amino acid
GVTSYVVVSVNVLISSFRKIYLFHQVXXXXXXLFSVHTMKLRQKSIVLXKHKNLQHELSPLNCNIIT

SEQ ID NO: 31036 - protein, 101 aa, Diabrotica virgifera
  misc_feature: Coding regions on vcDNA: vcDNA=SeqID_10733; Strand=-; Position=737 -1042
  misc_feature (95)..(95): Xaa can be any naturally occurring amino acid
KKNGVKSQIIEFFEVWLKNFPFSTTHYFKSALFCTVFMLANLIFSHSIRYLTLVCRKVTFLCRKVTFLCRKVLFCTVDYLILSNVIFCLHPWLNXRQIYNL

SEQ ID NO: 31037 - protein, 303 aa, Diabrotica virgifera
  misc_feature: Coding regions on vcDNA: vcDNA=SeqID_10734; Strand=+; Position=40-948
  misc_feature: Homolog annotation: Hit_ID=XP_395067.1; Match level="QueryCoverage =92%, HitCoverage=12%, E-value=4e-60, Identity=36%"; Hit description =similar to hemolectin [Apis mellifera]
  misc_feature: Gene Ontology Annotation: Molecular function=ATP binding; Cellular component=extracellular space; Biological process=blood coagulation
  misc_feature: Pfam annotation: Pfam_ID=F5_F8_type_C; Match level="Score=119.0, E -value=1.1e-32, Copies=1"; Pfam description=F5/8 type C domain
MQTSTTLTAKPTRHTTRPTHRTRRPTTRHSTTTHRPTTIIVHTTVAPQICDDPMGLSEGNLSLSQISVSSSVDVRHDKASLPLNSESAWQPLTNSPTEWIVVDFLEPRELTGLTTKGGPDGWVENYVVEYSHDGINWNKVMYEQKERIFPGNFNQNLPQVNYFELPIMARYLKVIPKKWKNTIQMRLEVQGCYLPYPTTTPEEVTPSTTTTAYECNYCPGVIDTNVELDVCKCLPTKYWDGQRCVDRPECPCVVGVVKYPVGAVFEKEDCSECVCKLGGVEYCEPKKCHPCGPMRSTVTATCA

SEQ ID NO: 31038 - protein, 216 aa, Diabrotica virgifera
  misc_feature: Coding regions on vcDNA: vcDNA=SeqID_10735; Strand=+; Position=153-802
  misc_feature: Homolog annotation: Hit_ID=NP_651005.1; Match level="QueryCoverage =100%, HitCoverage=38%, E-value=8e-49, Identity=45%"; Hit description= CG6015-PA [Drosophila melanogaster] gb|AAF55949.1| CG6015-PA [Drosophila melanogaster]
  misc_feature: Gene Ontology Annotation: Cellular component=spliceosome complex; Biological process=mRNA splicing
  misc_feature (194)..(194): Xaa can be any naturally occurring amino acid
MLALQQYSGSSDEDDTDNNKNKDTSVDITEIPINSEFSTKNKLAICAAPNVLPTGLDGEKNHIHPDSGELTYNPKYDILFAPVVGPANPFKTQQQSVERNILSGHIEKAHVSDFQFENQRRTFTSYGYALDPSISNDGDGHLKVVGSTEEGKNVESVKTVFETSKIRPLDKRKRKRNDNPGDIEGFLGPWGGFXMNKKVSRPTEEEQAELNEITSK

SEQ ID NO: 31039 - protein, 52 aa, Diabrotica virgifera
  misc_feature: Coding regions on vcDNA: vcDNA=SeqID_10736; Strand=-; Position=63-221
  misc_feature (31)..(37): Xaa can be any naturally occurring amino acid
IDVTIPEAGSLHILAPWHLISLVQSPNTTSXXXXXXXSIAITNISVSTNYKL

SEQ ID NO: 31040 - protein, 74 aa, Diabrotica virgifera
  misc_feature: Coding regions on vcDNA: vcDNA=SeqID_10737; Strand=+; Position=401-622
  misc_feature (30)..(30): Xaa can be any naturally occurring amino acid
MMIEEFAVTSIRNEPREDGIYNFEVYLICXLLTGLYKILSVLLTHGDVIDKIAENYKPIARRSPFVRRYLQRRA

SEQ ID NO: 31041 - protein, 23 aa, Diabrotica virgifera
  misc_feature: Coding regions on vcDNA: vcDNA=SeqID_10738; Strand=+; Position=3-74
WTIYYIVNHSFYIKKVLDNILYS

SEQ ID NO: 31042 - protein, 35 aa, Diabrotica virgifera
  misc_feature: Coding regions on vcDNA: vcDNA=SeqID_10739; Strand=-; Position=2-106
  misc_feature (31)..(35): Xaa can be any naturally occurring amino acid
EQWRSRQNTIHLIISFVGYLFYDKNSNKLAXXXXX

SEQ ID NO: 31043 - protein, 181 aa, Diabrotica virgifera
  misc_feature: Coding regions on vcDNA: vcDNA=SeqID_10740; Strand=-; Position=732 -1277
  misc_feature (1)..(16): Xaa can be any naturally occurring amino acid
  misc_feature (18)..(31): Xaa can be any naturally occurring amino acid
  misc_feature (36)..(45): Xaa can be any naturally occurring amino acid
  misc_feature (53)..(97): Xaa can be any naturally occurring amino acid
  misc_feature (100)..(112): Xaa can be any naturally occurring amino acid
  misc_feature (115)..(122): Xaa can be any naturally occurring amino acid
  misc_feature (133)..(134): Xaa can be any naturally occurring amino acid
  misc_feature (140)..(140): Xaa can be any naturally occurring amino acid
  misc_feature (151)..(151): Xaa can be any naturally occurring amino acid
  misc_feature (169)..(175): Xaa can be any naturally occurring amino acid
XXXXXXXXXXXXXXXXSXXXXXXXXXXXXXXGLGGXXXXXXXXXXRGGGKVPXXXXXXXXXXXXXXXXXXXXXXXXXXXXXXXXXXXXXXXXXXXXXGFXXXXXXXXXXXXXCVXXXXXXXXWFFRIWKKMNXXCRCNIXQICLCLKTHSXRNIIMSAYIVSQTLTIQXXXXXXXIASGIF

SEQ ID NO: 31044 - protein, 135 aa, Diabrotica virgifera
  misc_feature: Coding regions on vcDNA: vcDNA=SeqID_10741; Strand=+; Position=37-443
  misc_feature: Homolog annotation: Hit_ID=XP_311994.1; Match level="QueryCoverage =94%, HitCoverage=26%, E-value=3e-25, Identity=51%"; Hit description =ENSANGP00000018558 [Anopheles gambiae]
  misc_feature: Gene Ontology Annotation: Molecular function=pre-mRNA splicing factor activity; Cellular component=nucleus; Biological process=mRNA processing
  misc_feature (26)..(26): Xaa can be any naturally occurring amino acid
  misc_feature (71)..(71): Xaa can be any naturally occurring amino acid
  misc_feature (88)..(88): Xaa can be any naturally occurring amino acid
  misc_feature (95)..(95): Xaa can be any naturally occurring amino acid
  misc_feature (104)..(104): Xaa can be any naturally occurring amino acid
HRRRSTSRRRVRERFRCSSPINNSPXHSAYSGKREPSLYWDVAPARMEPITPLLSTVMKAAGHIPANIGAXTPLAAEPVAGPTISRQXRRVNVGXFVFGVTEDXVMEYFNQQIATWAAYPQAMDKPISGESNKSR

SEQ ID NO: 31045 - protein, 263 aa, Diabrotica virgifera
  misc_feature: Coding regions on vcDNA: vcDNA=SeqID_10742; Strand=+; Position=114-905
  misc_feature (9)..(16): Xaa can be any naturally occurring amino acid
MKLADDSEXXXXXXXXYITLSFKKPDRSVDLRKFVEEVYSIFQTNDIKYSKTDILTTWKDLVEDYYYYKKNFTSEYASNAWNFFSLMDRCFDPKDTSKKFNSTLTFYLIDCMSNHRDVIAKKGLTSTVLSSVENDFKELGNNDINQSDIYIQWEILKQSFRESRLLIKQRCRNIKLNEFYDAMRIFYQSPSFHASKNYNGPVKRRNGADRCEGISKKMDVKSDDVDRPFNTELKEQLLIYIKSKKNKLGFNKELTPSFSNYIV

SEQ ID NO: 31046 - protein, 98 aa, Diabrotica virgifera
  misc_feature: Coding regions on vcDNA: vcDNA=SeqID_10743; Strand=+; Position=122-418
DNAELEEMLIVSFQPGTPKSMYLYLYRVESTREDNAKADELDGISNQRGARMKRPLRSQPLLWDMFSTAQWHGHYLQLVQWEKELPKQPRQDNGDSRQ

SEQ ID NO: 31047 - protein, 131 aa, Diabrotica virgifera
  misc_feature: Coding regions on vcDNA: vcDNA=SeqID_10744; Strand=-; Position=77-472
  misc_feature (1)..(20): Xaa can be any naturally occurring amino acid
  misc_feature (88)..(94): Xaa can be any naturally occurring amino acid
XXXXXXXXXXXXXXXXXXXXRLCIVLSRSTEAAARSQPPGHSERSPIVLIASAHSLQLWQVVLRIGNPNLFPRDKSYYVPGPPTPLCXXXXXXXGLQGVHQRVFQPIQGARFYGDIVHQHIGKRRITSRVP

SEQ ID NO: 31048 - protein, 97 aa, Diabrotica virgifera
  misc_feature: Coding regions on vcDNA: vcDNA=SeqID_10745; Strand=-; Position=42-335
  misc_feature (47)..(58): Xaa can be any naturally occurring amino acid
HTASVVSSFSGFYILVRALSKFIYCLYVQILFPERLPSTSHFCLLEXXXXXXXXXXXXCRPPEPNRLYITCPYSFLSSTQYFKLNAKYFASKLSTMR

SEQ ID NO: 31049 - protein, 93 aa, Diabrotica virgifera
  misc_feature: Coding regions on vcDNA: vcDNA=SeqID_10746; Strand=+; Position=335-616
  misc_feature (72)..(79): Xaa can be any naturally occurring amino acid
TDCNVTPSGALKKNIITTRWIMSLYNMLTNYNFKIKIELFQDLFSKSSILEKIYSIILTPCLYIHYVQYRNXXXXXXXXAWIFLVYSQSDILC

SEQ ID NO: 31050 - protein, 75 aa, Diabrotica virgifera
  misc_feature: Coding regions on vcDNA: vcDNA=SeqID_10747; Strand=-; Position=68-295
  misc_feature (60)..(73): Xaa can be any naturally occurring amino acid
GPGVFSSCYVYLLITNPHTKNVYFIEFLLLINIGGGSAPTNAIARQLYSLVYLFPLLDQXXXXXXXXXXXXXXCT

SEQ ID NO: 31051 - protein, 52 aa, Diabrotica virgifera
  misc_feature: Coding regions on vcDNA: vcDNA=SeqID_10748; Strand=-; Position=3-158
  misc_feature (43)..(50): Xaa can be any naturally occurring amino acid
PTLPYRHSLSFIILVVSKINEVSFLFVRRVITLVFCIIIALIXXXXXXXXRH

SEQ ID NO: 31052 - protein, 51 aa, Diabrotica virgifera
  misc_feature: Coding regions on vcDNA: vcDNA=SeqID_10749; Strand=-; Position=3-155
  misc_feature (23)..(51): Xaa can be any naturally occurring amino acid
KPYKQFIILKIYRRLRIKLSFIXXXXXXXXXXXXXXXXXXXXXXXXXXXXX

SEQ ID NO: 31053 - protein, 62 aa, Diabrotica virgifera
  misc_feature: Coding regions on vcDNA: vcDNA=SeqID_10750; Strand=-; Position=1-186
  misc_feature (10)..(61): Xaa can be any naturally occurring amino acid
NQKKWDQKIXXXXXXXXXXXXXXXXXXXXXXXXXXXXXXXXXXXXXXXXXXXXXXXXXXXXF

SEQ ID NO: 31054 - protein, 267 aa, Diabrotica virgifera
  misc_feature: Coding regions on vcDNA: vcDNA=SeqID_10751; Strand=+; Position=3-804
  misc_feature: Homolog annotation: Hit_ID=EAA06493.2; Match level="QueryCoverage =98%, HitCoverage=24%, E-value=6e-45, Identity=40%"; Hit description =ENSANGP00000020426 [Anopheles gambiae str. PEST] ref|XP_566413.1| ENSANGP00000020426 [Anopheles gambiae st
  misc_feature: Gene Ontology Annotation: Molecular function=phosphatidylinositol 3 -kinase activity; Cellular component=1-phosphatidylinositol 3-kinase complex; Biological process=embryonic cleavage
  misc_feature: Pfam annotation: Pfam_ID=PI3K_C2; Match level="Score=75.5, E-value =1.4e-19, Copies=1"; Pfam description=Phosphoinositide 3-kinase C2
  misc_feature (85)..(92): Xaa can be any naturally occurring amino acid
  misc_feature (257)..(257): Xaa can be any naturally occurring amino acid
AVINPKQLLEMFLAKRATTLNIRNERVSEYVLKVCGQDEFLIGDNKIIEFQYVQDCISRNIMPTLITLHIDKVPVFKINDYESLXXXXXXXXHSAPFGSTNTLRKKKNSLSSWSIQDNYLVKICTVCKLNCDLKKTSEIGIQAGLFHGGKSLCQPKKTFDCSIDDKYECSINTELVFDIDVCNIPRNAKLCFVVYEVNKYAKGTKSRKSKDSNKENNLSNNPLAWANTSVYDFKGQLKSGDMTLYMWAFADDMNSEXDVLHPLGTVS

SEQ ID NO: 31055 - protein, 147 aa, Diabrotica virgifera
  misc_feature: Coding regions on vcDNA: vcDNA=SeqID_10752; Strand=+; Position=334-774
  misc_feature: Homolog annotation: Hit_ID=XP_392575.1; Match level="QueryCoverage =95%, HitCoverage=46%, E-value=7e-36, Identity=49%"; Hit description =similar to ENSANGP00000018856 [Apis mellifera]
  misc_feature: Gene Ontology Annotation: Molecular function=Rab GTPase activator activity; Cellular component=bud tip; Biological process=exocytosis
  misc_feature (6)..(6): Xaa can be any naturally occurring amino acid
MAKSTXDNFNYEVYDNFMSGYIRVLTRRAQRWSTVKGDVYRKPNVLKRFIRKGVPSNQRTAVWMRVSGAENLRNSTNLSYGALKKNIDNQHIIDTIQIDLPRTFPENIYFSNHEYLPKELFNVLATFAHQNKEVGYCQGLNYIAGLL

SEQ ID NO: 31056 - protein, 81 aa, Diabrotica virgifera
  misc_feature: Coding regions on vcDNA: vcDNA=SeqID_10753; Strand=-; Position=0-242
YLIKNKNDNISSSTTHNNSVYYLQRMQLLCRLPFHRALSISRAANDTWKWEDYYQSVNIIFDFGNDLISRNVILLFGIVIS

SEQ ID NO: 31057 - protein, 58 aa, Diabrotica virgifera
  misc_feature: Coding regions on vcDNA: vcDNA=SeqID_10754; Strand=-; Position=0-173
  misc_feature (5)..(22): Xaa can be any naturally occurring amino acid
  misc_feature (24)..(55): Xaa can be any naturally occurring amino acid
SKKWXXXXXXXXXXXXXXXXXXPXXXXXXXXXXXXXXXXXXXXXXXXXXXXXXXXLFT

SEQ ID NO: 31058 - protein, 243 aa, Diabrotica virgifera
  misc_feature: Coding regions on vcDNA: vcDNA=SeqID_10755; Strand=-; Position=2-730
  misc_feature (1)..(13): Xaa can be any naturally occurring amino acid
  misc_feature (15)..(25): Xaa can be any naturally occurring amino acid
  misc_feature (35)..(43): Xaa can be any naturally occurring amino acid
  misc_feature (45)..(58): Xaa can be any naturally occurring amino acid
  misc_feature (65)..(77): Xaa can be any naturally occurring amino acid
  misc_feature (79)..(237): Xaa can be any naturally occurring amino acid
  misc_feature (239)..(243): Xaa can be any naturally occurring amino acid
XXXXXXXXXXXXXFXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXX

SEQ ID NO: 31059 - protein, 66 aa, Diabrotica virgifera
  misc_feature: Coding regions on vcDNA: vcDNA=SeqID_10756; Strand=-; Position=3-200
  misc_feature (3)..(13): Xaa can be any naturally occurring amino acid
  misc_feature (23)..(30): Xaa can be any naturally occurring amino acid
  misc_feature (33)..(40): Xaa can be any naturally occurring amino acid
  misc_feature (45)..(45): Xaa can be any naturally occurring amino acid
  misc_feature (52)..(65): Xaa can be any naturally occurring amino acid
PFXXXXXXXXXXXTNLAHTGLNXXXXXXXXSNXXXXXXXXPIINXNPTSRSXXXXXXXXXXXXXXC

SEQ ID NO: 31060 - protein, 66 aa, Diabrotica virgifera
  misc_feature: Coding regions on vcDNA: vcDNA=SeqID_10757; Strand=-; Position=1-198
  misc_feature (3)..(11): Xaa can be any naturally occurring amino acid
  misc_feature (23)..(30): Xaa can be any naturally occurring amino acid
  misc_feature (33)..(45): Xaa can be any naturally occurring amino acid
  misc_feature (52)..(64): Xaa can be any naturally occurring amino acid
PFXXXXXXXXXIEPNLAHTGLNXXXXXXXXRTXXXXXXXXXXXXXIQHRGRXXXXXXXXXXXXXLL

SEQ ID NO: 31061 - protein, 76 aa, Diabrotica virgifera
  misc_feature: Coding regions on vcDNA: vcDNA=SeqID_10758; Strand=-; Position=41-271
WFVGGIIIIFSGGSPLCVFFVHRRGYLIVIFFGQVPWRPKGKNHHVRSIVVDDNKILLSSFVIHNMALFFDRFEKS

SEQ ID NO: 31062 - protein, 22 aa, Diabrotica virgifera
  misc_feature: Coding regions on vcDNA: vcDNA=SeqID_10759; Strand=-; Position=1-66
  misc_feature (1)..(22): Xaa can be any naturally occurring amino acid
XXXXXXXXXXXXXXXXXXXXXX

SEQ ID NO: 31063 - protein, 20 aa, Diabrotica virgifera
  misc_feature: Coding regions on vcDNA: vcDNA=SeqID_10760; Strand=-; Position=1-60
  misc_feature (3)..(17): Xaa can be any naturally occurring amino acid
KLXXXXXXXXXXXXXXXNLF

SEQ ID NO: 31064 - protein, 33 aa, Diabrotica virgifera
  misc_feature: Coding regions on vcDNA: vcDNA=SeqID_10761; Strand=-; Position=2-100
  misc_feature (3)..(29): Xaa can be any naturally occurring amino acid
  misc_feature (32)..(32): Xaa can be any naturally occurring amino acid
KKXXXXXXXXXXXXXXXXXXXXXXXXXXXYIXK

SEQ ID NO: 31065 - protein, 20 aa, Diabrotica virgifera
  misc_feature: Coding regions on vcDNA: vcDNA=SeqID_10762; Strand=-; Position=1-60
  misc_feature (1)..(1): Xaa can be any naturally occurring amino acid
  misc_feature (3)..(20): Xaa can be any naturally occurring amino acid
XKXXXXXXXXXXXXXXXXXX

SEQ ID NO: 31066 - protein, 45 aa, Diabrotica virgifera
  misc_feature: Coding regions on vcDNA: vcDNA=SeqID_10763; Strand=-; Position=167-304
  misc_feature (14)..(21): Xaa can be any naturally occurring amino acid
LINKSNPYLHKIDXXXXXXXXSLHKNYCTSIILQYKTLIFRNRVE

SEQ ID NO: 31067 - protein, 53 aa, Diabrotica virgifera
  misc_feature: Coding regions on vcDNA: vcDNA=SeqID_10764; Strand=+; Position=2-163
  misc_feature (3)..(24): Xaa can be any naturally occurring amino acid
KYXXXXXXXXXXXXXXXXXXXXXXMLITELGDVLDTWMWASLRRTIRLGRSTY

SEQ ID NO: 31068 - protein, 71 aa, Diabrotica virgifera
  misc_feature: Coding regions on vcDNA: vcDNA=SeqID_10765; Strand=-; Position=108-323
PITYNSVINSALRIKNTYSATQIMLSSYDPLVGSPGKNNLFKRSPIYKKSGYGISLRYFKITLYFMPYIKI

SEQ ID NO: 31069 - protein, 377 aa, Diabrotica virgifera
  misc_feature: Coding regions on vcDNA: vcDNA=SeqID_10766; Strand=-; Position=1-1131
  misc_feature (11)..(16): Xaa can be any naturally occurring amino acid
  misc_feature (32)..(63): Xaa can be any naturally occurring amino acid
  misc_feature (66)..(88): Xaa can be any naturally occurring amino acid
  misc_feature (91)..(114): Xaa can be any naturally occurring amino acid
  misc_feature (118)..(131): Xaa can be any naturally occurring amino acid
  misc_feature (145)..(373): Xaa can be any naturally occurring amino acid
NLFKTPPGGSXXXXXXIGTPPTKKNPPRYPVXXXXXXXXXXXXXXXXXXXXXXXXXXXXXXXXPPXXXXXXXXXXXXXXXXXXXXXXXLMXXXXXXXXXXXXXXXXXXXXXXXXIFFXXXXXXXXXXXXXXFIFPYPGQKSRGHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTLG

SEQ ID NO: 31070 - protein, 73 aa, Diabrotica virgifera
  misc_feature: Coding regions on vcDNA: vcDNA=SeqID_10767; Strand=-; Position=2-220
  misc_feature (1)..(1): Xaa can be any naturally occurring amino acid
  misc_feature (6)..(6): Xaa can be any naturally occurring amino acid
  misc_feature (10)..(20): Xaa can be any naturally occurring amino acid
  misc_feature (28)..(28): Xaa can be any naturally occurring amino acid
  misc_feature (30)..(37): Xaa can be any naturally occurring amino acid
  misc_feature (40)..(47): Xaa can be any naturally occurring amino acid
  misc_feature (52)..(52): Xaa can be any naturally occurring amino acid
  misc_feature (59)..(72): Xaa can be any naturally occurring amino acid
XLFYIXGPFXXXXXXXXXXXTNLAHTGXNXXXXXXXXSNXXXXXXXXPIINXNPTSRSXXXXXXXXXXXXXXV

SEQ ID NO: 31071 - protein, 60 aa, Diabrotica virgifera
  misc_feature: Coding regions on vcDNA: vcDNA=SeqID_10768; Strand=-; Position=2-181
LYRRISPPSPYYPPIYLFKLVFLPYLLVFHTSAFFLYFVRLLQIFFTICLLSKIFLSNFL

SEQ ID NO: 31072 - protein, 66 aa, Diabrotica virgifera
  misc_feature: Coding regions on vcDNA: vcDNA=SeqID_10769; Strand=-; Position=234-434
ICFSILPSCHLIHTYLNHLNAHIHSVALLTLHYFRYTRFYLAYLSPYGIVKQVKYLTHNKLKFGYL

SEQ ID NO: 31073 - protein, 34 aa, Diabrotica virgifera; identical to SEQ ID NO: 27603
  misc_feature: Coding regions on vcDNA: vcDNA=SeqID_10770; Strand=-; Position=80-184

SEQ ID NO: 31074 - protein, 65 aa, Diabrotica virgifera
  misc_feature: Coding regions on vcDNA: vcDNA=SeqID_10771; Strand=-; Position=2-196
  misc_feature (3)..(12): Xaa can be any naturally occurring amino acid
  misc_feature (23)..(30): Xaa can be any naturally occurring amino acid
  misc_feature (33)..(40): Xaa can be any naturally occurring amino acid
SFXXXXXXXXXXRTKPGSHRLNXXXXXXXXSNXXXXXXXXPNINFNPTSRSHLYYRFDSPINYAV

SEQ ID NO: 31075 - protein, 68 aa, Diabrotica virgifera
  misc_feature: Coding regions on vcDNA: vcDNA=SeqID_10772; Strand=-; Position=32-238
  misc_feature (36)..(54): Xaa can be any naturally occurring amino acid
  misc_feature (57)..(65): Xaa can be any naturally occurring amino acid
QRMIISTGKQGEIAASQVVVFFSTFVFSIVFLDFLXXXXXXXXXXXXXXXXXXXVMXXXXXXXXXEGT

SEQ ID NO: 31076 - protein, 185 aa, Diabrotica virgifera
  misc_feature: Coding regions on vcDNA: vcDNA=SeqID_10773; Strand=-; Position=3-560
  misc_feature (2)..(14): Xaa can be any naturally occurring amino acid
  misc_feature (16)..(26): Xaa can be any naturally occurring amino acid
  misc_feature (36)..(44): Xaa can be any naturally occurring amino acid
  misc_feature (46)..(59): Xaa can be any naturally occurring amino acid
  misc_feature (66)..(78): Xaa can be any naturally occurring amino acid
  misc_feature (80)..(180): Xaa can be any naturally occurring amino acid
NXXXXXXXXXXXXXFXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRAKVA

SEQ ID NO: 31077 - protein, 76 aa, Diabrotica virgifera
  misc_feature: Coding regions on vcDNA: vcDNA=SeqID_10774; Strand=+; Position=78-308
LKSLYPNLFPLKRPITTNCYIADRFLFHLLPWSQKQFWLNMCLRYVERRRHYYYIAYRSYSVIYSYNKLHPLLCAT

SEQ ID NO: 31078 - protein, 154 aa, Diabrotica virgifera
  misc_feature: Coding regions on vcDNA: vcDNA=SeqID_10775; Strand=+; Position=3-719
  misc_feature: Homolog annotation: Hit_ID=XP_485924.1; Match level="QueryCoverage =91%, HitCoverage=54%, E-value=2e-35, Identity=40%"; Hit description =similar to Zinc finger protein 267 (Zinc finger protein HZF2) [Mus musculus]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=78.4, E-value =1.9e-20, Copies=3"; Pfam description=Zinc finger, C2H2 type
QFNQAGNLKTHLRAHIGEKPYKCQICLKRFSEPYIMKVHLRKHTGETPYNCETCLKPFITSSSLKLHLRKHTGDKFYKCEICLKQFTEGGSLKTHLRVHTGEKSYQFSQAGSLKTHLRVHTGEKKQFSQAGSLKMHLRLKSFLGKFFENTLESA

SEQ ID NO: 31079 - protein, 335 aa, Diabrotica virgifera
  misc_feature: Coding regions on vcDNA: vcDNA=SeqID_10776; Strand=+; Position=2-1004
  misc_feature: Homolog annotation: Hit_ID=AAF87756.1; Match level="QueryCoverage =100%, HitCoverage=76%, E-value=1e-123, Identity=70%"; Hit description=cytochrome oxidase subunit I [Diabrotica lemniscata]
  misc_feature: Pfam annotation: Pfam_ID=COX1; Match level="Score=90.1, E-value=5.9e -24, Copies=1"; Pfam description=Cytochrome C and Quinol oxidase polyp
  misc_feature (9)..(9): Xaa can be any naturally occurring amino acid
  misc_feature (54)..(62): Xaa can be any naturally occurring amino acid
  misc_feature (66)..(72): Xaa can be any naturally occurring amino acid
  misc_feature (83)..(90): Xaa can be any naturally occurring amino acid
  misc_feature (111)..(111): Xaa can be any naturally occurring amino acid
  misc_feature (146)..(146): Xaa can be any naturally occurring amino acid
  misc_feature (163)..(163): Xaa can be any naturally occurring amino acid
  misc_feature (166)..(172): Xaa can be any naturally occurring amino acid
  misc_feature (199)..(205): Xaa can be any naturally occurring amino acid
  misc_feature (219)..(219): Xaa can be any naturally occurring amino acid
  misc_feature (227)..(243): Xaa can be any naturally occurring amino acid
  misc_feature (273)..(273): Xaa can be any naturally occurring amino acid
  misc_feature (296)..(296): Xaa can be any naturally occurring amino acid
  misc_feature (299)..(299): Xaa can be any naturally occurring amino acid
  misc_feature (321)..(321): Xaa can be any naturally occurring amino acid
FDRIPLFVXAVVITAILLLLSLPVLAGAITILLTDRNLNTSFFDPAGGGDPILXXXXXXXXXHPEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVLFLILLFXEAXSFSRKRLRTFRITSSILMTTFXPPAEHRYSEIAILS

SEQ ID NO: 31080 - protein, 239 aa, Diabrotica virgifera
  misc_feature: Coding regions on vcDNA: vcDNA=SeqID_10777; Strand=+; Position=249-965
  misc_feature: Pfam annotation: Pfam_ID=RVP; Match level="Score=-6.0, E-value=0.043, Copies=1"; Pfam description=Retroviral aspartyl protease
  misc_feature (165)..(172): Xaa can be any naturally occurring amino acid
  misc_feature (180)..(180): Xaa can be any naturally occurring amino acid
  misc_feature (190)..(190): Xaa can be any naturally occurring amino acid
TRIRIKRNKSKKLLIPPLIRIKLLLNDTLEIYGVYDSGSNVSLVNAKLLQIKAHNRDDLQLVNLRTINGVKKTNGIVTPKIKIYDIEQKMNVFIVDDENFNYDFLIGLDCIKSFRLIQNEDLRITRCNSSKEIENLSTIDNNVSIPEFPGNIYVNASNEKINDIXXXXXXXXESINTDNXEIAINHLDLXQQSKIEQLINKYKSAFAKDKYDVGTIREYEAHIDFSVDKYWLQRPYRCT

SEQ ID NO: 31081 - protein, 55 aa, Diabrotica virgifera
  misc_feature: Coding regions on vcDNA: vcDNA=SeqID_10778; Strand=+; Position=363-530
  misc_feature (34)..(41): Xaa can be any naturally occurring amino acid
IVLLFSKLSFLEYRRMAHTTDHECDTLYNFFVHXXXXXXXXYLICYLMFFISSLN

SEQ ID NO: 31082 - protein, 165 aa, Diabrotica virgifera
  misc_feature: Coding regions on vcDNA: vcDNA=SeqID_10779; Strand=-; Position=2-496
  misc_feature (5)..(30): Xaa can be any naturally occurring amino acid
  misc_feature (33)..(43): Xaa can be any naturally occurring amino acid
  misc_feature (53)..(60): Xaa can be any naturally occurring amino acid
  misc_feature (63)..(76): Xaa can be any naturally occurring amino acid
  misc_feature (82)..(95): Xaa can be any naturally occurring amino acid
  misc_feature (97)..(164): Xaa can be any naturally occurring amino acid
PLVRXXXXXXXXXXXXXXXXXXXXXXXXXXPFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXG

SEQ ID NO: 31083 - protein, 65 aa, Diabrotica virgifera
  misc_feature: Coding regions on vcDNA: vcDNA=SeqID_10780; Strand=-; Position=271-468
KSMISYHDIGEGRNLTLKEKLACNYILLLTSDLQILNTPNTKIDKYNCIVNKYTSFIVKIILARW

SEQ ID NO: 31084 - protein, 183 aa, Diabrotica virgifera
  misc_feature: Coding regions on vcDNA: vcDNA=SeqID_10781; Strand=+; Position=23-575
  misc_feature: Homolog annotation: Hit_ID=XP_397033.1; Match level="QueryCoverage =84%, HitCoverage=9%, E-value=4e-13, Identity=36%"; Hit description =similar to CG9246-PA [Apis mellifera]
  misc_feature (83)..(88): Xaa can be any naturally occurring amino acid
  misc_feature (144)..(144): Xaa can be any naturally occurring amino acid
MRLFSKIVDSKNENITSSYSSYKESYSINKSSSSKYVPLSAPSTPSSNWPTKSFDLTKSASINEVLEGSKNFKPSDSKDPSTXXXXXXLTEKVFRVKSDENAPPKPPINLEKIFTPADGEQIKPTKCRKVFASSAFYEKGFHPXMRDRFSRANRISRSVARRKEKHNRVCVPMSSIQMMRFVE

SEQ ID NO: 31085 - protein, 89 aa, Diabrotica virgifera
  misc_feature: Coding regions on vcDNA: vcDNA=SeqID_10782; Strand=+; Position=473-843
  misc_feature: Homolog annotation: Hit_ID=XP_525925.1; Match level="QueryCoverage =86%, HitCoverage=60%, E-value=7e-25, Identity=70%"; Hit description =PREDICTED: similar to rRNA intron-encoded homing endonuclease [Pan troglodytes]
  misc_feature (18)..(18): Xaa can be any naturally occurring amino acid
  misc_feature (36)..(36): Xaa can be any naturally occurring amino acid
  misc_feature (41)..(41): Xaa can be any naturally occurring amino acid
  misc_feature (61)..(61): Xaa can be any naturally occurring amino acid
LARAVQLNPAAVLLTECXVGRYVYFEQIRVLKAGQXRLNTXAWNNGIGPRFYFVEAKAFAXNAFIDQERKLEVQRRSDTALVLTINNAS

SEQ ID NO: 31086 - protein, 61 aa, Diabrotica virgifera
  misc_feature: Coding regions on vcDNA: vcDNA=SeqID_10783; Strand=+; Position=357-542
TIGKRLLDRPTSLLATCPLFAKLSPVARYRNVSSTYVSGQAGLLIHVSDFVGLDSTSFDSF

SEQ ID NO: 31087 - protein, 58 aa, Diabrotica virgifera
  misc_feature: Coding regions on vcDNA: vcDNA=SeqID_10784; Strand=-; Position=0-173
CRTCSHTNYSQIFFIVNYHESITTVMRYHFLRIIITDNQNSSGQTGRGGGTREPGPGP

SEQ ID NO: 31088 - protein, 66 aa, Diabrotica virgifera
  misc_feature: Coding regions on vcDNA: vcDNA=SeqID_10785; Strand=+; Position=59-259
RNVDYNRFLIPTTTITIITILRERDTPNICTRINCITISIILSFFIFSITNLPPDSKQMSSIQTTN

SEQ ID NO: 31089 - protein, 209 aa, Diabrotica virgifera
  misc_feature: Coding regions on vcDNA: vcDNA=SeqID_10786; Strand=+; Position=51-677
  misc_feature (14)..(20): Xaa can be any naturally occurring amino acid
  misc_feature (109)..(118): Xaa can be any naturally occurring amino acid
KLLSSDVRTVTRNXXXXXXXMNNRTVLWDPNADKRNTTLRQPKGLTITQQSAPSSSPNTTPRDETPRLSSKSLVDRETLVANSTLNASATEWYPKNIYTPSPVEVITSXXXXXXXXXXECPQVNNINNEGTEEYSPDLNRIKQIITTLTKDPGQFHDLIDLFMETLVPYLEDIMITSLVAEIIAEQAINSPNFRYTATSVCWIIDPVSP

SEQ ID NO: 31090 - protein, 75 aa, Diabrotica virgifera
  misc_feature: Coding regions on vcDNA: vcDNA=SeqID_10787; Strand=-; Position=0-224
  misc_feature (5)..(74): Xaa can be any naturally occurring amino acid
KIRCXXXXXXXXXXXXXXXXXXXXXXXXXXXXXXXXXXXXXXXXXXXXXXXXXXXXXXXXXXXXXXXXXXXXXXL

SEQ ID NO: 31091 - protein, 90 aa, Diabrotica virgifera
  misc_feature: Coding regions on vcDNA: vcDNA=SeqID_10788; Strand=-; Position=15-287
FVCFCIIPLYCTYSYVSLQLFLCALITYLWIFLLPFPSSHLDSSDFHQHQSLYLYLLHVQASLSVSPLLHSSCSGINWQHSFRSSSPYTL

SEQ ID NO: 31092 - protein, 136 aa, Diabrotica virgifera
  misc_feature: Coding regions on vcDNA: vcDNA=SeqID_10789; Strand=+; Position=148-558
  misc_feature (45)..(51): Xaa can be any naturally occurring amino acid
  misc_feature (58)..(77): Xaa can be any naturally occurring amino acid
  misc_feature (92)..(114): Xaa can be any naturally occurring amino acid
  misc_feature (116)..(124): Xaa can be any naturally occurring amino acid
STYLLFPFSHYLAISNFYSATNISYIFSVMRRDSLSNISNIVRNXXXXXXXNILHHCXXXXXXXXXXXXXXXXXXXXSNSNLYIKITTENCXXXXXXXXXXXXXXXXXXXXXXXEXXXXXXXXXNDHNITISLIVY

SEQ ID NO: 31093 - protein, 64 aa, Diabrotica virgifera
  misc_feature: Coding regions on vcDNA: vcDNA=SeqID_10790; Strand=-; Position=629-823
  misc_feature (2)..(9): Xaa can be any naturally occurring amino acid
  misc_feature (27)..(33): Xaa can be any naturally occurring amino acid
GXXXXXXXXINEIKSILFSCNLAILTXXXXXXXYVSIARSKCRCHSNQLAGRKSLDLSYIKTRS

SEQ ID NO: 31094 - protein, 45 aa, Diabrotica virgifera
  misc_feature: Coding regions on vcDNA: vcDNA=SeqID_10791; Strand=+; Position=3-140
  misc_feature (1)..(13): Xaa can be any naturally occurring amino acid
  misc_feature (15)..(22): Xaa can be any naturally occurring amino acid
XXXXXXXXXXXXXRXXXXXXXXDRNQPGSHRFKLRSCKILKVEQT

SEQ ID NO: 31095 - protein, 54 aa, Diabrotica virgifera
  misc_feature: Coding regions on vcDNA: vcDNA=SeqID_10792; Strand=+; Position=2-166
  misc_feature (15)..(25): Xaa can be any naturally occurring amino acid
KLLCLTKKNYYQNIXXXXXXXXXXXWRLVADVTNNVDNNGRKNICLKSDENCVI

SEQ ID NO: 31096 - protein, 76 aa, Diabrotica virgifera
  misc_feature: Coding regions on vcDNA: vcDNA=SeqID_10793; Strand=-; Position=1-228
LKLLAWAPSHCSGPQFYKIYLLSLQAPSYTNMSSRKEVSVPAINTSHKIYSISQQMLSFEPFNGLLCSNLECGRQF

SEQ ID NO: 31097 - protein, 85 aa, Diabrotica virgifera
  misc_feature: Coding regions on vcDNA: vcDNA=SeqID_10794; Strand=-; Position=2-256
  misc_feature (18)..(85): Xaa can be any naturally occurring amino acid
IAVSFISKLHIDLLNIQXXXXXXXXXXXXXXXXXXXXXXXXXXXXXXXXXXXXXXXXXXXXXXXXXXXXXXXXXXXXXXXXXXXX

SEQ ID NO: 31098 - protein, 78 aa, Diabrotica virgifera
  misc_feature: Coding regions on vcDNA: vcDNA=SeqID_10795; Strand=-; Position=1-234
  misc_feature (4)..(10): Xaa can be any naturally occurring amino acid
  misc_feature (16)..(50): Xaa can be any naturally occurring amino acid
  misc_feature (52)..(77): Xaa can be any naturally occurring amino acid
IWDXXXXXXXAGFPLXXXXXXXXXXXXXXXXXXXXXXXXXXXXXXXXXXXPXXXXXXXXXXXXXXXXXXXXXXXXXXV

SEQ ID NO: 31099 - protein, 62 aa, Diabrotica virgifera
  misc_feature: Coding regions on vcDNA: vcDNA=SeqID_10796; Strand=-; Position=329-517
KLLGHVLFIKHSQNMPLSYSATSYTTVITRRLHCTVPRSIDQIKSVTPPRQISHTKDIHHRN

SEQ ID NO: 31100 - protein, 183 aa, Diabrotica virgifera
  misc_feature: Coding regions on vcDNA: vcDNA=SeqID_10797; Strand=+; Position=25-575
  misc_feature: Homolog annotation: Hit_ID=CAE46725.1; Match level="QueryCoverage =97%, HitCoverage=47%, E-value=3e-31, Identity=46%"; Hit description =beta actin [Homarus gammarus] gb|AAG16253.1| beta-actin [Litopenaeus vannamei] dbj|BAB41102.1| actin [Mars
  misc_feature: Gene Ontology Annotation: Biological process=reproduction
  misc_feature (71)..(71): Xaa can be any naturally occurring amino acid
  misc_feature (122)..(122): Xaa can be any naturally occurring amino acid
  misc_feature (150)..(150): Xaa can be any naturally occurring amino acid
  misc_feature (173)..(173): Xaa can be any naturally occurring amino acid
TRQTRENQAAEPDAHKGAERSKAGQAAEDGPRGEDPAREARPRQQDETTGTGQKKPKGGDETQRKKGSPTXENPNENGKGTNSDDREKTGQHTSHKEHRGNPEEHTALPTEAHLSHNCFREXMRLMKFETSITHSMYVDIHAGVSLYAIXLTSAIALDSGDGVSQTDKSYEGXILLHALLPLD

SEQ ID NO: 31101 - protein, 58 aa, Diabrotica virgifera
  misc_feature: Coding regions on vcDNA: vcDNA=SeqID_10798; Strand=-; Position=2-175
  misc_feature (25)..(58): Xaa can be any naturally occurring amino acid
KTCRRGWKKIKRTKFFLFNPPHEIXXXXXXXXXXXXXXXXXXXXXXXXXXXXXXXXXX

SEQ ID NO: 31102 - protein, 210 aa, Diabrotica virgifera
  misc_feature: Coding regions on vcDNA: vcDNA=SeqID_10799; Strand=+; Position=2-633
  misc_feature: Homolog annotation: Hit_ID=XP_392660.1; Match level="QueryCoverage =96%, HitCoverage=38%, E-value=2e-88, Identity=84%"; Hit description =similar to ENSANGP00000013382 [Apis mellifera]
  misc_feature: Gene Ontology Annotation: Molecular function=chaperone activity; Cellular component=cytosol; Biological process=protein folding
  misc_feature (22)..(22): Xaa can be any naturally occurring amino acid
AAEVVQERISDDELIIIKGPKXRTAASIILRGPNDFYCDEMERSVHDALSVVKRVLESKSVVVGGGSVEAALSIYLENFATTLSSREQLAIAEFARSLLVIPKTLAVNAAQDATDLVAKLRAYQNSSQTKKDHAHLKYVGLDLMEGTVRDNRKAGVLEPTMSKIKSLKFATEAAITILRIDDMIKLDSEQRGGKSYQQALESGKYMINLI

SEQ ID NO: 31103 - protein, 67 aa, Diabrotica virgifera
  misc_feature: Coding regions on vcDNA: vcDNA=SeqID_10800; Strand=-; Position=22-225
SSSRRYYCFFSSRSCISPFTIIGILVMHISTIIILWIIHIWLPHIISILVMRIRILHTGKKFHPGTL

SEQ ID NO: 31104 - protein, 37 aa, Diabrotica virgifera
  misc_feature: Coding regions on vcDNA: vcDNA=SeqID_10801; Strand=-; Position=2-112
  misc_feature (28)..(36): Xaa can be any naturally occurring amino acid
KLVDHVLVIVQSIKCLIIYSINTNILEXXXXXXXXXY

SEQ ID NO: 31105 - protein, 23 aa, Diabrotica virgifera
  misc_feature: Coding regions on vcDNA: vcDNA=SeqID_10802; Strand=-; Position=1-69
  misc_feature (17)..(23): Xaa can be any naturally occurring amino acid
PKKNYGRFSPKGNFILXXXXXXX

SEQ ID NO: 31106 - protein, 69 aa, Diabrotica virgifera
  misc_feature: Coding regions on vcDNA: vcDNA=SeqID_10803; Strand=-; Position=308-517
  misc_feature (57)..(64): Xaa can be any naturally occurring amino acid
IIHMLLVIHYLSKLNMIIYQNPIIAFLSLGNFSVVLFTYKLNLQTICHNKVIPTNLXXXXXXXXQSLIF

SEQ ID NO: 31107 - protein, 229 aa, Diabrotica virgifera
  misc_feature: Coding regions on vcDNA: vcDNA=SeqID_10804; Strand=-; Position=2-688
  misc_feature (41)..(48): Xaa can be any naturally occurring amino acid
  misc_feature (181)..(187): Xaa can be any naturally occurring amino acid
VPTTDPYYQCMRRKKRLNNLHPLVELLQKLGETSIPKVEKXXXXXXXXDFVLRNFDGKNVPMNSWLKTFESECSRCEVDTDKDKILILRLFLDGIAKEWFESKIITLGLDNSFEVWKVNFFDSFCETGWDNHRKAYSFKYIGGSLVDYAFRKENLLLNIKNDFPIDILIDLIVTNLPIHIXXXXXXXEVATMEKLIGELRKLESSVISKKNKSETNPNFVQIPTKLNTI

SEQ ID NO: 31108 - protein, 17 aa, Diabrotica virgifera
  misc_feature: Coding regions on vcDNA: vcDNA=SeqID_10805; Strand=+; Position=1-51
  misc_feature (1)..(16): Xaa can be any naturally occurring amino acid
XXXXXXXXXXXXXXXXG

SEQ ID NO: 31109 - protein, 72 aa, Diabrotica virgifera
  misc_feature: Coding regions on vcDNA: vcDNA=SeqID_10806; Strand=-; Position=96-314
  misc_feature (22)..(28): Xaa can be any naturally occurring amino acid
TNHEKTEKTIIVKKSQKSVQNXXXXXXXKFFIVKLTNALLHSTTHLSWKRHHLQHLLQQSLRSHLYRQILRI

SEQ ID NO: 31110 - protein, 115 aa, Diabrotica virgifera
  misc_feature: Coding regions on vcDNA: vcDNA=SeqID_10807; Strand=+; Position=3-347
  misc_feature (1)..(42): Xaa can be any naturally occurring amino acid
  misc_feature (93)..(112): Xaa can be any naturally occurring amino acid
XXXXXXXXXXXXXXXXXXXXXXXXXXXXXXXXXXXXXXXXXXDNYLRIQRIFIEESIDIKCGPPGGVKVLIGEHGYFFKLVPLLKFSCLGFNXXXXXXXXXXXXXXXXXXXXRGP

SEQ ID NO: 31111 - protein, 173 aa, Diabrotica virgifera
  misc_feature: Coding regions on vcDNA: vcDNA=SeqID_10808; Strand=+; Position=168-689
  misc_feature: Homolog annotation: Hit_ID=XP_321189.1; Match level="QueryCoverage =100%, HitCoverage=94%, E-value=4e-74, Identity=76%"; Hit description= ENSANGP00000020842 [Anopheles gambiae]
  misc_feature: Gene Ontology Annotation: Molecular function=N-acetyltransferase activity; Cellular component=nucleus; Biological process=protein modification
  misc_feature: Pfam annotation: Pfam_ID=Acetyltransf_1; Match level="Score=52.2, E -value=1.5e-12, Copies=1"; Pfam description=Acetyltransferase (GNAT) family
  misc_feature (14)..(14): Xaa can be any naturally occurring amino acid
MTTLRPFTGDDLFXFNNDNLDPLSETYGSSFYMQYLAHWPEYFQVAESPSGEVMGYIMGRAEGIGENWHGDVRALTVSPDFRRLGLAGCLMNFLEDVAEKKRAYFVNLFARVSDKVAINMYDHLGYIVYRTGLEYDSGDPDEDAYDMRRACSIDVNQQSVIPLTHPGRPEDVD

SEQ ID NO: 31112 - protein, 39 aa, Diabrotica virgifera
  misc_feature: Coding regions on vcDNA: vcDNA=SeqID_10809; Strand=-; Position=1-117
  misc_feature (10)..(39): Xaa can be any naturally occurring amino acid
KISPFFPKGXXXXXXXXXXXXXXXXXXXXXXXXXXXXXX

SEQ ID NO: 31113 - protein, 89 aa, Diabrotica virgifera
  misc_feature: Coding regions on vcDNA: vcDNA=SeqID_10810; Strand=-; Position=1-267
  misc_feature (13)..(24): Xaa can be any naturally occurring amino acid
  misc_feature (27)..(50): Xaa can be any naturally occurring amino acid
  misc_feature (60)..(87): Xaa can be any naturally occurring amino acid
DLLVFKKNLSFLXXXXXXXXXXXXTSXXXXXXXXXXXXXXXXXXXXXXXXQNSRPISNYXXXXXXXXXXXXXXXXXXXXXXXXXXXXIN

SEQ ID NO: 31114 - protein, 249 aa, Diabrotica virgifera
  misc_feature: Coding regions on vcDNA: vcDNA=SeqID_10811; Strand=+; Position=210-955
  misc_feature: Homolog annotation: Hit_ID=XP_392510.1; Match level="QueryCoverage =100%, HitCoverage=42%, E-value=8e-94, Identity=71%"; Hit description= similar to Kinesin light chain (KLC) [Apis mellifera]
  misc_feature (226)..(226): Xaa can be any naturally occurring amino acid
NMSKTINAYRIKKIENYGKMTQMTQEEIVAAVKTVAQGLEALRSEHTGILHSLHEAPDPVVSERAGLVQQSADMIELGLGEAQVIMALAAHLQLVEAEKQKLRTQVRRLCQENAWLRDELASTQQRLQSSEQMVAQLEEDKRHLEFMSSVSKYDQDVNEDNASEQSKSEKPDPVVDLFPDDDADDRHNMSPTPPNQLQLSQQVNAGYEIPARLRTLHNLVIQYASXGRYEVAVPLCKAAVEDLEKTSGH

SEQ ID NO: 31115 - protein, 63 aa, Diabrotica virgifera
  misc_feature: Coding regions on vcDNA: vcDNA=SeqID_10812; Strand=+; Position=3-194
  misc_feature (1)..(23): Xaa can be any naturally occurring amino acid
XXXXXXXXXXXXXXXXXXXXXXXSSYLYSPVTIISLLTICIFSISICILNDYGDMSLTRPLKT

SEQ ID NO: 31116 - protein, 109 aa, Diabrotica virgifera
  misc_feature: Coding regions on vcDNA: vcDNA=SeqID_10813; Strand=-; Position=509-838
  misc_feature (2)..(25): Xaa can be any naturally occurring amino acid
  misc_feature (35)..(51): Xaa can be any naturally occurring amino acid
  misc_feature (57)..(64): Xaa can be any naturally occurring amino acid
GXXXXXXXXXXXXXXXXXXXXXXXXLFSSTRPFQXXXXXXXXXXXXXXXXXRGHSNXXXXXXXXIFHTKRHALNTQGKKILPNPCIRSIILLLNIQSSNSNMIFIAPSK

SEQ ID NO: 31117 - protein, 23 aa, Diabrotica virgifera
  misc_feature: Coding regions on vcDNA: vcDNA=SeqID_10814; Strand=-; Position=0-68
  misc_feature (2)..(21): Xaa can be any naturally occurring amino acid
KXXXXXXXXXXXXXXXXXXXXYT

SEQ ID NO: 31118 - protein, 326 aa, Diabrotica virgifera
  misc_feature: Coding regions on vcDNA: vcDNA=SeqID_10815; Strand=+; Position=3-980
  misc_feature: Homolog annotation: Hit_ID=EAA08143.2; Match level="QueryCoverage =92%, HitCoverage=56%, E-value=8e-56, Identity=37%"; Hit description =ENSANGP00000010831 [Anopheles gambiae str. PEST] ref|XP_563425.1| ENSANGP00000010831 [Anopheles gambiae st
  misc_feature: Pfam annotation: Pfam_ID=AMP-binding; Match level="Score=-106.1, E -value=0.011, Copies=1"; Pfam description=AMP-binding enzyme
  misc_feature (276)..(276): Xaa can be any naturally occurring amino acid
  misc_feature (285)..(285): Xaa can be any naturally occurring amino acid
IVSNKILSKWDFTVAFRRCLATGNPKNILKSGSSDISIPTVTLSEFVFEKAEKFNKYTAFISGTTGRSYTFEQIRIKSRNFSKVLREKFKLKDGDVIAMFLPNVPEYVICFLGSLEARLIVTTMNPMYTADEIAKQIIDASPKLIVTQANLVSTARSALELTKRQLPLIIVKETQAESLPEGTIDLSELINTHLDVPDLLPGKADDVAIMPYSSGTTGLPKGVLLTHKNMTSNLTQMSHPDFSSVEPPTDNFQDMSPAVLPFYHIYGLTLNFLFIXPGTRCVALXQFTPESYIAALKDNPISMIFAAPPLVLFLTAHPDVKSEYFK

SEQ ID NO: 31119 - protein, 260 aa, Diabrotica virgifera
  misc_feature: Coding regions on vcDNA: vcDNA=SeqID_10816; Strand=+; Position=96-876
  misc_feature: Homolog annotation: Hit_ID=NP_651246.2; Match level="QueryCoverage =99%, HitCoverage=27%, E-value=3e-54, Identity=41%"; Hit description =CG6413-PA [Drosophila melanogaster] gb|AAF56281.1| CG6413-PA [Drosophila melanogaster]
  misc_feature: Gene Ontology Annotation: Molecular function=GDP-dissociation stimulator activity; Cellular component=exosome (RNase complex); Biological process=rRNA processing
  misc_feature (91)..(101): Xaa can be any naturally occurring amino acid
  misc_feature (142)..(146): Xaa can be any naturally occurring amino acid
  misc_feature (223)..(223): Xaa can be any naturally occurring amino acid
  misc_feature (227)..(227): Xaa can be any naturally occurring amino acid
  misc_feature (231)..(231): Xaa can be any naturally occurring amino acid
  misc_feature (241)..(241): Xaa can be any naturally occurring amino acid
MFTTKAFIKKTKIGHFLKNVREHYIRDDIFCGISTCEKCHPVDSNLSTTHQNKCGLFDFNHFLILDTNIILDQMDILDEPILGNVIILHTXXXXXXXXXXXTYKRLHSIIENPSRHFYVFTNDHHKDTYIKQKDGELINDYXXXXXRKSCSWYIQHLPKEKFVFLSDDANNRNIALEEGIPACTIKDYITNVPDNSILQDKLSKKEIAIDSYTKDVFPPHLSXVALXTGVXEGKLYQGTFXASRDNFLEGFVNVDAFKDS

SEQ ID NO: 31120 - protein, 115 aa, Diabrotica virgifera
  misc_feature: Coding regions on vcDNA: vcDNA=SeqID_10817; Strand=+; Position=142-486
  misc_feature (34)..(53): Xaa can be any naturally occurring amino acid
  misc_feature (55)..(77): Xaa can be any naturally occurring amino acid
  misc_feature (83)..(109): Xaa can be any naturally occurring amino acid
PNIGAPIFIINLNPPKKLRCYPKGNFFLKPKKWXXXXXXXXXXXXXXXXXXXXPXXXXXXXXXXXXXXXXXXXXXXXYRAFPXXXXXXXXXXXXXXXXXXXXXXXXXXXPFFPVF

SEQ ID NO: 31121 - protein, 298 aa, Diabrotica virgifera
  misc_feature: Coding regions on vcDNA: vcDNA=SeqID_10818; Strand=+; Position=1-897
  misc_feature (275)..(275): Xaa can be any naturally occurring amino acid
  misc_feature (285)..(285): Xaa can be any naturally occurring amino acid
AVKSCVRKISNHVAESRTKFNIEKLSDIKDTVLFASPLDRKFLLLYMHNSEEEFSNTFFKYLRDEDISKILNDYFYIIGWDVENRAYHPALCKAVEDANFGHLSALIQSEACAAVIIQNINGCPNILSFLMGNDVDSSRDSFLLCLQNCRDFLIVDRMSVNGLDGSLQSNELTSEAFQKIMADRLGDRDYDSFAFDQHELLERKIGFALFGQPVQESGNGYDKAQNKQIKNLYKIILKHNNLYAEYKDQVEIGFMYIVLEPTDDQAKSRRKKDPXYNPHIDISPXPIFVLRKCPKRRR

SEQ ID NO: 31122 - protein, 22 aa, Diabrotica virgifera
  misc_feature: Coding regions on vcDNA: vcDNA=SeqID_10819; Strand=-; Position=1-66
  misc_feature (3)..(21): Xaa can be any naturally occurring amino acid
KKXXXXXXXXXXXXXXXXXXXF

SEQ ID NO: 31123 - protein, 84 aa, Diabrotica virgifera
  misc_feature: Coding regions on vcDNA: vcDNA=SeqID_10820; Strand=+; Position=174-429
  misc_feature: Homolog annotation: Hit_ID=XP_311560.1; Match level="QueryCoverage =91%, HitCoverage=19%, E-value=3e-15, Identity=50%"; Hit description =ENSANGP00000016081 [Anopheles gambiae]
  misc_feature: Gene Ontology Annotation: Molecular function=endoplasmic reticulum receptor activity; Cellular component=integral to membrane; Biological process=cotranslational membrane targeting
  misc_feature (55)..(55): Xaa can be any naturally occurring amino acid
LTEAGEVHLYTPGANDWDCIFLYTLICGVIHGIIQEYVLYNVSRKLRLSNSRVSXFATRGQLTIFYLISTLWGLDIISQRELCI

SEQ ID NO: 31124 - protein, 41 aa, Diabrotica virgifera
  misc_feature: Coding regions on vcDNA: vcDNA=SeqID_10821; Strand=-; Position=1-123
  misc_feature (13)..(41): Xaa can be any naturally occurring amino acid
KYAVSLGNLFYIXXXXXXXXXXXXXXXXXXXXXXXXXXXXX

SEQ ID NO: 31125 - protein, 80 aa, Diabrotica virgifera
  misc_feature: Coding regions on vcDNA: vcDNA=SeqID_10822; Strand=-; Position=3-242
  misc_feature (3)..(15): Xaa can be any naturally occurring amino acid
  misc_feature (17)..(27): Xaa can be any naturally occurring amino acid
  misc_feature (37)..(45): Xaa can be any naturally occurring amino acid
  misc_feature (47)..(60): Xaa can be any naturally occurring amino acid
  misc_feature (67)..(79): Xaa can be any naturally occurring amino acid
LNXXXXXXXXXXXXXFXXXXXXXXXXXNQPGSHRFKXXXXXXXXXEXXXXXXXXXXXXXXSNIEVAXXXXXXXXXXXXXC

SEQ ID NO: 31126 - protein, 63 aa, Diabrotica virgifera
  misc_feature: Coding regions on vcDNA: vcDNA=SeqID_10823; Strand=+; Position=4-192
  misc_feature (6)..(6): Xaa can be any naturally occurring amino acid
  misc_feature (19)..(19): Xaa can be any naturally occurring amino acid
  misc_feature (25)..(33): Xaa can be any naturally occurring amino acid
  misc_feature (37)..(37): Xaa can be any naturally occurring amino acid
  misc_feature (54)..(62): Xaa can be any naturally occurring amino acid
QRNFIXRVNRYKDCDLDVXIKFIIXXXXXXXXXVDFXILHDLSLNPCEPRLVLXXXXXXXXXT

SEQ ID NO: 31127 - protein, 151 aa, Diabrotica virgifera
  misc_feature: Coding regions on vcDNA: vcDNA=SeqID_10824; Strand=+; Position=74-580
  misc_feature: Homolog annotation: Hit_ID=AAF87760.1; Match level="QueryCoverage =100%, HitCoverage=45%, E-value=2e-61, Identity=69%"; Hit description= cytochrome oxidase subunit I [Diabrotica virgifera zeae]
  misc_feature: Pfam annotation: Pfam_ID=COX1; Match level="Score=-167.9, E-value =1.5e-05, Copies=1"; Pfam description=Cytochrome C and Quinol oxidase polyp
  misc_feature (68)..(68): Xaa can be any naturally occurring amino acid
  misc_feature (103)..(103): Xaa can be any naturally occurring amino acid
LSLPVLAGAITILLTDRNLNTSFFDPAGGGDPILHPEGFGLISHIVRFGTLGIIYAIIAIGLLGFIVXAHHIFTVGMDVDTRAYFTSATIIIAVPTGIKVFRXLATYHGTTITYRLTGVVLANSSIDIVLHDTYYVVAIGAVFAIIAGFIQ

SEQ ID NO: 31128 - protein, 79 aa, Diabrotica virgifera
  misc_feature: Coding regions on vcDNA: vcDNA=SeqID_10825; Strand=-; Position=0-236
  misc_feature (5)..(16): Xaa can be any naturally occurring amino acid
  misc_feature (31)..(37): Xaa can be any naturally occurring amino acid
  misc_feature (42)..(48): Xaa can be any naturally occurring amino acid
  misc_feature (61)..(70): Xaa can be any naturally occurring amino acid
WPLLXXXXXXXXXXXXRKPNPGPTPGFNLRXXXXXXXSKQPXXXXXXXQFINFNPTIEGRXXXXXXXXXXKNYAVILKV

SEQ ID NO: 31129 - protein, 17 aa, Diabrotica virgifera
  misc_feature: Coding regions on vcDNA: vcDNA=SeqID_10826; Strand=-; Position=1-51
  misc_feature (1)..(2): Xaa can be any naturally occurring amino acid
  misc_feature (5)..(16): Xaa can be any naturally occurring amino acid
XXYHXXXXXXXXXXXXN

SEQ ID NO: 31130 - protein, 88 aa, Diabrotica virgifera
  misc_feature: Coding regions on vcDNA: vcDNA=SeqID_10827; Strand=-; Position=1-264
  misc_feature (13)..(13): Xaa can be any naturally occurring amino acid
  misc_feature (17)..(88): Xaa can be any naturally occurring amino acid
IKLYRGLSSLKKXKLLXXXXXXXXXXXXXXXXXXXXXXXXXXXXXXXXXXXXXXXXXXXXXXXXXXXXXXXXXXXXXXXXXXXXXXXX

SEQ ID NO: 31131 - protein, 196 aa, Diabrotica virgifera
  misc_feature: Coding regions on vcDNA: vcDNA=SeqID_10828; Strand=+; Position=260-850
  misc_feature: Homolog annotation: Hit_ID=XP_395125.1; Match level="QueryCoverage =88%, HitCoverage=52%, E-value=3e-50, Identity=46%"; Hit description =similar to CG8646-PA [Apis mellifera]
  misc_feature: Gene Ontology Annotation: Molecular function=arylsulfatase activity; Cellular component=lysosome; Biological process=skeletal development
  misc_feature: Pfam annotation: Pfam_ID=Sulfatase; Match level="Score=-71.3, E-value= 0.0077, Copies=1"; Pfam description=Sulfatase
MKTSQSATSVNSQEKQIHKQPPHIVIILADDVGWNDFGLHGSSQIPTPNIDALGYNGVILDKFYTQQTCTPSRAALLTGKYPIRMGLQGIPLDAGENRSLPLNIRTMPERLKELGYSTHLVGKWHLGAACEEVTPTRRGFDTHFGYWSGFVGYFNHELSVPNPLNKSENFTGLKIFVTIFTPQWSLERKYVTEIIF

SEQ ID NO: 31132 - protein, 176 aa, Diabrotica virgifera
  misc_feature: Coding regions on vcDNA: vcDNA=SeqID_10829; Strand=+; Position=21-551
  misc_feature: Homolog annotation: Hit_ID=XP_315305.1; Match level="QueryCoverage =93%, HitCoverage=79%, E-value=6e-52, Identity=64%"; Hit description =ENSANGP00000024391 [Anopheles gambiae]
  misc_feature: Gene Ontology Annotation: Molecular function=actin binding; Cellular component=troponin complex; Biological process=muscle development
  misc_feature: Pfam annotation: Pfam_ID=Troponin; Match level="Score=95.3, E-value =1.5e-25, Copies=1"; Pfam description=Troponin
  misc_feature (29)..(38): Xaa can be any naturally occurring amino acid
  misc_feature (144)..(161): Xaa can be any naturally occurring amino acid
NKYVFTAPFFMTPERKKKLRLLLRKKAAXXXXXXXXXXAAERRRIIEERCGKPKLVDDANEGSLKQVCEGYHRRIVDLENKKFDLEKEVEFRDFQISELNSQVNDLRGKFVKPTLKKVSKYENKFAKLQKKAAEFNFRNQLKVXXXXXXXXXXXXXXXXXXWSKKGDEKKVQEAEA

SEQ ID NO: 31133 - protein, 80 aa, Diabrotica virgifera
  misc_feature: Coding regions on vcDNA: vcDNA=SeqID_10830; Strand=-; Position=119-361
LGICYYVTGVGVIVLRNYKRTFYRIIHHADLTRHDREINVIYASDCCSSIQKSFCIYTHFHIGFNFCELRFADIPPPRSR

SEQ ID NO: 31134 - protein, 185 aa, Diabrotica virgifera
  misc_feature: Coding regions on vcDNA: vcDNA=SeqID_10831; Strand=-; Position=1-555
  misc_feature (1)..(185): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31135 - protein, 45 aa, Diabrotica virgifera
  misc_feature: Coding regions on vcDNA: vcDNA=SeqID_10832; Strand=+; Position=24-161
QYEQVREDVIDLTNSLIVLVDRSYIIYYIYPILVISHLFHNKQLI

SEQ ID NO: 31136 - protein, 68 aa, Diabrotica virgifera
  misc_feature: Coding regions on vcDNA: vcDNA=SeqID_10833; Strand=+; Position=71-277
PSLISLILSFLPSLHVPSSSCTVLYSMTVFDLSCNIHQILFNPNSPITFSVVLSRYFLAERKNTHSKH

SEQ ID NO: 31137 - protein, 74 aa, Diabrotica virgifera
  misc_feature: Coding regions on vcDNA: vcDNA=SeqID_10834; Strand=-; Position=67-291
  misc_feature (22)..(36): Xaa can be any naturally occurring amino acid
CRSHLKKKWYSRRYKRKASYCXXXXXXXXXXXXXXXLPIYFLMNWKQFTCCIADSPRRVNDLFFARDARLSILL

SEQ ID NO: 31138 - protein, 266 aa, Diabrotica virgifera
  misc_feature: Coding regions on vcDNA: vcDNA=SeqID_10835; Strand=+; Position=65-862
  misc_feature: Homolog annotation: Hit_ID=XP_424751.1; Match level="QueryCoverage =93%, HitCoverage=40%, E-value=4e-80, Identity=54%"; Hit description =PREDICTED: similar to KIAA0073 protein [Gallus gallus]
  misc_feature: Gene Ontology Annotation: Biological process=protein folding
  misc_feature: Pfam annotation: Pfam_ID=WD40; Match level="Score=16.5, E-value =0.083, Copies=1"; Pfam description=WD domain, G-beta repeat
TLLNRHRHNSNIIIWLISFYIGLNITNILNNFHPFHNSPKYDVVISADKKGMVEYWHGSKHDYGVPKNIGFDSKLDTDLFEFAKNKTVPTGLAFSNDGKKFATISTDRKIRVFNFLKGKLILVLDESLPRFSDHQHKTQQLPNMEFGRRMAVERDLEKSDSFELANIIFDESGYFIMYATLLGIKLVNIHTNRCVKIIGKNENLRMLNIALYQGSAKKSKAAVTLEIEASNNPTLDAILPDPTLICTAYKKSRFYLFSRREPDDLQ

SEQ ID NO: 31139 - protein, 88 aa, Diabrotica virgifera
  misc_feature: Coding regions on vcDNA: vcDNA=SeqID_10836; Strand=-; Position=67-333
VRRCRCVIIGENNRASYSYISSPRYHPQTRRHCIATACIIQRRHIYAYRFHNVVRMNIWMMFVEIFRSFCLRCGRAHTSVNIICSGIS

SEQ ID NO: 31140 - protein, 76 aa, Diabrotica virgifera
  misc_feature: Coding regions on vcDNA: vcDNA=SeqID_10837; Strand=+; Position=364-594
  misc_feature (29)..(58): Xaa can be any naturally occurring amino acid
NFGTVCFIVILRGGHQAVLRPPLCRVAGXXXXXXXXXXXXXXXXXXXXXXXXXXXXXXTSYILLKRLYFETFTRIF

SEQ ID NO: 31141 - protein, 34 aa, Diabrotica virgifera; identical to SEQ ID NO: 27603
  misc_feature: Coding regions on vcDNA: vcDNA=SeqID_10838; Strand=-; Position=80-184

SEQ ID NO: 31142 - protein, 19 aa, Diabrotica virgifera
  misc_feature: Coding regions on vcDNA: vcDNA=SeqID_10839; Strand=-; Position=1-57
  misc_feature (5)..(17): Xaa can be any naturally occurring amino acid
HRGRXXXXXXXXXXXXXLL

SEQ ID NO: 31143 - protein, 28 aa, Diabrotica virgifera
  misc_feature: Coding regions on vcDNA: vcDNA=SeqID_10840; Strand=-; Position=1-84
  misc_feature (13)..(19): Xaa can be any naturally occurring amino acid
PNIFTSHNKLPIXXXXXXXVIQFNRTRG

SEQ ID NO: 31144 - protein, 47 aa, Diabrotica virgifera
  misc_feature: Coding regions on vcDNA: vcDNA=SeqID_10841; Strand=-; Position=2-142
  misc_feature (36)..(45): Xaa can be any naturally occurring amino acid
VMQCQQRTDLYVPPVTFYLSSRAFVILTDRILCYIXXXXXXXXXXNN

SEQ ID NO: 31145 - protein, 187 aa, Diabrotica virgifera
  misc_feature: Coding regions on vcDNA: vcDNA=SeqID_10842; Strand=+; Position=2-565
  misc_feature: Homolog annotation: Hit_ID=XP_397060.1; Match level="QueryCoverage =79%, HitCoverage=9%, E-value=1e-82, Identity=92%"; Hit description =similar to ENSANGP00000016766 [Apis mellifera]
  misc_feature: Gene Ontology Annotation: Molecular function=cleavage/polyadenylation specificity factor activity; Cellular component=nucleoplasm; Biological process=mRNA polyadenylation
  misc_feature: Pfam annotation: Pfam_ID=WD40; Match level="Score=42.0, E-value=1.7e -09, Copies=2"; Pfam description=WD domain, G-beta repeat
SIIKELENRVWQRDYRDRRALQPDAMYYPDLMPPPSYPDNPINCVTTRFVKTATNKMRCPIFCMAWTPEGRRLVTGASSGEFTLWNGLTFNFETILQAHDSPVRTMVWSHNDSWMITGDHSGYVKYWQSNMNNVKMFQAHKEALRGIRYLQLLSVIIKLVHLLIFYFINKRSLLLPTLVQNKEINFK

SEQ ID NO: 31146 - protein, 235 aa, Diabrotica virgifera
  misc_feature: Coding regions on vcDNA: vcDNA=SeqID_10843; Strand=+; Position=2-706
  misc_feature: Homolog annotation: Hit_ID=AAF87760.1; Match level="QueryCoverage =100%, HitCoverage=53%, E-value=3e-88, Identity=73%"; Hit description= cytochrome oxidase subunit I [Diabrotica virgifera zeae]
  misc_feature: Pfam annotation: Pfam_ID=COX1; Match level="Score=-158.9, E-value =7.6e-06, Copies=1"; Pfam description=Cytochrome C and Quinol oxidase polyp
  misc_feature (11)..(11): Xaa can be any naturally occurring amino acid
  misc_feature (46)..(46): Xaa can be any naturally occurring amino acid
  misc_feature (63)..(63): Xaa can be any naturally occurring amino acid
  misc_feature (66)..(72): Xaa can be any naturally occurring amino acid
  misc_feature (99)..(105): Xaa can be any naturally occurring amino acid
  misc_feature (119)..(119): Xaa can be any naturally occurring amino acid
  misc_feature (127)..(143): Xaa can be any naturally occurring amino acid
  misc_feature (173)..(173): Xaa can be any naturally occurring amino acid
  misc_feature (189)..(196): Xaa can be any naturally occurring amino acid
  misc_feature (217)..(217): Xaa can be any naturally occurring amino acid
IAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFSFQRKRLRPLRIISSIEXLQFNPPAEHRYSELPILS

SEQ ID NO: 31147 - protein, 66 aa, Diabrotica virgifera; identical to SEQ ID NO: 26808
  misc_feature: Coding regions on vcDNA: vcDNA=SeqID_10844; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 31148 - protein, 111 aa, Diabrotica virgifera
  misc_feature: Coding regions on vcDNA: vcDNA=SeqID_10845; Strand=-; Position=0-332
  misc_feature (12)..(18): Xaa can be any naturally occurring amino acid
  misc_feature (23)..(78): Xaa can be any naturally occurring amino acid
  misc_feature (82)..(108): Xaa can be any naturally occurring amino acid
GGAKFFFIVLNXXXXXXXGLPLXXXXXXXXXXXXXXXXXXXXXXXXXXXXXXXXXXXXXXXXXXXXXXXXXXXXXXXXRVFXXXXXXXXXXXXXXXXXXXXXXXXXXXIPA

SEQ ID NO: 31149 - protein, 58 aa, Diabrotica virgifera
  misc_feature: Coding regions on vcDNA: vcDNA=SeqID_10846; Strand=+; Position=1-177
  misc_feature: Homolog annotation: Hit_ID=XP_393875.1; Match level="QueryCoverage =93%, HitCoverage=29%, E-value=8e-19, Identity=75%"; Hit description =similar to modifier 1 [Apis mellifera]
  misc_feature: Gene Ontology Annotation: Molecular function=lamin/chromatin binding; Cellular component=nuclear membrane
  misc_feature: Pfam annotation: Pfam_ID=Chromo_shadow; Match level="Score=86.4, E -value=7.6e-23, Copies=1"; Pfam description=Chromo shadow domain
ADKIIGASDTSGQLMFLMKWKGTDDTDLVYARQANLKCPQVVIKFYEERIAWHTPDDF

SEQ ID NO: 31150 - protein, 89 aa, Diabrotica virgifera
  misc_feature: Coding regions on vcDNA: vcDNA=SeqID_10847; Strand=+; Position=551-820
  misc_feature (51)..(60): Xaa can be any naturally occurring amino acid
FTTKKIKYLCYCFTYLSELFMHLKTISKKLSGRYYSIILLLHNHLSYGQNXXXXXXXXXXWLPIVESSIYKILSSMGYVERSLNNCSSG

SEQ ID NO: 31151 - protein, 86 aa, Diabrotica virgifera
  misc_feature: Coding regions on vcDNA: vcDNA=SeqID_10848; Strand=+; Position=350-610
IANCSWKEFICRASLSLKSGDFDAFGNGAMHKPFEDAAFARYAEDVSEPAFADSGRLMILSQCLLISVYAALNCYTLAEQTYCYVR

SEQ ID NO: 31152 - protein, 267 aa, Diabrotica virgifera
  misc_feature: Coding regions on vcDNA: vcDNA=SeqID_10849; Strand=-; Position=68-871
TPRKRLCDMLEDCTKKYADQHISRTQLQYMEQEVEVYEKSLLELKDLEDMVQKLLAHYFVLKIMYREETQQIEEYEQYFKGVISYISWDMESCIIRTDKMKDVIQNHHETSSSERLKLSKTIVKLLSKNEGNYSIDRAFELISEFNKEVELLENKLFTPGFKDLKSKGGQLRSSIKTLQSFLISGPTHRVLLLPSELQLLIRRVEHLLKKELESVKSSIEIIACAKKVPSKWQNYRRQLWMYFYAEPNQLKFILQEIQKEIEKSSKN

SEQ ID NO: 31153 - protein, 114 aa, Diabrotica virgifera
  misc_feature: Coding regions on vcDNA: vcDNA=SeqID_10850; Strand=+; Position=86-430
CLMFRPSQQQRRQYGDRNETCNDILKTLDEVIMNSMIHKIAYFPELALLKIDDGRKEWSYPRVNGKNIRKSRCKYYDMLWSHLLCQYKELIFRDYAQVKANEFMRLLARSIILW

SEQ ID NO: 31154 - protein, 66 aa, Diabrotica virgifera
  misc_feature: Coding regions on vcDNA: vcDNA=SeqID_10851; Strand=-; Position=1-198
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (53)..(64): Xaa can be any naturally occurring amino acid
PFXXXXXXXXXXXTNLAHTGLNXXXXXXXXSNXXXXXXXXXXXXXXPTSRSQXXXXXXXXXXXXLL

SEQ ID NO: 31155 - protein, 31 aa, Diabrotica virgifera
  misc_feature: Coding regions on vcDNA: vcDNA=SeqID_10852; Strand=-; Position=0-92
  misc_feature (1)..(8): Xaa can be any naturally occurring amino acid
  misc_feature (12)..(29): Xaa can be any naturally occurring amino acid
XXXXXXXXAFNXXXXXXXXXXXXXXXXXXPP

SEQ ID NO: 31156 - protein, 113 aa, Diabrotica virgifera
  misc_feature: Coding regions on vcDNA: vcDNA=SeqID_10853; Strand=-; Position=46-387
DDFERKATHSGKRSAGRHLRALHSYKPGLLVHQSEASYMPHDYTCDTRCPLHRCFGLLLKIHNTRAYQVLTALVFVLLWASSDSILASRLPSHGSEVHRIIKMWNKIIVGVLL

SEQ ID NO: 31157 - protein, 273 aa, Diabrotica virgifera
  misc_feature: Coding regions on vcDNA: vcDNA=SeqID_10854; Strand=+; Position=30-851
  misc_feature: Homolog annotation: Hit_ID=EAL38559.1; Match level="QueryCoverage =80%, HitCoverage=97%, E-value=5e-40, Identity=47%"; Hit description =ENSANGP00000027221 [Anopheles gambiae str. PEST] ref|XP_551141.1| ENSANGP00000027221 [Anopheles gambiae st
  misc_feature: Gene Ontology Annotation: Molecular function=structural constituent of eye lens
  misc_feature: Pfam annotation: Pfam_ID=Chitin_bind_4; Match level="Score=100.2, E -value=5.4e-27, Copies=1"; Pfam description=Insect cuticle protein
MAFKLISFLALVAAAHAGVISPQHSYSDAPSVSYSSVSTPDVSYGGPSYAKVAAPVHYAAAPAYKVAAPVSYSAPVAYAAPAYKVAAPVYKVAKQVVSEDYYSTPAHYDFGYGVEDPHTGDVKSQHETREGDVVKGSYSLIEADGTKRVVEYTVDAHSGFNAVVHREPSSHSVAAKYAAPAAYAQPAKYAAPIVYAQPIVKAVAPVAYAQPVLKAVAPVAYAQPIAKASYAPKLVGKVPSFQQSLIILSAPEVAYSQCFWLQKNMLVPSYYHH

SEQ ID NO: 31158 - protein, 208 aa, Diabrotica virgifera
  misc_feature: Coding regions on vcDNA: vcDNA=SeqID_10855; Strand=+; Position=41-667
MMFKFVFSISEVAVSMPQPTRDPLVDFFRGGLFRKPFSLPNTEIQSSVFEGAFSFPLPVRDPLLDLCLGMLFRNPSFADIQAQIFSLMVTSSLAFIPEIIGFGLGVHALHKVAEKLGVPDTVFKVEHNVPDQVFAEPDGRQYVLKKQWIGSTPVLAKVYSDNGQVAFVDSSSSVGTPVNNNAVNQGESGSGNAAIEYSNEEEWNNRHN

SEQ ID NO: 31159 - protein, 166 aa, Diabrotica virgifera
  misc_feature: Coding regions on vcDNA: vcDNA=SeqID_10856; Strand=+; Position=43-537
  misc_feature: Homolog annotation: Hit_ID=BAD52258.1; Match level="QueryCoverage =100%, HitCoverage=63%, E-value=4e-67, Identity=77%"; Hit description= proteasome alpha 4 subunit [Plutella xylostella]
  misc_feature: Gene Ontology Annotation: Molecular function=endopeptidase activity; Cellular component=proteasome core complex (sensu Eukarya); Biological process=ubiquitin-dependent protein catabolism
  misc_feature: Pfam annotation: Pfam_ID=Proteasome; Match level="Score=26.4, E-value= 2.7e-07, Copies=1"; Pfam description=Proteasome A-type and B-type
  misc_feature (30)..(30): Xaa can be any naturally occurring amino acid
  misc_feature (69)..(69): Xaa can be any naturally occurring amino acid
  misc_feature (104)..(104): Xaa can be any naturally occurring amino acid
MARRDDTRTTTSSPEGRTYQVEYAMEGISXHGGTCLGILANDGILVAAERRHANELLDDVVISEKIYKXLNEAMVCSVVGITSDANVITHEWRLIGHRYLFQYXESIPCEQLVSWLCDDTQAYTQHGGKRPFGVSILYMGWDKHHGYQLYPPDPRGYYSGWKATLL

SEQ ID NO: 31160 - protein, 44 aa, Diabrotica virgifera
  misc_feature: Coding regions on vcDNA: vcDNA=SeqID_10857; Strand=-; Position=124-258
ELVTLGIEEYFYWRVQIDNKDCDIDVGLKFIIGVAAILLSLFDF

SEQ ID NO: 31161 - protein, 47 aa, Diabrotica virgifera
  misc_feature: Coding regions on vcDNA: vcDNA=SeqID_10858; Strand=-; Position=1-141
AFPSPFTPSAATIDVLVSLSDNSTCSILFFRRHHKRAPNSGPPFAPV

SEQ ID NO: 31162 - protein, 81 aa, Diabrotica virgifera
  misc_feature: Coding regions on vcDNA: vcDNA=SeqID_10859; Strand=-; Position=1-243
  misc_feature (3)..(12): Xaa can be any naturally occurring amino acid
  misc_feature (15)..(23): Xaa can be any naturally occurring amino acid
  misc_feature (34)..(42): Xaa can be any naturally occurring amino acid
  misc_feature (44)..(53): Xaa can be any naturally occurring amino acid
  misc_feature (58)..(58): Xaa can be any naturally occurring amino acid
  misc_feature (63)..(76): Xaa can be any naturally occurring amino acid
  misc_feature (80)..(80): Xaa can be any naturally occurring amino acid
NYXXXXXXXXXXPFXXXXXXXXXIEPTWLTRFKXXXXXXXXXEXXXXXXXXXXYNLNXTSRSXXXXXXXXXXXXXXVSPXG

SEQ ID NO: 31163 - protein, 58 aa, Diabrotica virgifera
  misc_feature: Coding regions on vcDNA: vcDNA=SeqID_10860; Strand=-; Position=77-253
GCYILILYKHFNINILVINKVNLFDNQLDMLKNVLHFILIYTMFYIYVTYRHFNFISH

SEQ ID NO: 31164 - protein, 71 aa, Diabrotica virgifera
  misc_feature: Coding regions on vcDNA: vcDNA=SeqID_10861; Strand=-; Position=16-231
RRWTVFRAHLVRSRCRDPTTFRVTPLTSDIIRRICEVARSLACCALGERYILYGYPYVVSIHFFLSMYPSM

SEQ ID NO: 31165 - protein, 291 aa, Diabrotica virgifera
  misc_feature: Coding regions on vcDNA: vcDNA=SeqID_10862; Strand=+; Position=1-873
  misc_feature: Homolog annotation: Hit_ID=XP_393340.1; Match level="QueryCoverage =89%, HitCoverage=37%, E-value=5e-83, Identity=63%"; Hit description =similar to CG31064-PA [Apis mellifera]
  misc_feature: Gene Ontology Annotation: Molecular function=protein transporter activity; Cellular component=cytoplasm; Biological process=protein transport
SDEAIIIIGLLVGLNVIDCNLCVKEEDLDCPQGVIDFSLYLRSSSHVSTDSSNEEQGDAMITVLDQKNYIEELNRHLNATVANLQTKVESLTTTNALMKEDLAIAKNNLLTLYDENRQLPLKLGKESDGYALGISGGQITKVEEKETKEISKLIGSEVEELKHRLEEERKLRQEADNELEIQMCMKAEMGVAMKLLEKDIHEKQDTIISLRRQLDDIKLINLEMYKKLSGSEASLRHKTEFITKLEAKAQSMTDTIQSLENKYRESESNRVTAEQLKREVDMQARSSLRTG

SEQ ID NO: 31166 - protein, 302 aa, Diabrotica virgifera
  misc_feature: Coding regions on vcDNA: vcDNA=SeqID_10863; Strand=+; Position=70-975
  misc_feature: Homolog annotation: Hit_ID=NP_725856.1; Match level="QueryCoverage =89%, HitCoverage=77%, E-value=1e-41, Identity=33%"; Hit description =CG15111-PB, isoform B [Drosophila melanogaster] gb|AAM68437.1| CG15111-PB, isoform B [Drosophila
  misc_feature (247)..(253): Xaa can be any naturally occurring amino acid
MDLAILLIGFIILLLIFLAIWVIFPLVFMNSISVQRFFIFFNFQDPKNPEFNNPQKYGMTGVVNFYITTKDLIDGSLVSIGAWLLLQENQIQSTKIAGQDDKTASEIIRNTKSPIAIYLHGVGCNRIKPKETYEVLRKHFLVISLDHRGYGDSGPDKPPTELGIVGDTSQVFQWIRALTDNDIYVWGHSLGTALSTHSVKRLKEQSIVPSGLILESPFTTMREEIPATSLGKIFSWMPWFTATVLNXXXXXXXQFKTTTNILDVDCPIMVMHAQDDNVIPYTLGEKCTCCQYGTKNSDQGNV

SEQ ID NO: 31167 - protein, 120 aa, Diabrotica virgifera
  misc_feature: Coding regions on vcDNA: vcDNA=SeqID_10864; Strand=-; Position=0-359
  misc_feature (78)..(87): Xaa can be any naturally occurring amino acid
YVNFLLTCLSVFLTLTSIPYTNHNISTFLVDTTVFYFFICSLSFGSPFFVCLFVFSVVAAPPCLFLVAWFSVRLSSLXXXXXXXXXXSVSLKSFVCFFLRLAGPFRGRAEAFPIPAPVPP

SEQ ID NO: 31168 - protein, 56 aa, Diabrotica virgifera
  misc_feature: Coding regions on vcDNA: vcDNA=SeqID_10865; Strand=+; Position=126-296
RSDYKRNCCKLRMLILILLMMLLETRFCMKDIASHRDLCAVSPSRPVRITPYDRRK

SEQ ID NO: 31169 - protein, 149 aa, Diabrotica virgifera
  misc_feature: Coding regions on vcDNA: vcDNA=SeqID_10866; Strand=-; Position=1-447
  misc_feature (3)..(149): Xaa can be any naturally occurring amino acid
KKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31170 - protein, 36 aa, Diabrotica virgifera
  misc_feature: Coding regions on vcDNA: vcDNA=SeqID_10867; Strand=-; Position=0-107
  misc_feature (1)..(35): Xaa can be any naturally occurring amino acid
XXXXXXXXXXXXXXXXXXXXXXXXXXXXXXXXXXXA

SEQ ID NO: 31171 - protein, 124 aa, Diabrotica virgifera
  misc_feature: Coding regions on vcDNA: vcDNA=SeqID_10868; Strand=+; Position=295-669
  misc_feature (1)..(9): Xaa can be any naturally occurring amino acid
  misc_feature (21)..(38): Xaa can be any naturally occurring amino acid
  misc_feature (63)..(75): Xaa can be any naturally occurring amino acid
  misc_feature (80)..(90): Xaa can be any naturally occurring amino acid
  misc_feature (106)..(113): Xaa can be any naturally occurring amino acid
XXXXXXXXXLNIAIVEILYMXXXXXXXXXXXXXXXXXXQGLEIFIFWNMLLVICTYYYCYVLXXXXXXXXXXXXXLSYRXXXXXXXXXXXEQYIGEIKRIRQHLFXXXXXXXXFCIKDKVSHAH

SEQ ID NO: 31172 - protein, 97 aa, Diabrotica virgifera
  misc_feature: Coding regions on vcDNA: vcDNA=SeqID_10869; Strand=-; Position=3-293
  misc_feature (30)..(34): Xaa can be any naturally occurring amino acid
FVRVEVYCRHYYSVGEKYLREYTEDPRNTXXXXXFWFGCSSDGSYYESYVVAVSMEITATSVVHRAQENISHNLLMYHIFSVDHTHIKRTMCPPLKR

SEQ ID NO: 31173 - protein, 121 aa, Diabrotica virgifera
  misc_feature: Coding regions on vcDNA: vcDNA=SeqID_10870; Strand=+; Position=4-369
  misc_feature (2)..(14): Xaa can be any naturally occurring amino acid
  misc_feature (21)..(33): Xaa can be any naturally occurring amino acid
  misc_feature (36)..(43): Xaa can be any naturally occurring amino acid
  misc_feature (53)..(64): Xaa can be any naturally occurring amino acid
  misc_feature (66)..(85): Xaa can be any naturally occurring amino acid
  misc_feature (93)..(121): Xaa can be any naturally occurring amino acid
QXXXXXXXXXXXXXATSMLDXXXXXXXXXXXXXCSXXXXXXXXSLNRCEPGWXXXXXXXXXXXXKXXXXXXXXXXXXXXXXXXXXPNNKKRQXXXXXXXXXXXXXXXXXXXXXXXXXXXXX

SEQ ID NO: 31174 - protein, 81 aa, Diabrotica virgifera
  misc_feature: Coding regions on vcDNA: vcDNA=SeqID_10871; Strand=+; Position=706-948
  misc_feature (72)..(72): Xaa can be any naturally occurring amino acid
LSLRLSSPVVMLLYVNTPTVLQLNHCLKLSSQATCSVHNMLLLNNMLPCLNDLQNMIFIYFSSSDMAQILNXLIFIVIKIS

SEQ ID NO: 31175 - protein, 72 aa, Diabrotica virgifera
  misc_feature: Coding regions on vcDNA: vcDNA=SeqID_10872; Strand=-; Position=1-216
  misc_feature (1)..(66): Xaa can be any naturally occurring amino acid
XXXXXXXXXXXXXXXXXXXXXXXXXXXXXXXXXXXXXXXXXXXXXXXXXXXXXXXXXXXXXXXXXXIRIGRE

SEQ ID NO: 31176 - protein, 150 aa, Diabrotica virgifera
  misc_feature: Coding regions on vcDNA: vcDNA=SeqID_10873; Strand=+; Position=1-453
  misc_feature: Homolog annotation: Hit_ID=XP_397033.1; Match level="QueryCoverage =98%, HitCoverage=9%, E-value=9e-36, Identity=54%"; Hit description =similar to CG9246-PA [Apis mellifera]
  misc_feature (139)..(139): Xaa can be any naturally occurring amino acid
TKCRKVFASSAFYEKGFHPTVEDQIKLANRISSSLSDISNKSSKGQSMYVKRMKRSVKWVHEGEGRGGFNGQELGSSDGTPKDPLKLVMNPHGQVHDINSLRKQGYNVEPALLSPEIAQEIVKGLNSPKGKGAELFSKXRKRSEKWVDVR

SEQ ID NO: 31177 - protein, 74 aa, Diabrotica virgifera
  misc_feature: Coding regions on vcDNA: vcDNA=SeqID_10874; Strand=-; Position=167-391
QTERHHEGVHDDCYGYSHAGMILSLTFWFKKVFYDIGLYFCVLWLGYDLDSCGYTRDLMSCDIHLNSLDKQAHK

SEQ ID NO: 31178 - protein, 32 aa, Diabrotica virgifera
  misc_feature: Coding regions on vcDNA: vcDNA=SeqID_10875; Strand=-; Position=1-96
  misc_feature (2)..(31): Xaa can be any naturally occurring amino acid
PXXXXXXXXXXXXXXXXXXXXXXXXXXXXXXK

SEQ ID NO: 31179 - protein, 243 aa, Diabrotica virgifera
  misc_feature: Coding regions on vcDNA: vcDNA=SeqID_10876; Strand=+; Position=1-732
  misc_feature: Homolog annotation: Hit_ID=XP_392843.1; Match level="QueryCoverage =95%, HitCoverage=83%, E-value=1e-115, Identity=88%"; Hit description= similar to ENSANGP00000015322 [Apis mellifera]
  misc_feature: Gene Ontology Annotation: Molecular function=structural constituent of ribosome; Cellular component=cytosolic small ribosomal subunit (sensu Eukarya); Biological process=protein biosynthesis
  misc_feature: Pfam annotation: Pfam_ID=Ribosomal_S5; Match level="Score=137.1, E -value=4e-38, Copies=1"; Pfam description=Ribosomal protein S5, N -terminal doma
LLLFILHTKDQKEWVPVTKLGRLVKDGKIRSLEEIYLFSLPIKEFEIIDHFIGSDLNDEVLKIMPVQKQTRAGQRTRFKAFVAIGDSKGHIGLGVKCSKEVATAIRGAIILAKLSVVPVRRGYWGNKIGQPHTVPCKVTGKCGSVTVRLIPAPRGTGIVSAPVPKKLLQMAGIEDCYTSARGSTGTLGNFAKATYAAIAKTYAYLTPDLWKDMALAKTPYQEFADYLAKNHRPVTGPARAETA

SEQ ID NO: 31180 - protein, 18 aa, Diabrotica virgifera
  misc_feature: Coding regions on vcDNA: vcDNA=SeqID_10877; Strand=+; Position=3-56
  misc_feature (3)..(3): Xaa can be any naturally occurring amino acid
  misc_feature (6)..(6): Xaa can be any naturally occurring amino acid
  misc_feature (11)..(11): Xaa can be any naturally occurring amino acid
  misc_feature (16)..(16): Xaa can be any naturally occurring amino acid
SLXFFXRRETXIEFYXII

SEQ ID NO: 31181 - protein, 34 aa, Diabrotica virgifera; identical to SEQ ID NO: 27603
  misc_feature: Coding regions on vcDNA: vcDNA=SeqID_10878; Strand=-; Position=80-184

SEQ ID NO: 31182 - protein, 32 aa, Diabrotica virgifera
  misc_feature: Coding regions on vcDNA: vcDNA=SeqID_10879; Strand=-; Position=1-96
  misc_feature (3)..(21): Xaa can be any naturally occurring amino acid
  misc_feature (23)..(31): Xaa can be any naturally occurring amino acid
KKXXXXXXXXXXXXXXXXXXXPXXXXXXXXXI

SEQ ID NO: 31183 - protein, 64 aa, Diabrotica virgifera
  misc_feature: Coding regions on vcDNA: vcDNA=SeqID_10880; Strand=+; Position=79-273
  misc_feature (5)..(11): Xaa can be any naturally occurring amino acid
FWAIXXXXXXXYIFFLCLGCMDNLLVIHYCFSSTTQVGLDLYRLYICLLSLVDGRVTRSYVHPI

SEQ ID NO: 31184 - protein, 85 aa, Diabrotica virgifera
  misc_feature: Coding regions on vcDNA: vcDNA=SeqID_10881; Strand=-; Position=0-254
  misc_feature (5)..(26): Xaa can be any naturally occurring amino acid
  misc_feature (29)..(84): Xaa can be any naturally occurring amino acid
KKMGXXXXXXXXXXXXXXXXXXXXXXSPXXXXXXXXXXXXXXXXXXXXXXXXXXXXXXXXXXXXXXXXXXXXXXXXXXXXXXXXP

SEQ ID NO: 31185 - protein, 245 aa, Diabrotica virgifera
  misc_feature: Coding regions on vcDNA: vcDNA=SeqID_10882; Strand=+; Position=23-760
  misc_feature: Homolog annotation: Hit_ID=XP_392155.1; Match level="QueryCoverage =91%, HitCoverage=93%, E-value=2e-44, Identity=43%"; Hit description =similar to ENSANGP00000011718 [Apis mellifera]
  misc_feature: Pfam annotation: Pfam_ID=Secretogranin_V; Match level="Score=125.2, E- value=1.6e-34, Copies=1"; Pfam description=Neuroendocrine protein 7B2 precursor
  misc_feature (230)..(230): Xaa can be any naturally occurring amino acid
MKITILMCCLTGAMCYLPPAKESLLSGLFLRDLVNRINGKGISEGDGVSYLDFTDGLPLDGRSLSGTLEEEQMFPVDYETMGEMNMHPSIRDQEYLQHSTLWGKQYLNGDRDENSILHHNGFKNKNGLKGESTLPAYCSPPNPCPIGYTADHGCIEMFDNTASFSRRYQASQNCMCDTEHMFECPTSNDISDDNSMDMIDSYHFNKMLQQSAKSKNNPFLTGEKLPVAAXKGNNVLLTYNTNPQL

SEQ ID NO: 31186 - protein, 145 aa, Diabrotica virgifera
  misc_feature: Coding regions on vcDNA: vcDNA=SeqID_10883; Strand=+; Position=3-440
  misc_feature: Homolog annotation: Hit_ID=NP_659181.1; Match level="QueryCoverage =97%, HitCoverage=63%, E-value=3e-38, Identity=53%"; Hit description =cDNA sequence BC021611 [Mus musculus] gb|AAH21611.1| BC021611 protein [Mus musculus]
  misc_feature: Gene Ontology Annotation: Molecular function=AMP binding; Cellular component=peroxisomal membrane; Biological process=biological _process unknown
IFKEYFNRPEATRKEFTSDGWFKTGDVSEYSLEDKEFKILGRKSVDIIKSGGYKLSALEIETKLLLHPHILECVVVGLDDDKWGQRVVAAVVLHEGKELTLEELREWAKDKMPPYWIPSVVKPVASIPKNAMGKVNKKDLIKSWM

SEQ ID NO: 31187 - protein, 71 aa, Diabrotica virgifera
  misc_feature: Coding regions on vcDNA: vcDNA=SeqID_10884; Strand=-; Position=101-316
  misc_feature (36)..(53): Xaa can be any naturally occurring amino acid
VSSLKAAPLNNVLVFTPRNIVQKTNQDLVVMQSLEXXXXXXXXXXXXXXXXXXDYHSNGRYMVPMIDSFNV

SEQ ID NO: 31188 - protein, 97 aa, Diabrotica virgifera
  misc_feature: Coding regions on vcDNA: vcDNA=SeqID_10885; Strand=+; Position=2-295
  misc_feature: Homolog annotation: Hit_ID=EAA10867.2; Match level="QueryCoverage =72%, HitCoverage=89%, E-value=3e-29, Identity=65%"; Hit description =ENSANGP00000013850 [Anopheles gambiae str. PEST] ref|XP_556442.1| ENSANGP00000013850 [Anopheles gambiae st
LKLLLQICVLILAASYVDNRVINKRSTDSSIKGYLTERICWWNEICKEEFRSQFRCKCPEWSYCRAPGKYYNAFCTMTTTGYIWQQPGWREAAESQN

SEQ ID NO: 31189 - protein, 79 aa, Diabrotica virgifera
  misc_feature: Coding regions on vcDNA: vcDNA=SeqID_10886; Strand=-; Position=2-238
  misc_feature (4)..(59): Xaa can be any naturally occurring amino acid
  misc_feature (63)..(79): Xaa can be any naturally occurring amino acid
KKWXXXXXXXXXXXXXXXXXXXXXXXXXXXXXXXXXXXXXXXXXXXXXXXXXXXXXXXXFLLXXXXXXXXXXXXXXXXX

SEQ ID NO: 31190 - protein, 75 aa, Diabrotica virgifera
  misc_feature: Coding regions on vcDNA: vcDNA=SeqID_10887; Strand=+; Position=2-229
  misc_feature: Homolog annotation: Hit_ID=AAK28318.1; Match level="QueryCoverage =89%, HitCoverage=27%, E-value=4e-13, Identity=53%"; Hit description =putative deoxynucleoside kinase [Bombyx mori]
RILKRNRSEEKTVAFEYIKALHEIHDDWLYNKTLHDCKAPVIVLNADLDRSVIEEEYEKYEPHILNKKPVGVKIG

SEQ ID NO: 31191 - protein, 184 aa, Diabrotica virgifera
  misc_feature: Coding regions on vcDNA: vcDNA=SeqID_10888; Strand=+; Position=3-557
  misc_feature (1)..(134): Xaa can be any naturally occurring amino acid
  misc_feature (137)..(144): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYFXXXXXXXXQIKLFTGIADANKRHENIYNGGRSIGAGGYVLILFLTPYT

SEQ ID NO: 31192 - protein, 51 aa, Diabrotica virgifera
  misc_feature: Coding regions on vcDNA: vcDNA=SeqID_10889; Strand=-; Position=2-154
  misc_feature (8)..(16): Xaa can be any naturally occurring amino acid
LEILGFSXXXXXXXXXFLLIVRLTSIIIIQIYYQNYLVNNSLIDFVITDAK

SEQ ID NO: 31193 - protein, 138 aa, Diabrotica virgifera
  misc_feature: Coding regions on vcDNA: vcDNA=SeqID_10890; Strand=-; Position=129-545
  misc_feature: Homolog annotation: Hit_ID=BAC82592.1; Match level="QueryCoverage =65%, HitCoverage=10%, E-value=6e-10, Identity=35%"; Hit description =reverse transcriptase [Ciona intestinalis]
  misc_feature (82)..(82): Xaa can be any naturally occurring amino acid
IKLKLTILYSLFGFRNALCTSGLFSLQVVLIQRCRDMNKNVYICFIDYAKAFDNVKHEKIIQVLHKTGIDYRDIRTIVSLYXGQTATVKIESTLTNKIEIKEEVRQGSTLSHILFNIYSEEVFKTALEINGEIINNIR

SEQ ID NO: 31194 - protein, 61 aa, Diabrotica virgifera
  misc_feature: Coding regions on vcDNA: vcDNA=SeqID_10891; Strand=-; Position=1-183
  misc_feature (3)..(47): Xaa can be any naturally occurring amino acid
  misc_feature (52)..(59): Xaa can be any naturally occurring amino acid
KLXXXXXXXXXXXXXXXXXXXXXXXXXXXXXXXXXXXXXXXXXXXXXLGFFXXXXXXXXFY

SEQ ID NO: 31195 - protein, 231 aa, Diabrotica virgifera
  misc_feature: Coding regions on vcDNA: vcDNA=SeqID_10892; Strand=+; Position=199-893
  misc_feature: Homolog annotation: Hit_ID=EAA11902.3; Match level="QueryCoverage =74%, HitCoverage=35%, E-value=3e-60, Identity=63%"; Hit description =ENSANGP00000018572 [Anopheles gambiae str. PEST] ref|XP_556430.1| ENSANGP00000018572 [Anopheles gambiae st
  misc_feature (122)..(131): Xaa can be any naturally occurring amino acid
  misc_feature (168)..(168): Xaa can be any naturally occurring amino acid
  misc_feature (192)..(192): Xaa can be any naturally occurring amino acid
MSREISRRLSLTALQFQRTYATDRPYSTALGVVSDEMQDKDIYEYKIEKVDPIPKDYKEIPGPKELPFIGNSWRFAPIIGHYKIHELDKVMWSLHKQYGKIAKVSGLIGHPDLLFIFDGDEXXXXXXXXXXMPHRPSMPSLHYYKQKLQKDFFNGNEGIIGVHGPKWXTFRKQVQQFLLPPITAKKYIEPLXEIFTDFINRMGNMLDTNRELPDHFLSEIYKWAFRSGSES

SEQ ID NO: 31196 - protein, 69 aa, Diabrotica virgifera
  misc_feature: Coding regions on vcDNA: vcDNA=SeqID_10893; Strand=-; Position=15-224
KESMYLLVHVPSLRRRLAIIKSIPIIHAAPMNSSQDVHPYHSLKFRIPEIRLLPSLLYAKIFSGPNNCL

SEQ ID NO: 31197 - protein, 57 aa, Diabrotica virgifera
  misc_feature: Coding regions on vcDNA: vcDNA=SeqID_10894; Strand=-; Position=202-375
EIKSPNLKTYILLLYVAAYSNAIYTFLNKCRLLSKDNESLRVFTSIHHPVQLFKSVL

SEQ ID NO: 31198 - protein, 230 aa, Diabrotica virgifera
  misc_feature: Coding regions on vcDNA: vcDNA=SeqID_10895; Strand=+; Position=155-847
  misc_feature: Homolog annotation: Hit_ID=NP_524775.1; Match level="QueryCoverage =75%, HitCoverage=23%, E-value=2e-39, Identity=52%"; Hit description =CG17100-PA [Drosophila melanogaster] gb|AAF54527.2| CG17100-PA [Drosophila melanogaster]
  misc_feature: Gene Ontology Annotation: Molecular function=transcription factor activity; Cellular component=nucleus; Biological process=neurogenesis
  misc_feature: Pfam annotation: Pfam_ID=HLH; Match level="Score=60.0, E-value=6.6e -15, Copies=1"; Pfam description=Helix-loop-helix DNA-binding domain
MDMTPTYWEENSNIQPIQRVKYESCNAHDESSRMKEERTVYTCCDTNLNFSTATCSEDDCEYGPYKKNKVARQDPMSHRIIEKRRRDRMNNCLADLSRLIPTEYLKKGRGRIEKTEIIEMAIKHMKYLQQDQGNPTEHYRLGYQECMSEAMRFMVEVEGHFPREAICVRLLNHLQKHGDSFSRASFNGNHHSSLLTEHIVPVPNIPEPISNDVNPKTVGYSLPKWNPNPQ

SEQ ID NO: 31199 - protein, 37 aa, Diabrotica virgifera
  misc_feature: Coding regions on vcDNA: vcDNA=SeqID_10896; Strand=-; Position=1-111
  misc_feature (1)..(23): Xaa can be any naturally occurring amino acid
  misc_feature (25)..(37): Xaa can be any naturally occurring amino acid
XXXXXXXXXXXXXXXXXXXXXXXHXXXXXXXXXXXXX

SEQ ID NO: 31200 - protein, 89 aa, Diabrotica virgifera
  misc_feature: Coding regions on vcDNA: vcDNA=SeqID_10897; Strand=-; Position=2-268
  misc_feature (8)..(9): Xaa can be any naturally occurring amino acid
  misc_feature (11)..(23): Xaa can be any naturally occurring amino acid
  misc_feature (26)..(36): Xaa can be any naturally occurring amino acid
  misc_feature (46)..(53): Xaa can be any naturally occurring amino acid
  misc_feature (56)..(69): Xaa can be any naturally occurring amino acid
  misc_feature (75)..(88): Xaa can be any naturally occurring amino acid
LHDWFVRXXLXXXXXXXXXXXXXPFXXXXXXXXXXXTNLAHTGLNXXXXXXXXSNXXXXXXXXXXXXXXPTSRSXXXXXXXXXXXXXXV

SEQ ID NO: 31201 - protein, 42 aa, Diabrotica virgifera
  misc_feature: Coding regions on vcDNA: vcDNA=SeqID_10898; Strand=+; Position=3-131
  misc_feature (1)..(25): Xaa can be any naturally occurring amino acid
  misc_feature (31)..(31): Xaa can be any naturally occurring amino acid
XXXXXXXXXXXXXXXXXXXXXXXXXINYLRXYQRILLGEVNR

SEQ ID NO: 31202 - protein, 311 aa, Diabrotica virgifera
  misc_feature: Coding regions on vcDNA: vcDNA=SeqID_10899; Strand=-; Position=6-941
  misc_feature (1)..(2): Xaa can be any naturally occurring amino acid
  misc_feature (7)..(14): Xaa can be any naturally occurring amino acid
  misc_feature (30)..(38): Xaa can be any naturally occurring amino acid
  misc_feature (40)..(310): Xaa can be any naturally occurring amino acid
XXKVDRXXXXXXXXNYNLNPTSRSQSYLSXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXD

SEQ ID NO: 31203 - protein, 57 aa, Diabrotica virgifera
  misc_feature: Coding regions on vcDNA: vcDNA=SeqID_10900; Strand=-; Position=65-238
ETLRLMFPSSKITMLDIKCLYAVKIQNESQVTLLTTKVWCWIHTKRLFSEKLSLLLA

SEQ ID NO: 31204 - protein, 98 aa, Diabrotica virgifera
  misc_feature: Coding regions on vcDNA: vcDNA=SeqID_10901; Strand=-; Position=956 -1252
  misc_feature (9)..(21): Xaa can be any naturally occurring amino acid
  misc_feature (26)..(48): Xaa can be any naturally occurring amino acid
  misc_feature (57)..(65): Xaa can be any naturally occurring amino acid
KKKKTPPPXXXXXXXXXXXXXFFKLXXXXXXXXXXXXXXXXXXXXXXXAKGHPNPAXXXXXXXXXVVKRKPSLYSFGKIYMEVGKKTKPFKSIIFTKP

SEQ ID NO: 31205 - protein, 40 aa, Diabrotica virgifera
  misc_feature: Coding regions on vcDNA: vcDNA=SeqID_10902; Strand=-; Position=1-120
  misc_feature (2)..(37): Xaa can be any naturally occurring amino acid
PXXXXXXXXXXXXXXXXXXXXXXXXXXXXXXXXXXXXFLN

SEQ ID NO: 31206 - protein, 207 aa, Diabrotica virgifera
  misc_feature: Coding regions on vcDNA: vcDNA=SeqID_10903; Strand=-; Position=0-620
  misc_feature (72)..(140): Xaa can be any naturally occurring amino acid
  misc_feature (146)..(163): Xaa can be any naturally occurring amino acid
  misc_feature (165)..(175): Xaa can be any naturally occurring amino acid
NSGQSAHMYTVLDSHKTHTHASAPLSHHTLSREPGPPPAPPRYTHASPHTRVYIYTRVHKLKKKYYNMFLTXXXXXXXXXXXXXXXXXXXXXXXXXXXXXXXXXXXXXXXXXXXXXXXXXXXXXXXXXXXXXXXXXXXXXIYTYIXXXXXXXXXXXXXXXXXXHXXXXXXXXXXXRPLEKVQKNHIWRETHLNFLLLLFHLACLYRL

SEQ ID NO: 31207 - protein, 223 aa, Diabrotica virgifera
  misc_feature: Coding regions on vcDNA: vcDNA=SeqID_10904; Strand=+; Position=207-874
  misc_feature: Homolog annotation: Hit_ID=XP_393983.1; Match level="QueryCoverage =95%, HitCoverage=38%, E-value=3e-72, Identity=58%"; Hit description =similar to Primase polypeptide 1 [Apis mellifera]
  misc_feature: Gene Ontology Annotation: Molecular function=DNA primase activity; Cellular component=alpha DNA polymerase:primase complex; Biological process=DNA replication, priming
  misc_feature: Pfam annotation: Pfam_ID=DNA_primase_S; Match level="Score=116.8, E -value=5.3e-32, Copies=1"; Pfam description=DNA primase small subunit
  misc_feature (198)..(198): Xaa can be any naturally occurring amino acid
MSVEYNPDTLGDLLPLYYRRLFPHSQFYRWLSYGHTLTFAKREISFTLLGDIYIRYQSFDTQEDFSNELQKKFPMKIDLGAIYQTKPRDKGPVSQIVPVEKEIVFDIDMTDYDDIRTCCSGADVCTKCWKFMVIACKILDAALYHDFGFNHRLWVFSGRRGIHCWVCDPQARVMDESIRSCIGDYLQIVRGGANVYKXVQLPGEKIHASLERGLGIINTYFTT

SEQ ID NO: 31208 - protein, 93 aa, Diabrotica virgifera
  misc_feature: Coding regions on vcDNA: vcDNA=SeqID_10905; Strand=-; Position=1-279
SKFILVVQGSGLFWTVFWIVRQCHVGYIGCITVESLGVGKCGRVCWIVRQCHVGYIGCITVESLGVGKCGRVCWIVRQCHVGYIGCITVRTRG

SEQ ID NO: 31209 - protein, 92 aa, Diabrotica virgifera
  misc_feature: Coding regions on vcDNA: vcDNA=SeqID_10906; Strand=+; Position=213-491
  misc_feature (35)..(41): Xaa can be any naturally occurring amino acid
  misc_feature (44)..(63): Xaa can be any naturally occurring amino acid
SSLKSFMLCNLLPLYLCLLCYHKTSIATALGFFNXXXXXXXLLXXXXXXXXXXXXXXXXXXXXIKQYKVTVRSFLPPLFIDINYFPVAWVIY

SEQ ID NO: 31210 - protein, 61 aa, Diabrotica virgifera
  misc_feature: Coding regions on vcDNA: vcDNA=SeqID_10907; Strand=-; Position=2-184
  misc_feature (54)..(60): Xaa can be any naturally occurring amino acid
VSDRSIYYLITITYILLGPPEQCNCLSTHGYTYIIAVKRYDDSTNSLYLLTQNXXXXXXXV

SEQ ID NO: 31211 - protein, 95 aa, Diabrotica virgifera
  misc_feature: Coding regions on vcDNA: vcDNA=SeqID_10908; Strand=+; Position=21-308
  misc_feature (3)..(15): Xaa can be any naturally occurring amino acid
  misc_feature (35)..(53): Xaa can be any naturally occurring amino acid
  misc_feature (58)..(79): Xaa can be any naturally occurring amino acid
  misc_feature (81)..(87): Xaa can be any naturally occurring amino acid
NMXXXXXXXXXXXXXYQNINFDYLDFVMIILVLKXXXXXXXXXXXXXXXXXXXSPVYXXXXXXXXXXXXXXXXXXXXXXRXXXXXXXHIPSAFFY

SEQ ID NO: 31212 - protein, 298 aa, Diabrotica virgifera
  misc_feature: Coding regions on vcDNA: vcDNA=SeqID_10909; Strand=+; Position=28-921
  misc_feature: Homolog annotation: Hit_ID=XP_317383.1; Match level="QueryCoverage =92%, HitCoverage=64%, E-value=8e-47, Identity=38%"; Hit description =ENSANGP00000011629 [Anopheles gambiae]
  misc_feature: Gene Ontology Annotation: Molecular function=GPI-anchor transamidase activity; Cellular component=cellular_component unknown; Biological process=attachment of GPI anchor to protein
MSLKNFTTTPNDPVSTVRIISTCVSAIILRYYLMLSKYQSVIANHVEVSTPLNSWKRVSEGLYLLSLNINPYNGDVLHETPLSLYWYKTSLQLFQGKVHLIFITLEIATSIVLYYTIKRFAAVIYEEEERDRKTFSKDAEDSLLKPEKIFRTPYYVLLAYLFNPYTLLNSVGFSTTVFYNFYLSVVLFSMVYGLPLLCGVFLAMSASVSFYPVVLLLPASFYYQQIFKSSLKTVTCVVSFIVTSLLIVSVCSDSFNNFSYIRNVYGCILNVPDLQPNIGLFWVLFTEMFETLRELLYM

SEQ ID NO: 31213 - protein, 43 aa, Diabrotica virgifera
  misc_feature: Coding regions on vcDNA: vcDNA=SeqID_10910; Strand=+; Position=12-143
  misc_feature (22)..(29): Xaa can be any naturally occurring amino acid
GRAWHAVQGPGPSPPAPPFPGXXXXXXXXILPQTKKTKIIDDW

SEQ ID NO: 31214 - protein, 133 aa, Diabrotica virgifera
  misc_feature: Coding regions on vcDNA: vcDNA=SeqID_10911; Strand=+; Position=3-404
  misc_feature (1)..(18): Xaa can be any naturally occurring amino acid
  misc_feature (33)..(39): Xaa can be any naturally occurring amino acid
  misc_feature (41)..(78): Xaa can be any naturally occurring amino acid
  misc_feature (85)..(127): Xaa can be any naturally occurring amino acid
XXXXXXXXXXXXXXXXXXEVMFVVKYIYFFNKXXXXXXXQXXXXXXXXXXXXXXXXXXXXXXXXXXXXXXXXXXXXXXILLILKXXXXXXXXXXXXXXXXXXXXXXXXXXXXXXXXXXXXXXXXXXXKYIGLV

SEQ ID NO: 31215 - protein, 206 aa, Diabrotica virgifera
  misc_feature: Coding regions on vcDNA: vcDNA=SeqID_10912; Strand=+; Position=35-655
  misc_feature: Homolog annotation: Hit_ID=XP_394110.1; Match level="QueryCoverage =93%, HitCoverage=24%, E-value=4e-68, Identity=61%"; Hit description =similar to ENSANGP00000010932 [Apis mellifera]
  misc_feature: Gene Ontology Annotation: Molecular function=3'-5' exoribonuclease activity; Cellular component=nuclear exosome (RNase complex); Biological process=rRNA processing
FKYLCLKMSESLICLPGQRLCLCDKVYTSGQGTYERQGYVYSQLAGYVDVVEKDGVKIVEVHTSGEQTVVPAQGDIVTAQVSVITQQYAKCFIKCVGDTVLRRPFKAVLRREDVRATEKDKVEIYKSCRPGDIILARVLPITEAHNYQLSTAENELGVVIAHSENGHPMVPISWTEMQCSKSFVKEPRKVAKVVPENYNQENTSAG

SEQ ID NO: 31216 - protein, 62 aa, Diabrotica virgifera
  misc_feature: Coding regions on vcDNA: vcDNA=SeqID_10913; Strand=-; Position=50-238
HYTSMYLLYNFIPTQSDSIHHISNVLRTTKLKNAFIRHCLMIHQLYRIYYLKIHMFWVLIPH

SEQ ID NO: 31217 - protein, 90 aa, Diabrotica virgifera
  misc_feature: Coding regions on vcDNA: vcDNA=SeqID_10914; Strand=+; Position=168-437
NQQRNHQRRMYRSVLPINSNTNSVKVQECSLYPGQGCVMLYVSYTEDDKGFRPEGDHIKVPPFVACILQHSEDGSNGSDSNNVPDSDADQ

SEQ ID NO: 31218 - protein, 109 aa, Diabrotica virgifera
  misc_feature: Coding regions on vcDNA: vcDNA=SeqID_10915; Strand=-; Position=2-328
  misc_feature (4)..(11): Xaa can be any naturally occurring amino acid
  misc_feature (49)..(109): Xaa can be any naturally occurring amino acid
KGGXXXXXXXXFPPFNKPLTHTGGADILLSIGPLQKKIRLLSLKLIYSXXXXXXXXXXXXXXXXXXXXXXXXXXXXXXXXXXXXXXXXXXXXXXXXXXXXXXXXXXXXX

SEQ ID NO: 31219 - protein, 79 aa, Diabrotica virgifera
  misc_feature: Coding regions on vcDNA: vcDNA=SeqID_10916; Strand=+; Position=190-429
  misc_feature: Homolog annotation: Hit_ID=XP_310353.1; Match level="QueryCoverage =91%, HitCoverage=98%, E-value=7e-31, Identity=81%"; Hit description =ENSANGP00000005592 [Anopheles gambiae]
  misc_feature: Gene Ontology Annotation: Molecular function=molecular_function unknown; Cellular component=cellular_component unknown; Biological process=regulation of cell cycle
  misc_feature: Pfam annotation: Pfam_ID=CKS; Match level="Score=170.4, E-value=3.8e -48, Copies=1"; Pfam description=Cyclin-dependent kinase regulatory sub
MPAETIQYSEKYCDEMYEYRHVILPPDLAKLVPRPHLMTETEWRNLGVQQSPNWVHYMLHAPEPHVLLFRRPLRLVHLH

SEQ ID NO: 31220 - protein, 79 aa, Diabrotica virgifera
  misc_feature: Coding regions on vcDNA: vcDNA=SeqID_10917; Strand=-; Position=0-236
  misc_feature (14)..(23): Xaa can be any naturally occurring amino acid
  misc_feature (25)..(46): Xaa can be any naturally occurring amino acid
  misc_feature (49)..(77): Xaa can be any naturally occurring amino acid
PKKNFALVSPLRVXXXXXXXXXXGXXXXXXXXXXXXXXXXXXXXXXPPXXXXXXXXXXXXXXXXXXXXXXXXXXXXXSR

SEQ ID NO: 31221 - protein, 22 aa, Diabrotica virgifera
  misc_feature: Coding regions on vcDNA: vcDNA=SeqID_10918; Strand=-; Position=0-65
  misc_feature (5)..(21): Xaa can be any naturally occurring amino acid
SIQAXXXXXXXXXXXXXXXXXG

SEQ ID NO: 31222 - protein, 102 aa, Diabrotica virgifera
  misc_feature: Coding regions on vcDNA: vcDNA=SeqID_10919; Strand=-; Position=116-424
SAMTPNSPKNPTLYHFYRSSCSVTITNMYFSYEKLINKTLVLVEYNKNVPLAIRIPHQKFPDDKFLLQAAHFCYTPPAQSHFNPFLIRKINISNGIKSTGTI

SEQ ID NO: 31223 - protein, 62 aa, Diabrotica virgifera
  misc_feature: Coding regions on vcDNA: vcDNA=SeqID_10920; Strand=-; Position=0-185
  misc_feature (2)..(58): Xaa can be any naturally occurring amino acid
PXXXXXXXXXXXXXXXXXXXXXXXXXXXXXXXXXXXXXXXXXXXXXXXXXXXXXXXXXPTPS

SEQ ID NO: 31224 - protein, 57 aa, Diabrotica virgifera
  misc_feature: Coding regions on vcDNA: vcDNA=SeqID_10921; Strand=+; Position=1-174
TLRDNSVIFIWKRSNRIIRCATSRVGIKVFKFGGASLILFKVLVPPFNKFFTLNSEG

SEQ ID NO: 31225 - protein, 52 aa, Diabrotica virgifera
  misc_feature: Coding regions on vcDNA: vcDNA=SeqID_10922; Strand=-; Position=198-356
MSKFDPLVEKDYLLEANVDYALMQYPNRKKSTVATKYSAPKNDLKLLNHNSD

SEQ ID NO: 31226 - protein, 107 aa, Diabrotica virgifera
  misc_feature: Coding regions on vcDNA: vcDNA=SeqID_10923; Strand=+; Position=178-501
YTCIPYLLVQDSSKTTVALEQPIFLNAFCALICLSYCTPILPFSGPMLTSLILQISLNATHTLSHCYSTFFGDVLIFHNCITPFFLHNDWHQKFPVCHHTVPMHYPL

SEQ ID NO: 31227 - protein, 94 aa, Diabrotica virgifera
  misc_feature: Coding regions on vcDNA: vcDNA=SeqID_10924; Strand=-; Position=244-528
  misc_feature (24)..(32): Xaa can be any naturally occurring amino acid
  misc_feature (43)..(53): Xaa can be any naturally occurring amino acid
  misc_feature (58)..(73): Xaa can be any naturally occurring amino acid
NKQDDGSATSARVDTPRPVKLSSXXXXXXXXXKKGSFLINSCXXXXXXXXXXXYILIXXXXXXXXXXXXXXXXITSNLYWDRVNLKNQNNHISK

SEQ ID NO: 31228 - protein, 47 aa, Diabrotica virgifera; identical to SEQ ID NO: 26759
  misc_feature: Coding regions on vcDNA: vcDNA=SeqID_10925; Strand=+; Position=2-145
  misc_feature (1)..(15): Xaa can be any naturally occurring amino acid
  misc_feature (17)..(24): Xaa can be any naturally occurring amino acid

SEQ ID NO: 31229 - protein, 121 aa, Diabrotica virgifera
  misc_feature: Coding regions on vcDNA: vcDNA=SeqID_10926; Strand=-; Position=423-788
  misc_feature (8)..(24): Xaa can be any naturally occurring amino acid
  misc_feature (71)..(79): Xaa can be any naturally occurring amino acid
  misc_feature (88)..(116): Xaa can be any naturally occurring amino acid
IFEKVNKXXXXXXXXXXXXXXXXXANDYDTLARSRSRGHSTLSVGCRVFISKTQSHDNQMQEILMYPNSNXXXXXXXXXFNILILTSXXXXXXXXXXXXXXXXXXXXXXXXXXXXXSFHIR

SEQ ID NO: 31230 - protein, 45 aa, Diabrotica virgifera
  misc_feature: Coding regions on vcDNA: vcDNA=SeqID_10927; Strand=-; Position=105-242
PNVTTQPVSRDILQIYAGWVKRHINPKYHARHRPLCHTQLILASV

SEQ ID NO: 31231 - protein, 101 aa, Diabrotica virgifera
  misc_feature: Coding regions on vcDNA: vcDNA=SeqID_10928; Strand=-; Position=40-345
  misc_feature (78)..(87): Xaa can be any naturally occurring amino acid
RLSILVLSNNPIIIIVNTSTFNVVFSFWISFPAKNRKLITLIFHHRIVSVFLFSRTYKKIVNRDYKILILQSLILKYXXXXXXXXXXQFLSLPLYTYIKHN

SEQ ID NO: 31232 - protein, 59 aa, Diabrotica virgifera
  misc_feature: Coding regions on vcDNA: vcDNA=SeqID_10929; Strand=+; Position=1-180
LGYCSFRQISKLAFALSVASRIHASVFTSSLAICGYIRTYGEMICIKYEIKYCCTALVV

SEQ ID NO: 31233 - protein, 91 aa, Diabrotica virgifera
  misc_feature: Coding regions on vcDNA: vcDNA=SeqID_10930; Strand=-; Position=640-915
  misc_feature (3)..(44): Xaa can be any naturally occurring amino acid
ELXXXXXXXXXXXXXXXXXXXXXXXXXXXXXXXXXXXXXXXXXXFISSNADTNMNGVLVSSVPISSSSYVIYSITIYSIENRISHLSCITQ

SEQ ID NO: 31234 - protein, 95 aa, Diabrotica virgifera
  misc_feature: Coding regions on vcDNA: vcDNA=SeqID_10931; Strand=-; Position=66-353
  misc_feature (74)..(81): Xaa can be any naturally occurring amino acid
ENSYVHDLGVDMGTCSKFSSPRCPRLAGACILLVFAARVVLIQSISFYSTYSSLMKRTRQHQSILQFGILLEIXXXXXXXXESDAKKYKNVKDEK

SEQ ID NO: 31235 - protein, 79 aa, Diabrotica virgifera
  misc_feature: Coding regions on vcDNA: vcDNA=SeqID_10932; Strand=-; Position=3-239
  misc_feature (4)..(14): Xaa can be any naturally occurring amino acid
  misc_feature (16)..(24): Xaa can be any naturally occurring amino acid
  misc_feature (46)..(59): Xaa can be any naturally occurring amino acid
  misc_feature (66)..(78): Xaa can be any naturally occurring amino acid
NIMXXXXXXXXXXXFXXXXXXXXXDRNQPGSHRFKLRSCKIVKVEXXXXXXXXXXXXXXSNIEVAXXXXXXXXXXXXXC

SEQ ID NO: 31236 - protein, 31 aa, Diabrotica virgifera
  misc_feature: Coding regions on vcDNA: vcDNA=SeqID_10933; Strand=-; Position=1-93
RGKKYTFKLNQKNNVLNSQGKKDVREFRYST

SEQ ID NO: 31237 - protein, 76 aa, Diabrotica virgifera
  misc_feature: Coding regions on vcDNA: vcDNA=SeqID_10934; Strand=+; Position=3-233
  misc_feature: Homolog annotation: Hit_ID=XP_392645.1; Match level="QueryCoverage =93%, HitCoverage=45%, E-value=1e-29, Identity=84%"; Hit description =similar to ENSANGP00000023074 [Apis mellifera]
  misc_feature: Gene Ontology Annotation: Molecular function=nucleic acid binding; Cellular component=cellular_component unknown; Biological process =biological_process unknown
KNKVPDRPLITAADLEGKSAEEQEMMKLMGFCNFDTTKGKKVNGNDVGDVHVILKRKYRQYMNRKGGFNRPLDFVA

SEQ ID NO: 31238 - protein, 199 aa, Diabrotica virgifera
  misc_feature: Coding regions on vcDNA: vcDNA=SeqID_10935; Strand=-; Position=221-820
  misc_feature (1)..(12): Xaa can be any naturally occurring amino acid
  misc_feature (23)..(121): Xaa can be any naturally occurring amino acid
  misc_feature (124)..(162): Xaa can be any naturally occurring amino acid
  misc_feature (167)..(173): Xaa can be any naturally occurring amino acid
  misc_feature (188)..(197): Xaa can be any naturally occurring amino acid
XXXXXXXXXXXXQFCFHPALLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHIXXXXXXXXXXXXXXXXXXXXXXXXXXXXXXXXXXXXXXXINMEXXXXXXXVLKKLDVHKNEERGXXXXXXXXXXLR

SEQ ID NO: 31239 - protein, 98 aa, Diabrotica virgifera
  misc_feature: Coding regions on vcDNA: vcDNA=SeqID_10936; Strand=+; Position=326-625
  misc_feature: Homolog annotation: Hit_ID=AAK76989.1; Match level="QueryCoverage =81%, HitCoverage=42%, E-value=4e-13, Identity=56%"; Hit description =ribosomal protein L9 [Spodoptera frugiperda] sp|Q963B7|RL9_SPOFR 60S ribosomal protein L9
  misc_feature (22)..(22): Xaa can be any naturally occurring amino acid
  misc_feature (46)..(46): Xaa can be any naturally occurring amino acid
  misc_feature (60)..(60): Xaa can be any naturally occurring amino acid
ATTEGDTVIAIINSWRENYIRXVKMPLGDTGLISTKPQDELIIEGXRWRSVLKTAALIQXSKPVKTKDIRKLPHGIYVSAKIIRCTRGITRIIVFSLS

SEQ ID NO: 31240 - protein, 84 aa, Diabrotica virgifera
  misc_feature: Coding regions on vcDNA: vcDNA=SeqID_10937; Strand=+; Position=506-760
  misc_feature (33)..(40): Xaa can be any naturally occurring amino acid
  misc_feature (42)..(48): Xaa can be any naturally occurring amino acid
  misc_feature (68)..(78): Xaa can be any naturally occurring amino acid
KTTIAAIVTYALENRRFVRLTSQTQFIQTLYNXXXXXXXXPXXXXXXXAPIFKPQKGTQSFIESLICXXXXXXXXXXXNNSRRL

SEQ ID NO: 31241 - protein, 324 aa, Diabrotica virgifera
  misc_feature: Coding regions on vcDNA: vcDNA=SeqID_10938; Strand=+; Position=2-973
  misc_feature: Homolog annotation: Hit_ID=XP_313488.1; Match level="QueryCoverage =91%, HitCoverage=38%, E-value=1e-75, Identity=46%"; Hit description =ENSANGP00000023545 [Anopheles gambiae]
  misc_feature: Gene Ontology Annotation: Molecular function=receptor activity; Cellular component=integral to plasma membrane; Biological process =pathogenesis
  misc_feature: Pfam annotation: Pfam_ID=Peptidase_M1; Match level="Score=274.0, E -value=2.6e-79, Copies=1"; Pfam description=Peptidase family M1
VSIRSTKPDSSLLEIKEQLYYEKEKYKIVLKEHLRKNEEYQLDLNFHGKLSGHLQGFYRIKYYDEYHRQRLIASTQFSPVDARSAFPCFDEPSFKANFQITIGRPADMLSLSNMPLAQKTPFSTNNSELWSWDEYPETPKMSTYLVAFMVMDFIKGAGDDPRMMFWARPQIAGNSAYAAQIGPKILSFYENYFGIKFPLSKIDIVAVPEFGFSAMENWGLITFREDVLLYDQQSSTNEDKRTTATILAHELAHQWFGNLVTPVFWNDLWLKEGFSNFLVYSGVNYAEPKWMFAEEFMLSENLDAMSGDAFATSRPFSSIYPKHS

SEQ ID NO: 31242 - protein, 269 aa, Diabrotica virgifera
  misc_feature: Coding regions on vcDNA: vcDNA=SeqID_10939; Strand=+; Position=101-907
  misc_feature: Homolog annotation: Hit_ID=EAL41685.1; Match level="QueryCoverage =67%, HitCoverage=43%, E-value=2e-11, Identity=24%"; Hit description =ENSANGP00000026270 [Anopheles gambiae str. PEST] ref|XP_560232.1| ENSANGP00000026270 [Anopheles gambiae st
  misc_feature (131)..(137): Xaa can be any naturally occurring amino acid
  misc_feature (228)..(228): Xaa can be any naturally occurring amino acid
MPVVISKELFYEKISKELDCRVIHYWTDNCVQGALPALPQVAIGVAKFFLPIYLLRMAIDYRTFVIRELRSILYGASLGLIIISSICLLGKICGRIHYYNLLLIPGFLSGLGILVESDENQTLDTLIFFNXXXXXXXNALKVNTTKQAILFVIFSGILMQLFENRKEELNFNYWWFYTPPLKKISNDNHQNKCSHENSCRFFITNGVKNYFMLGAGINITKRLLGSFXLLIKSPAKLVNVVFHKSNVYFGLLIAAYVGIYRAITCYLRQ

SEQ ID NO: 31243 - protein, 54 aa, Diabrotica virgifera
  misc_feature: Coding regions on vcDNA: vcDNA=SeqID_10940; Strand=-; Position=75-239
MRGYRGLCNSGSSMCVLSQLINKSISNILVVSIYFRVLHPVVVAFTFFIWSCKD

SEQ ID NO: 31244 - protein, 130 aa, Diabrotica virgifera
  misc_feature: Coding regions on vcDNA: vcDNA=SeqID_10941; Strand=-; Position=1-390
RKRGMFLPFICVLSILCRVISKWNLFCAPTTKASSKISPKNVVKFTCLKRVLLSFICGNKRVQKLKKNYYRFFWSFLQDVKSISVLYIYASSLALSIYILPQHLSCVSAVCVVLSTLIKNNGYRRSPTRP

SEQ ID NO: 31245 - protein, 259 aa, Diabrotica virgifera
  misc_feature: Coding regions on vcDNA: vcDNA=SeqID_10942; Strand=+; Position=110-886
  misc_feature: Homolog annotation: Hit_ID=XP_394637.1; Match level="QueryCoverage =98%, HitCoverage=30%, E-value=1e-113, Identity=76%"; Hit description= similar to ENSANGP00000006226 [Apis mellifera]
  misc_feature: Gene Ontology Annotation: Molecular function=peptide alpha-N -acetyltransferase activity; Cellular component=cytoplasm; Biological process=protein modification
  misc_feature: Pfam annotation: Pfam_ID=TPR_2; Match level="Score=54.9, E-value=2.3e- 13, Copies=4"; Pfam description=Tetratricopeptide repeat
MPSSKPLPPKENALFKRILKCYEQKQYKNGLKFAKQILSNPKYTEHGETLAMKGLTLNCLGRKEEAYEYVRRGLRNDLKSHVCWHVYGLLQRSDKKYDEAIKCYRNALKWEKDNIQILRDLSLLQIQMRDLEGYRDTRYQLLMLRPTQRASWIGYAMSFHLLEEYKNALNILDTFLEQQKANSFDYEHSELLLYQNLVIQESGDLKEALKHLEASQNQIVDKLTLKEKLGELCLLLKQFDKATTCYEELIQEIPKNKLL

SEQ ID NO: 31246 - protein, 37 aa, Diabrotica virgifera
  misc_feature: Coding regions on vcDNA: vcDNA=SeqID_10943; Strand=-; Position=19-132
RRDCLRYYSLLVNHHCLSSNIGVATPSFNFRFRVLTT

SEQ ID NO: 31247 - protein, 207 aa, Diabrotica virgifera
  misc_feature: Coding regions on vcDNA: vcDNA=SeqID_10944; Strand=+; Position=3-626
  misc_feature: Homolog annotation: Hit_ID=XP_143000.4; Match level="QueryCoverage =98%, HitCoverage=83%, E-value=7e-33, Identity=35%"; Hit description =similar to zinc finger protein 347; zinc finger 1111 [Mus musculus]
  misc_feature: Gene Ontology Annotation: Molecular function=protein binding; Cellular component=nucleus; Biological process=regulation of transcription, DNA-dependent
  misc_feature: Pfam annotation: Pfam_ID=zf-C2H2; Match level="Score=55.2, E-value =1.8e-13, Copies=3"; Pfam description=Zinc finger, C2H2 type
  misc_feature (69)..(75): Xaa can be any naturally occurring amino acid
  misc_feature (89)..(95): Xaa can be any naturally occurring amino acid
  misc_feature (97)..(103): Xaa can be any naturally occurring amino acid
  misc_feature (118)..(134): Xaa can be any naturally occurring amino acid
  misc_feature (174)..(186): Xaa can be any naturally occurring amino acid
LRVRCTLGEKSHKCEFCFKQFSLACALKEHLRRHTGEKPYKCKICFKQLISASVLKKHLRVHTGEKPYXXXXXXXRFNQAGTLKTHLRXXXXXXXYXXXXXXXRFAQKVQLTSHIRVXXXXXXXXXXXXXXXXXAASNLKKHLKVHTGEKPHKCEICFKQFSEVGCLKKHLRVXXXXXXXXXXXXXKQFREASNLKKHLKTHTREKR

SEQ ID NO: 31248 - protein, 87 aa, Diabrotica virgifera
  misc_feature: Coding regions on vcDNA: vcDNA=SeqID_10945; Strand=-; Position=1-261
  misc_feature (1)..(84): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXPLS

SEQ ID NO: 31249 - protein, 124 aa, Diabrotica virgifera
  misc_feature: Coding regions on vcDNA: vcDNA=SeqID_10946; Strand=-; Position=128-502
AVSRGAIHARNKQLCIYVEIHRAVNVYSLIAQYRLLNRMTCFQAACTWRRSRNGRALGPRGLHATVQLECAVNKFNSRTAEPPAIARSLKRRKCASSVTLTGKIYPEKHIAKYILDGYVLIGLK

SEQ ID NO: 31250 - protein, 214 aa, Diabrotica virgifera
  misc_feature: Coding regions on vcDNA: vcDNA=SeqID_10947; Strand=+; Position=75-719
  misc_feature (206)..(212): Xaa can be any naturally occurring amino acid
LKILLIHCIKMNRSWNRNSSSSSGFVYFAKESQKECGDSENFLSFQESPQKSYNHISPNYGTPMSHSSPRNFNKRNNYRYSGRNRGNRSYVSPNVNFKSWNNYNSPKPHHQKKISFNKIPMMSADGQRDMSMFYDHTCTWNPWADLEKHFKEEEPVKEEKMIESPSVPIVSEPESKTIIDTKKENESSSSDDSSDSDEDTSSSDSXXXXXXXTS

SEQ ID NO: 31251 - protein, 52 aa, Diabrotica virgifera
  misc_feature: Coding regions on vcDNA: vcDNA=SeqID_10948; Strand=-; Position=84-242
  misc_feature (3)..(19): Xaa can be any naturally occurring amino acid
GCXXXXXXXXXXXXXXXXXPTPASPPRFKPQNQVKILKVETDLNNITCYPHY

SEQ ID NO: 31252 - protein, 66 aa, Diabrotica virgifera; identical to SEQ ID NO: 26808
  misc_feature: Coding regions on vcDNA: vcDNA=SeqID_10949; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 31253 - protein, 272 aa, Diabrotica virgifera
  misc_feature: Coding regions on vcDNA: vcDNA=SeqID_10950; Strand=+; Position=61-876
  misc_feature: Homolog annotation: Hit_ID=XP_395882.1; Match level="QueryCoverage =85%, HitCoverage=78%, E-value=3e-39, Identity=34%"; Hit description =similar to CG1102-PA [Apis mellifera]
  misc_feature: Gene Ontology Annotation: Molecular function=serine-type endopeptidase activity; Cellular component=extracellular; Biological process=Tl signaling pathway
  misc_feature: Pfam annotation: Pfam_ID=Trypsin; Match level="Score=-35.0, E-value =0.097, Copies=1"; Pfam description=Trypsin
MVSSSMALLWKSLLLFIITCFLVVVKSQDSAVDDDGCRTPTGGAGHCIPLRQCKPMINVLRTAKRPLSPSISKQLNAYYCNFTKSVCCPQEPIILQDDSVTEVPQRPQLPPDVSNHRNLNLLPSDCGYLDLNDRIRNGQDADLNEFPWMALLSYRTRRGPDFKCGGTIINSRYILTAAHCISNLDTPMLGVRVGEYNTRTRRDCVMGKDGTEKCINNPVPDLAIEKIIPHPQFDASSISNDIGLLRVAKINLNVENARPVCLPLGEYRTKNV

SEQ ID NO: 31254 - protein, 81 aa, Diabrotica virgifera
  misc_feature: Coding regions on vcDNA: vcDNA=SeqID_10951; Strand=-; Position=1-243
  misc_feature (6)..(30): Xaa can be any naturally occurring amino acid
  misc_feature (36)..(42): Xaa can be any naturally occurring amino acid
GRPFGXXXXXXXXXXXXXXXXXXXXXXXXXFNLPVXXXXXXXGNRTLKKISWSPNLKTFYPNPRGSPSLFSIDFSNKNYAV

SEQ ID NO: 31255 - protein, 216 aa, Diabrotica virgifera
  misc_feature: Coding regions on vcDNA: vcDNA=SeqID_10952; Strand=+; Position=3-653
  misc_feature: Homolog annotation: Hit_ID=XP_393228.1; Match level="QueryCoverage =95%, HitCoverage=17%, E-value=6e-27, Identity=36%"; Hit description =similar to SI:zC214P16.5 (novel protein similar to human RAB3 GTPase- activating protein
  misc_feature: Gene Ontology Annotation: Cellular component=synaptic vesicle; Biological process=synaptic vesicle fusion
  misc_feature (117)..(132): Xaa can be any naturally occurring amino acid
MITTFSIKHTKPINNLFEASVVNLFFTDLQKKVQISCNRSDIRLNFSRTQFLFKIISATLETITVNESGKIYFTDHVNWMAKCINLGKLWNLDVDELRRYQIVQLYSNGYDSIAQEXXXXXXXXXXXXXXXXNVAAKRLSQFLVSSPQLSENIGALSTVLTNYMETLTEEWCAPSALKDITLLATHTIHCLTEEDSEYKLASLLLESCKTLEDLQS

SEQ ID NO: 31256 - protein, 41 aa, Diabrotica virgifera
  misc_feature: Coding regions on vcDNA: vcDNA=SeqID_10953; Strand=-; Position=1-123
  misc_feature (1)..(18): Xaa can be any naturally occurring amino acid
  misc_feature (20)..(31): Xaa can be any naturally occurring amino acid
  misc_feature (34)..(40): Xaa can be any naturally occurring amino acid
XXXXXXXXXXXXXXXXXXPXXXXXXXXXXXXKKXXXXXXXL

SEQ ID NO: 31257 - protein, 87 aa, Diabrotica virgifera
  misc_feature: Coding regions on vcDNA: vcDNA=SeqID_10954; Strand=+; Position=394-657
  misc_feature (13)..(29): Xaa can be any naturally occurring amino acid
KYHYIISHITINXXXXXXXXXXXXXXXXXFIFYPIFIKIETAIISNIPMPIIININKSYIWKKYTGLTPEFSNIFFLLSIKDLAFPC

SEQ ID NO: 31258 - protein, 58 aa, Diabrotica virgifera
  misc_feature: Coding regions on vcDNA: vcDNA=SeqID_10955; Strand=-; Position=21-197
LDLWALATHVLICLSHDLKVSTFHRSPLFVRIYGFPTSIHTRWGFSHLIINYLQTILK

SEQ ID NO: 31259 - protein, 45 aa, Diabrotica virgifera
  misc_feature: Coding regions on vcDNA: vcDNA=SeqID_10956; Strand=+; Position=189-326
YEFYDSGRLYKARVLWLMFMEEIAMIVLRAMGITGPRLIYNHWIC

SEQ ID NO: 31260 - protein, 261 aa, Diabrotica virgifera
  misc_feature: Coding regions on vcDNA: vcDNA=SeqID_10957; Strand=+; Position=129-911
  misc_feature: Homolog annotation: Hit_ID=XP_395449.1; Match level="QueryCoverage =100%, HitCoverage=51%, E-value=2e-73, Identity=50%"; Hit description= similar to ENSANGP00000014036 [Apis mellifera]
  misc_feature (101)..(114): Xaa can be any naturally occurring amino acid
  misc_feature (218)..(218): Xaa can be any naturally occurring amino acid
  misc_feature (232)..(232): Xaa can be any naturally occurring amino acid
  misc_feature (252)..(252): Xaa can be any naturally occurring amino acid
KMEQTPIQKFYKNTNVFITGGTGFMGKILIERLLRSTQIETLYLLVRNKKGKNIHVRIDELFDDVIFDKLKKECPKFRHKVEAISGDCTQSGLGLNITDRXXXXXXXXXXXXXXATVKFDENLKLAYNINVNGTKSVLDLARQMNNLMSMVHVSTAYSHCPRSEIEEKIYDCPVSYEYVQAVLEKIGNDEAHLLTPRIIGEWPNTYTFTKALAENMVXDLGTNLPLAIFRPXIVLSTYKEPIEGWIDNMYGXTGCACRSYT

SEQ ID NO: 31261 - protein, 219 aa, Diabrotica virgifera
  misc_feature: Coding regions on vcDNA: vcDNA=SeqID_10958; Strand=-; Position=1-657
  misc_feature (1)..(219): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31262 - protein, 49 aa, Diabrotica virgifera
  misc_feature: Coding regions on vcDNA: vcDNA=SeqID_10959; Strand=+; Position=24-173
  misc_feature (6)..(12): Xaa can be any naturally occurring amino acid
IADVIXXXXXXXCATLIDPATIGAHIANTIKYLRQLRMVVTYLNHERDK

SEQ ID NO: 31263 - protein, 280 aa, Diabrotica virgifera
  misc_feature: Coding regions on vcDNA: vcDNA=SeqID_10960; Strand=+; Position=29-872
  misc_feature: Homolog annotation: Hit_ID=XP_392539.1; Match level="QueryCoverage =83%, HitCoverage=33%, E-value=1e-24, Identity=38%"; Hit description =similar to CG5360-PA [Apis mellifera]
  misc_feature (162)..(162): Xaa can be any naturally occurring amino acid
  misc_feature (209)..(209): Xaa can be any naturally occurring amino acid
MLEKLKTNKKYFWNNSTAVASKPASQSHSLLITCSEEEAKTKEFKDVLMDRCLGLHHNRSRFSEKFEDLCGRYGSRYVGAETQSSCTVFETHVTSPMKRRNIKPQWNTKSPGKRLSHLARRKITFSSANLQSGNSSLAGSRARQILVDAKKNGFTEPKEKSXKSPRKTPRKTPGKSPRIKTRTPSSSAKKKLAMRFRKVTGEIEKSSTXTSSDGSLCAKRTLFHSPDEDKKLLTRLLPSTSGSSLAHEIKRSTTKRALFMSPSKSSPLKIWDSNVRRLTT

SEQ ID NO: 31264 - protein, 20 aa, Diabrotica virgifera
  misc_feature: Coding regions on vcDNA: vcDNA=SeqID_10961; Strand=-; Position=1-60
  misc_feature (1)..(19): Xaa can be any naturally occurring amino acid
XXXXXXXXXXXXXXXXXXXL

SEQ ID NO: 31265 - protein, 23 aa, Diabrotica virgifera
  misc_feature: Coding regions on vcDNA: vcDNA=SeqID_10962; Strand=-; Position=0-68
  misc_feature (3)..(22): Xaa can be any naturally occurring amino acid
KNXXXXXXXXXXXXXXXXXXXXP

SEQ ID NO: 31266 - protein, 228 aa, Diabrotica virgifera
  misc_feature: Coding regions on vcDNA: vcDNA=SeqID_10963; Strand=+; Position=2-688
  misc_feature: Homolog annotation: Hit_ID=XP_397017.1; Match level="QueryCoverage =79%, HitCoverage=23%, E-value=7e-20, Identity=34%"; Hit description =similar to ENSANGP00000024473 [Apis mellifera]
GNHHNKHSLGRRNIFCKCIVQYFIQKAGGNVSPETASIIFSGLCIVFNIFVISFIVDRFSRKVLYSSSLVLCSMAILALAAYLYFDEFVPNTDLDSVAWLPLTCLITFQIGWSYGLAVIPTLMMGELFSVSIKSKAMLIMMVALGGGISFVNVLFNILNSVLRTFAPFVFFALCIIGAAIVSLYIIPDTKGKTLEEIQMNLKASSNDKKNSNIIPAIEAYYSEIYIYI

SEQ ID NO: 31267 - protein, 110 aa, Diabrotica virgifera
  misc_feature: Coding regions on vcDNA: vcDNA=SeqID_10964; Strand=+; Position=3-335
  misc_feature: Homolog annotation: Hit_ID=XP_392397.1; Match level="QueryCoverage =100%, HitCoverage=15%, E-value=3e-45, Identity=71%"; Hit description= similar to ENSANGP00000021902 [Apis mellifera]
  misc_feature: Gene Ontology Annotation: Molecular function=alpha,alpha-trehalose -phosphate synthase (UDP-forming) activity; Cellular component =cytoplasm; Biological process=protein modification
RAYLKANEAFAECTLKALKTLPKTSTEIPLIWVHDYHLMLAANWIRQAADEQEIKVKLGFFLHIPFPPWDIYRLFPWADEILQGMLGCDLVGFHITDYCINFVDCCHRIL

SEQ ID NO: 31268 - protein, 90 aa, Diabrotica virgifera
  misc_feature: Coding regions on vcDNA: vcDNA=SeqID_10965; Strand=-; Position=173-445
  misc_feature (53)..(58): Xaa can be any naturally occurring amino acid
GFMHLAVTSSELWYFSVITLSNLFGCIIERYETLIFQRPLVPQSFFDSTWNLXXXXXXSQARCIPPLVVVWFTVPAFTFERALPHFWVSG

SEQ ID NO: 31269 - protein, 46 aa, Diabrotica virgifera
  misc_feature: Coding regions on vcDNA: vcDNA=SeqID_10966; Strand=+; Position=2-142
  misc_feature: Homolog annotation: Hit_ID=Q27772; Match level="QueryCoverage=80%, HitCoverage=3%, E-value=1e-09, Identity=72%"; Hit description=C-1 -tetrahydrofolate synthase, cytoplasmic (C1-THF synthase) [Includes:
SISVGAQFIIPFTGEITRMPGLPTRPAIYDIDLNIETGETSWCSLN

SEQ ID NO: 31270 - protein, 34 aa, Diabrotica virgifera
  misc_feature: Coding regions on vcDNA: vcDNA=SeqID_10967; Strand=+; Position=1-102
  misc_feature (1)..(33): Xaa can be any naturally occurring amino acid
XXXXXXXXXXXXXXXXXXXXXXXXXXXXXXXXXP

SEQ ID NO: 31271 - protein, 97 aa, Diabrotica virgifera
  misc_feature: Coding regions on vcDNA: vcDNA=SeqID_10968; Strand=+; Position=383-676
  misc_feature (4)..(11): Xaa can be any naturally occurring amino acid
  misc_feature (19)..(26): Xaa can be any naturally occurring amino acid
  misc_feature (30)..(38): Xaa can be any naturally occurring amino acid
  misc_feature (42)..(52): Xaa can be any naturally occurring amino acid
RHLXXXXXXXXSSSTINNXXXXXXXXTYFXXXXXXXXXRILXXXXXXXXXXXNDDNISYSRIVDPGKIYRPTNGIREHLFHLFIKNMSFCVIIISLT

SEQ ID NO: 31272 - protein, 260 aa, Diabrotica virgifera
  misc_feature: Coding regions on vcDNA: vcDNA=SeqID_10969; Strand=+; Position=3-785
HASDSTSSEEDKSSEEKRESEDDILGVSLFLQPLGNKTPTRERESNMKENVENKDREQFFNQKNPPGENKDQEKTRTQTTNVDNKATNEKSNVKSIPYGDSKLSLTKSNEKSTHYEEPTLPSGKSEARARSFESDVSQFLDEIDGNKKPDLEEQLKELEEKFIKQSELARLRKLLGKGNEDENTGSKPLAQNEDQIEFLTRLEKLMKSRATDIKQQEKPTDSIREELKKLQIAIANLRPKEDAPKVEHPKIEPEAKELPR

SEQ ID NO: 31273 - protein, 110 aa, Diabrotica virgifera
  misc_feature: Coding regions on vcDNA: vcDNA=SeqID_10970; Strand=-; Position=257-589
SSSSSSSSYSSSSLSSSSVVAATCCTITGSTELYHGCASASGSLTTMAESESCDTPVSSVPVAPSASPAAISWASNSSLGFTSAPASPTSAGSDGATGTASIGSIGCGWG

SEQ ID NO: 31274 - protein, 67 aa, Diabrotica virgifera
  misc_feature: Coding regions on vcDNA: vcDNA=SeqID_10971; Strand=+; Position=401-604
  misc_feature (4)..(14): Xaa can be any naturally occurring amino acid
  misc_feature (38)..(48): Xaa can be any naturally occurring amino acid
HRIXXXXXXXXXXXQIFHMFKEVMILFLYIRILIFHNXXXXXXXXXXXHLALLIGLPWTHCIFTTDI

SEQ ID NO: 31275 - protein, 244 aa, Diabrotica virgifera
  misc_feature: Coding regions on vcDNA: vcDNA=SeqID_10972; Strand=+; Position=171-905
  misc_feature: Homolog annotation: Hit_ID=XP_392800.1; Match level="QueryCoverage =86%, HitCoverage=27%, E-value=1e-70, Identity=63%"; Hit description =similar to ENSANGP00000021534 [Apis mellifera]
  misc_feature: Gene Ontology Annotation: Molecular function=molecular_function unknown; Cellular component=cellular_component unknown; Biological process=cell cycle
  misc_feature: Pfam annotation: Pfam_ID=Cullin; Match level="Score=-24.4, E-value =4.6e-06, Copies=1"; Pfam description=Cullin family
  misc_feature (214)..(214): Xaa can be any naturally occurring amino acid
  misc_feature (219)..(219): Xaa can be any naturally occurring amino acid
  misc_feature (223)..(223): Xaa can be any naturally occurring amino acid
MNEESDPIHHRSNFSSVAETRGNRSLNLINSKSTAKKLIIKNLKTRPVLPPDYQEQTWKKLESAIFAIQQAVSNQYCLEELYQAIENLCNHKMGPILYDRLYNLTEAHVSTNIEQFLSESMDSSLFLQKMNEHWLAHCNQMMMIRSIFLYLDRTYVLQNPNIVPIWDMGLKLFSKYIVLNRLIQTRLVEGLLMFIKKERQGDTGNKTLLKSLLXMLTNXANYXHIFEQKFLQSTEHFYAAEGQK

SEQ ID NO: 31276 - protein, 250 aa, Diabrotica virgifera
  misc_feature: Coding regions on vcDNA: vcDNA=SeqID_10973; Strand=+; Position=50-802
  misc_feature: Homolog annotation: Hit_ID=XP_312845.1; Match level="QueryCoverage =94%, HitCoverage=80%, E-value=1e-63, Identity=50%"; Hit description =ENSANGP00000016674 [Anopheles gambiae]
  misc_feature: Gene Ontology Annotation: Molecular function=molecular_function unknown; Cellular component=cellular_component unknown; Biological process=coenzymes and prosthetic group metabolism
  misc_feature: Pfam annotation: Pfam_ID=DUF341; Match level="Score=52.2, E-value =1.4e-12, Copies=1"; Pfam description=Domain of unknown function (DUF341)
MNHENIEPQKCCPNDKMKLKILAIHGYRQNAETFRSKTGSFRKMIHKWAEFTYITAPHKVILVDDPNDLEKNGPDIGQSKDEEQYGWFFNRDDKTFRGIRKGGPAIGFEDSLKYIEDICEKEGPFDGLLGFSQGACFAGLLCDLQQRGLSKFTFNFAIFSSGFKSGSLPHLKYYIDRITIPSLHIFGENDQIIPTDMSEALSNCFEEPFIVRHPGGHYLPASAPQKSDYQKFIKLQLLKKQCNNLTFHAG

SEQ ID NO: 31277 - protein, 50 aa, Diabrotica virgifera
  misc_feature: Coding regions on vcDNA: vcDNA=SeqID_10974; Strand=+; Position=54-206
KNDYLVRALTIGRKYYNYHNRKSDFLYRVHPGLLTNKYICIIHESNGDPQ

SEQ ID NO: 31278 - protein, 85 aa, Diabrotica virgifera
  misc_feature: Coding regions on vcDNA: vcDNA=SeqID_10975; Strand=-; Position=2-256
  misc_feature (7)..(19): Xaa can be any naturally occurring amino acid
  misc_feature (22)..(32): Xaa can be any naturally occurring amino acid
  misc_feature (42)..(49): Xaa can be any naturally occurring amino acid
  misc_feature (52)..(65): Xaa can be any naturally occurring amino acid
  misc_feature (71)..(84): Xaa can be any naturally occurring amino acid
RSRTSFXXXXXXXXXXXXXPFXXXXXXXXXXXTNLAHTGLNXXXXXXXXSNXXXXXXXXXXXXXXPTSRSXXXXXXXXXXXXXXV

SEQ ID NO: 31279 - protein, 289 aa, Diabrotica virgifera
  misc_feature: Coding regions on vcDNA: vcDNA=SeqID_10976; Strand=-; Position=179 -1048
  misc_feature (11)..(18): Xaa can be any naturally occurring amino acid
  misc_feature (24)..(57): Xaa can be any naturally occurring amino acid
  misc_feature (66)..(277): Xaa can be any naturally occurring amino acid
KKILTVFSLRXXXXXXXXKIVDPXXXXXXXXXXXXXXXXXXXXXXXXXXXXXXXXXXETYLIFDKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFNKIFSFVSLLN

SEQ ID NO: 31280 - protein, 259 aa, Diabrotica virgifera
  misc_feature: Coding regions on vcDNA: vcDNA=SeqID_10977; Strand=+; Position=16-795
  misc_feature (34)..(41): Xaa can be any naturally occurring amino acid
  misc_feature (217)..(233): Xaa can be any naturally occurring amino acid
  misc_feature (259)..(259): Xaa can be any naturally occurring amino acid
VLRRVMGTLTVWIPLLVVSLILLDQQTGGAQVPXXXXXXXXTKTVDGYIPNANTKSYTKTKTAHTKSRHHGHTSKMLPPRAHEATMSPYDVSGRKARDFLDAVSGPSKYISSGGSYGGSSQGFSYQGGCQSMPSPMNAGVKCSSVSGCTATCMPDAHFPNGRTELKLLCQNGQWFAEGYNGVPNCERSSGMSGSSSSSGGSSISFQGGCVGMPSPMXXXXXXXXXXXXXXXXXPGSQFPNGKTELQILCQNGQWSALQX

SEQ ID NO: 31281 - protein, 161 aa, Diabrotica virgifera
  misc_feature: Coding regions on vcDNA: vcDNA=SeqID_10978; Strand=-; Position=2-484
  misc_feature (15)..(22): Xaa can be any naturally occurring amino acid
  misc_feature (38)..(49): Xaa can be any naturally occurring amino acid
  misc_feature (61)..(112): Xaa can be any naturally occurring amino acid
  misc_feature (116)..(125): Xaa can be any naturally occurring amino acid
  misc_feature (129)..(146): Xaa can be any naturally occurring amino acid
  misc_feature (149)..(161): Xaa can be any naturally occurring amino acid
TPPAPPPRFFSPTYXXXXXXXXTALKNNYLPPQLYLLXXXXXXXXXXXXDFPKKFRCSPGXXXXXXXXXXXXXXXXXXXXXXXXXXXXXXXXXXXXXXXXXXXXXXXXXXXXLIGXXXXXXXXXXLFKXXXXXXXXXXXXXXXXXXPFXXXXXXXXXXXXX

SEQ ID NO: 31282 - protein, 255 aa, Diabrotica virgifera
  misc_feature: Coding regions on vcDNA: vcDNA=SeqID_10979; Strand=-; Position=80-846
  misc_feature: Homolog annotation: Hit_ID=EAL39402.1; Match level="QueryCoverage =91%, HitCoverage=72%, E-value=8e-17, Identity=28%"; Hit description =ENSANGP00000028549 [Anopheles gambiae str. PEST] ref|XP_554483.1| ENSANGP00000028549 [Anopheles gambiae st
  misc_feature: Pfam annotation: Pfam_ID=HTH_psq; Match level="Score=17.9, E-value =0.018, Copies=1"; Pfam description=helix-turn-helix, Psq domain
  misc_feature (190)..(190): Xaa can be any naturally occurring amino acid
VGRELKVDIQRNTYKAVLEQVKSGMLSERQASKQYDIPRNTIRNKLKRNHSKNVGRPTVFSQEEEKSIAKHVISLSDNGIPISLFDVRCIAQSYLNSQGRKVSQFKENFRGWDWSQLFLERNCTDLAQRFQTNISRRRAQVNEDVINKFFDNFEIQVSDITPNNIYNYDETGFHDVPTKRTFIQKRLQEXHERIVNSTESCFTTLFCANADGEFLPPYVIMKGSLKWSDWVFGAPTGTILNTSKSGWIENSIFTD

SEQ ID NO: 31283 - protein, 171 aa, Diabrotica virgifera
  misc_feature: Coding regions on vcDNA: vcDNA=SeqID_10980; Strand=+; Position=144-659
  misc_feature: Homolog annotation: Hit_ID=XP_308176.1; Match level="QueryCoverage =95%, HitCoverage=76%, E-value=1e-19, Identity=41%"; Hit description =ENSANGP00000021540 [Anopheles gambiae]
  misc_feature: Gene Ontology Annotation: Molecular function=RAN small monomeric GTPase activity; Cellular component=nucleoplasm; Biological process =embryogenesis and morphogenesis
  misc_feature (51)..(51): Xaa can be any naturally occurring amino acid
  misc_feature (69)..(69): Xaa can be any naturally occurring amino acid
LFLRSVSSPFILPPNISRRPYDKGDSVGQEHHDELRDEPDIHRHCGIIILXSTSIDSYNYVPHCCRDLXDTCDHITIGLRGMNDHIKDRKDKEKSIGFHMKKNLLYYDISAYILYLFEEPFWRSSRKLIDISLLKILSCSCLCFLQTIQMHLSGTIHIEKDLRTAHTCTAL

SEQ ID NO: 31284 - protein, 52 aa, Diabrotica virgifera
  misc_feature: Coding regions on vcDNA: vcDNA=SeqID_10981; Strand=-; Position=49-207
AVHKLKKYFIVSFPHLCRKRNVLLIYIFKPCFQHVIYVGYISISQLLQVIFI

SEQ ID NO: 31285 - protein, 261 aa, Diabrotica virgifera
  misc_feature: Coding regions on vcDNA: vcDNA=SeqID_10982; Strand=+; Position=2-784
  misc_feature (1)..(99): Xaa can be any naturally occurring amino acid
  misc_feature (103)..(129): Xaa can be any naturally occurring amino acid
  misc_feature (131)..(183): Xaa can be any naturally occurring amino acid
  misc_feature (246)..(257): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGMEXXXXXXXXXXXXXXXXXXXXXXXXXXXEXXXXXXXXXXXXXXXXXXXXXXXXXXXXXXXXXXXXXXXXXXXXXXXXXXXXXNYLRDTAYFYWKVQSIIKLANFHGWIKVYYWGDPRFFIKSVPTFKIFHVLSFKPRGGPRVGFXXXXXXXXXXXXQRTP

SEQ ID NO: 31286 - protein, 56 aa, Diabrotica virgifera
  misc_feature: Coding regions on vcDNA: vcDNA=SeqID_10983; Strand=-; Position=185-355
VTYKYVRAICESLSIIKFRLLRQSHIIIYMMLQLLLLHEFFIRNNYNNNLYYELDL

SEQ ID NO: 31287 - protein, 301 aa, Diabrotica virgifera
  misc_feature: Coding regions on vcDNA: vcDNA=SeqID_10984; Strand=+; Position=1-906
  misc_feature: Homolog annotation: Hit_ID=XP_485924.1; Match level="QueryCoverage =94%, HitCoverage=56%, E-value=9e-46, Identity=31%"; Hit description =similar to Zinc finger protein 267 (Zinc finger protein HZF2) [Mus musculus]
  misc_feature: Gene Ontology Annotation: Molecular function=protein binding; Cellular component=nucleus; Biological process=regulation of transcription, DNA-dependent
  misc_feature: Pfam annotation: Pfam_ID=zf-C2H2; Match level="Score=107.1, E-value =4.5e-29, Copies=4"; Pfam description=Zinc finger, C2H2 type
  misc_feature (72)..(80): Xaa can be any naturally occurring amino acid
  misc_feature (129)..(136): Xaa can be any naturally occurring amino acid
  misc_feature (178)..(191): Xaa can be any naturally occurring amino acid
  misc_feature (213)..(219): Xaa can be any naturally occurring amino acid
  misc_feature (233)..(248): Xaa can be any naturally occurring amino acid
  misc_feature (262)..(275): Xaa can be any naturally occurring amino acid
  misc_feature (283)..(283): Xaa can be any naturally occurring amino acid
QISANAEETILKKSICKCKICFKQFNQASSLKQHMKTHIGEMLYKCKICFKEFSLTIDLKRHFRTHTGQKPXXXXXXXXXFTKASNLKTHLGVHTEEKPYKCEICLKQFRQAGNLKEHLKVHTGEKPYXXXXXXXXFGEASNLKKHLSTHTGEKPYKCEICLKQFRQAGNLKEHLRVXXXXXXXXXXXXXXQFGQTSHLKTHLEMHAEEKSYXXXXXXXQFRQAGNLKTHLKXXXXXXXXXXXXXXXXFSEACNLKTHLRVXXXXXXXXXXXXXXQFSQTSHXETHFETHQFTQAGKLKHI

SEQ ID NO: 31288 - protein, 100 aa, Diabrotica virgifera
  misc_feature: Coding regions on vcDNA: vcDNA=SeqID_10985; Strand=-; Position=102-404
APHSRRSRSRFNKYESVDGHLVQLCLASFYFRSLSVWRVRVKGIFVGIASLECVPREVERVCREVLRTSVNFGEVTSPRVWSPLKRQASLVRTGRNGTEI

SEQ ID NO: 31289 - protein, 221 aa, Diabrotica virgifera
  misc_feature: Coding regions on vcDNA: vcDNA=SeqID_10986; Strand=+; Position=184-849
  misc_feature: Homolog annotation: Hit_ID=EAA07749.3; Match level="QueryCoverage =99%, HitCoverage=100%, E-value=5e-77, Identity=64%"; Hit description= ENSANGP00000016924 [Anopheles gambiae str. PEST] ref|XP_563314.1| ENSANGP00000016924 [Anopheles gambiae s
  misc_feature: Gene Ontology Annotation: Molecular function=transcription co -activator activity; Cellular component=mediator complex; Biological process=regulation of transcription from Pol II promoter
  misc_feature: Pfam annotation: Pfam_ID=MED7; Match level="Score=341.8, E-value=9.5e- 100, Copies=1"; Pfam description=MED7 protein
  misc_feature (212)..(212): Xaa can be any naturally occurring amino acid
MANSDTIQVSSLPLPPMQYVSQYTDEAIRRGRTPKPPPPIQDTYHMFGNAFNTEESIIRPLESQGIKRLYPLHFDRRRELKKFNQSLLANFLDLLDLLVNCPDSPRRAEKVEDLSLLFIHIHHLLNEFRPHQARETLRVMMELQKRQRIETANRFQKHLDRVMDILQQAIQNLPEPMDLDSKIMIDTDFLMHSENSDNSETSQDPCYILDRXMCNIVDNMQ

SEQ ID NO: 31290 - protein, 115 aa, Diabrotica virgifera
  misc_feature: Coding regions on vcDNA: vcDNA=SeqID_10987; Strand=+; Position=1-345
  misc_feature (1)..(67): Xaa can be any naturally occurring amino acid
  misc_feature (69)..(114): Xaa can be any naturally occurring amino acid
XXXXXXXXXXXXXXXXXXXXXXXXXXXXXXXXXXXXXXXXXXXXXXXXXXXXXXXXXXXXXXXXXXXEXXXXXXXXXXXXXXXXXXXXXXXXXXXXXXXXXXXXXXXXXXXXXXS

SEQ ID NO: 31291 - protein, 91 aa, Diabrotica virgifera
  misc_feature: Coding regions on vcDNA: vcDNA=SeqID_10988; Strand=-; Position=3-275
  misc_feature (14)..(26): Xaa can be any naturally occurring amino acid
  misc_feature (28)..(38): Xaa can be any naturally occurring amino acid
  misc_feature (48)..(56): Xaa can be any naturally occurring amino acid
  misc_feature (58)..(71): Xaa can be any naturally occurring amino acid
  misc_feature (78)..(90): Xaa can be any naturally occurring amino acid
VSVIPLHFGNFHNXXXXXXXXXXXXXFXXXXXXXXXXXNQPGSHRFKXXXXXXXXXEXXXXXXXXXXXXXXSNIEVAXXXXXXXXXXXXXC

SEQ ID NO: 31292 - protein, 271 aa, Diabrotica virgifera
  misc_feature: Coding regions on vcDNA: vcDNA=SeqID_10989; Strand=+; Position=168-983
  misc_feature: Homolog annotation: Hit_ID=XP_484426.1; Match level="QueryCoverage =78%, HitCoverage=61%, E-value=2e-16, Identity=29%"; Hit description =similar to Nuclear receptor binding factor 2 [Mus musculus]
  misc_feature: Pfam annotation: Pfam_ID=TPR_1; Match level="Score=22.8, E-value =0.001, Copies=1"; Pfam description=Tetratricopeptide repeat
  misc_feature (53)..(58): Xaa can be any naturally occurring amino acid
MKMENSSLNKAHQQQRRAEALLRQKKYEDCIECHRQAIQLLEDSLNLTENARXXXXXXLQKEYHKKQIEFVQMKKAQSQIENHKKLAQLQKRRISVPSNDPENGEGLEAAIYRTIEVHDSLIDYLGKRGGSDNDSIKSYSTSDNEEKLEKETTQVIGNKHPKDDSQIIEELKVLSGQLRDSVKCLLIQLDDRNREIEKLRATIRVLEGEKQKAQQTKNNSSLKVVTDSSGGTSPYIYSPCSELSPDIVNESRNLPQLAPLEMPKLRLSKPH

SEQ ID NO: 31293 - protein, 137 aa, Diabrotica virgifera
  misc_feature: Coding regions on vcDNA: vcDNA=SeqID_10990; Strand=-; Position=226-637
  misc_feature: Homolog annotation: Hit_ID=AAW51362.1; Match level="QueryCoverage =94%, HitCoverage=50%, E-value=1e-16, Identity=37%"; Hit description =actin [Capsaspora owczarzaki]
  misc_feature: Gene Ontology Annotation: Molecular function=structural constituent of cytoskeleton; Cellular component=cytoskeleton; Biological process= actin cytoskeleton organization and biogenesis
  misc_feature (35)..(35): Xaa can be any naturally occurring amino acid
  misc_feature (53)..(53): Xaa can be any naturally occurring amino acid
  misc_feature (83)..(83): Xaa can be any naturally occurring amino acid
  misc_feature (108)..(108): Xaa can be any naturally occurring amino acid
RVKSRPDGQDIAVATDRFRSPAARSQSSLSGMESXKIYMSVLPKATCCEKQIXRDQIYINSYYNGGTAKFIGKSARIKKDITXMTLITKKIINNATTVSRVFSWIGGXIRASLKNIIQKRLNKHRYDEHAPPHFTGQ

SEQ ID NO: 31294 - protein, 72 aa, Diabrotica virgifera
  misc_feature: Coding regions on vcDNA: vcDNA=SeqID_10991; Strand=+; Position=445-660
QFTPELIVEDMCIEFEQFYQKSTSFTPRERDTDETHSQKKQVISRLHIIFFFFSMASCIYSHPDERMVILRY

SEQ ID NO: 31295 - protein, 127 aa, Diabrotica virgifera
  misc_feature: Coding regions on vcDNA: vcDNA=SeqID_10992; Strand=+; Position=172-555
  misc_feature: Homolog annotation: Hit_ID=XP_316883.1; Match level="QueryCoverage =76%, HitCoverage=33%, E-value=1e-37, Identity=73%"; Hit description =ENSANGP00000021403 [Anopheles gambiae]
  misc_feature: Gene Ontology Annotation: Molecular function=structural constituent of muscle; Cellular component=actin filament; Biological process =muscle contraction
  misc_feature: Pfam annotation: Pfam_ID=CH; Match level="Score=90.4, E-value=4.7e -24, Copies=1"; Pfam description=Calponin homology (CH) domain
  misc_feature (103)..(103): Xaa can be any naturally occurring amino acid
ISTIGQTKQYHYSTRNVQLDNFSTSWADGLAFCALIHHFLPDAFDYHALTPKERRHNFELAFKVASDKADIFPLLDVDDMMATRRPDWKCVFTYVQSIYRRFXYYVFCVCFCTNVDIRSCRQTLLVK

SEQ ID NO: 31296 - protein, 91 aa, Diabrotica virgifera
  misc_feature: Coding regions on vcDNA: vcDNA=SeqID_10993; Strand=+; Position=34-309
AYTALLYTQSILKWCHSQKKNIKIIALRGGIGIIVLLLYNNGCRTTPLASSYKHSTESSTSSRTQWCYPQERLSDFRYRFDLHKYFQSPST

SEQ ID NO: 31297 - protein, 92 aa, Diabrotica virgifera
  misc_feature: Coding regions on vcDNA: vcDNA=SeqID_10994; Strand=-; Position=453-731
  misc_feature (12)..(19): Xaa can be any naturally occurring amino acid
  misc_feature (54)..(61): Xaa can be any naturally occurring amino acid
SFRGERGWLGYXXXXXXXXPFKGGSGQATRLRLVQKAGVSNRQAEKTSPKAVIXXXXXXXXLTLSIVILSTFLKSNNYDLCLRIKLINNQNG

SEQ ID NO: 31298 - protein, 44 aa, Diabrotica virgifera
  misc_feature: Coding regions on vcDNA: vcDNA=SeqID_10995; Strand=+; Position=2-133
  misc_feature (4)..(30): Xaa can be any naturally occurring amino acid
YYMXXXXXXXXXXXXXXXXXXXXXXXXXXXFRFDILEYGTIKFN

SEQ ID NO: 31299 - protein, 358 aa, Diabrotica virgifera
  misc_feature: Coding regions on vcDNA: vcDNA=SeqID_10996; Strand=+; Position=1-1077
  misc_feature (1)..(302): Xaa can be any naturally occurring amino acid
  misc_feature (304)..(327): Xaa can be any naturally occurring amino acid
  misc_feature (334)..(334): Xaa can be any naturally occurring amino acid
  misc_feature (340)..(340): Xaa can be any naturally occurring amino acid
  misc_feature (345)..(345): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXXXXXXXXFIEIITXRDNSVXLFGEXQSNNKDGDIRWLE

SEQ ID NO: 31300 - protein, 309 aa, Diabrotica virgifera
  misc_feature: Coding regions on vcDNA: vcDNA=SeqID_10997; Strand=+; Position=74-999
  misc_feature: Homolog annotation: Hit_ID=EAL29195.1; Match level="QueryCoverage =100%, HitCoverage=85%, E-value=1e-150, Identity=87%"; Hit description=GA19430-PA [Drosophila pseudoobscura]
  misc_feature: Gene Ontology Annotation: Molecular function=GTP binding; Cellular component=cellular_component unknown; Biological process=signal transduction
  misc_feature: Pfam annotation: Pfam_ID=MMR_HSR1; Match level="Score=118.0, E-value =2.3e-32, Copies=1"; Pfam description=GTPase of unknown function
  misc_feature (14)..(14): Xaa can be any naturally occurring amino acid
  misc_feature (210)..(210): Xaa can be any naturally occurring amino acid
  misc_feature (266)..(266): Xaa can be any naturally occurring amino acid
MGILEKISEIEKEXSRTQKNKATEYHLGLLKAKLAKYRSQLLEPSKKSEKGEGFDVLKSGDARVALIGFPSVGKSTLLSTLTKTESEAASYEFTTLTCIPGVIDYNGANIQLLDLPGIIEGAAQGKGRGRQVIAVARTADLVLMMLDATKKDVHRSLLERELESVGIRLNKPKPNIYFKIKKGGGLSFNSTCPLTKIDEKLVQMILHEYXIFNAEVLFREDCTADELIDVICANRVYLPCLYVYNKIDQISIEEVDRIARQPNSIXVSCNMRLNLDYLLSPLWEYLSLIRVYNKKTSQPPDFSDGLILR

SEQ ID NO: 31301 - protein, 18 aa, Diabrotica virgifera
  misc_feature: Coding regions on vcDNA: vcDNA=SeqID_10998; Strand=-; Position=1-54
  misc_feature (2)..(18): Xaa can be any naturally occurring amino acid
FXXXXXXXXXXXXXXXXX

SEQ ID NO: 31302 - protein, 65 aa, Diabrotica virgifera
  misc_feature: Coding regions on vcDNA: vcDNA=SeqID_10999; Strand=-; Position=1-195
  misc_feature (2)..(12): Xaa can be any naturally occurring amino acid
  misc_feature (22)..(29): Xaa can be any naturally occurring amino acid
  misc_feature (32)..(44): Xaa can be any naturally occurring amino acid
  misc_feature (51)..(63): Xaa can be any naturally occurring amino acid
FXXXXXXXXXXXNQLGSHRFNXXXXXXXXRTXXXXXXXXXXXXXIQHRGRXXXXXXXXXXXXXLL

SEQ ID NO: 31303 - protein, 66 aa, Diabrotica virgifera; identical to SEQ ID NO: 26808
  misc_feature: Coding regions on vcDNA: vcDNA=SeqID_11000; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 31304 - protein, 26 aa, Diabrotica virgifera
  misc_feature: Coding regions on vcDNA: vcDNA=SeqID_11001; Strand=+; Position=2-79
  misc_feature (3)..(16): Xaa can be any naturally occurring amino acid
NLXXXXXXXXXXXXXXATSYLHILSF

SEQ ID NO: 31305 - protein, 302 aa, Diabrotica virgifera
  misc_feature: Coding regions on vcDNA: vcDNA=SeqID_11002; Strand=-; Position=1-906
  misc_feature (4)..(302): Xaa can be any naturally occurring amino acid
KKLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31306 - protein, 204 aa, Diabrotica virgifera
  misc_feature: Coding regions on vcDNA: vcDNA=SeqID_11003; Strand=+; Position=56-670
  misc_feature: Homolog annotation: Hit_ID=EAA44285.2; Match level="QueryCoverage =99%, HitCoverage=98%, E-value=8e-79, Identity=76%"; Hit description =ENSANGP00000022747 [Anopheles gambiae str. PEST] ref|XP_557383.1| ENSANGP00000022747 [Anopheles gambiae st
  misc_feature: Gene Ontology Annotation: Molecular function=actin binding; Cellular component=troponin complex; Biological process=muscle development
  misc_feature: Pfam annotation: Pfam_ID=Troponin; Match level="Score=114.5, E-value =2.7e-31, Copies=1"; Pfam description=Troponin
  misc_feature (57)..(66): Xaa can be any naturally occurring amino acid
  misc_feature (172)..(189): Xaa can be any naturally occurring amino acid
MADDEEKKRKQAEIERKRAEVRARMEEASKAKKAKKGFMTPERKKKLRLLLRKKAAXXXXXXXXXXAAERRRIIEERCGKPKLVDDANEGTLKKICKDYYDRMYICEEQKWDLEREVRKRDWEISELNSQVNDLRGKFVKPTLKKVSKYENKFAKLQKKAAEFNFRNQLKVXXXXXXXXXXXXXXXXXXWSKKGDEKKVQEAEA

SEQ ID NO: 31307 - protein, 19 aa, Diabrotica virgifera
  misc_feature: Coding regions on vcDNA: vcDNA=SeqID_11004; Strand=+; Position=2-58
PYRFNKGIRDPFFYHLIIT

SEQ ID NO: 31308 - protein, 74 aa, Diabrotica virgifera
  misc_feature: Coding regions on vcDNA: vcDNA=SeqID_11005; Strand=+; Position=126-350
  misc_feature (10)..(15): Xaa can be any naturally occurring amino acid
VTTRFNPWAXXXXXXYLCQIKMLLERKKHRKNLTRGRREFLLRVVIISFDARVNNPQARSDVAAVAKPLTGIIS

SEQ ID NO: 31309 - protein, 270 aa, Diabrotica virgifera
  misc_feature: Coding regions on vcDNA: vcDNA=SeqID_11006; Strand=+; Position=87-896
  misc_feature: Homolog annotation: Hit_ID=AAR25665.1; Match level="QueryCoverage =97%, HitCoverage=58%, E-value=7e-25, Identity=28%"; Hit description =class I helical cytokine receptor member 2 [Tetraodon nigroviridis]
  misc_feature (110)..(120): Xaa can be any naturally occurring amino acid
  misc_feature (202)..(202): Xaa can be any naturally occurring amino acid
  misc_feature (231)..(232): Xaa can be any naturally occurring amino acid
  misc_feature (245)..(245): Xaa can be any naturally occurring amino acid
  misc_feature (257)..(257): Xaa can be any naturally occurring amino acid
MNNTEVHDTVQAANIYLSRLKWLNSELDHAMKQILSTFEETEANVSKTFCNFKEAFIEALNKREKILLDKAKKTKIEALAPLRECRSMILDKIESTVKLINTGSAIISSXXXXXXXXXXXASLLGTLPEVPELKEVPYISFSYEPSLEIEIVDKLSELGDIYKIPPVQVAELTEKPGAVLVEWKVVVDNEEKVTDIEEFRLXKALGNVHEDKHLVVNFHDAYKGLDCQFLXXDLRVNEQYSFRVXCKFEGTTEWSPXSLPSVGSTSLKPF

SEQ ID NO: 31310 - protein, 111 aa, Diabrotica virgifera
  misc_feature: Coding regions on vcDNA: vcDNA=SeqID_11007; Strand=-; Position=423-758
RKLLTEHTRGEFPDVNVLISSVKKVFVKSPLRVQLYRNKLPNVPLPPEPVLTRWGTWLEAAISYAEHFVAIKELLLEFNAEDSAAIIKAQHIVKTTSLAKQLTFIKNQYAL

SEQ ID NO: 31311 - protein, 62 aa, Diabrotica virgifera
  misc_feature: Coding regions on vcDNA: vcDNA=SeqID_11008; Strand=-; Position=1-186
  misc_feature (9)..(14): Xaa can be any naturally occurring amino acid
  misc_feature (18)..(25): Xaa can be any naturally occurring amino acid
  misc_feature (30)..(40): Xaa can be any naturally occurring amino acid
  misc_feature (42)..(62): Xaa can be any naturally occurring amino acid
FNPHHGGAXXXXXXEFGXXXXXXXXLLSLXXXXXXXXXXXGXXXXXXXXXXXXXXXXXXXXX

SEQ ID NO: 31312 - protein, 71 aa, Diabrotica virgifera
  misc_feature: Coding regions on vcDNA: vcDNA=SeqID_11009; Strand=+; Position=3-218
  misc_feature (3)..(3): Xaa can be any naturally occurring amino acid
  misc_feature (5)..(5): Xaa can be any naturally occurring amino acid
  misc_feature (37)..(48): Xaa can be any naturally occurring amino acid
AAXQXAKKRKDEPFTTSKMIKWWLLRIGERTFYFDKXXXXXXXXXXXXLLVTNNLFIIVEFIRPRELKLLL

SEQ ID NO: 31313 - protein, 60 aa, Diabrotica virgifera
  misc_feature: Coding regions on vcDNA: vcDNA=SeqID_11010; Strand=-; Position=8-190
SGRPIALSFVYGQCCGRKISRRNILNALHTFFSQVVKNIKLKFLDDKKEDLLLFFISIRP

SEQ ID NO: 31314 - protein, 123 aa, Diabrotica virgifera
  misc_feature: Coding regions on vcDNA: vcDNA=SeqID_11011; Strand=+; Position=10-378
  misc_feature (20)..(28): Xaa can be any naturally occurring amino acid
  misc_feature (84)..(92): Xaa can be any naturally occurring amino acid
NFIFYVNPFFIDYSIQDKQXXXXXXXXXSYGNSCREESLYKCCNCNINTPARLPGASIPENTRQSTTSSLSSNPPPDKVPKRKXXXXXXXXXIGKFSQYGHESCIEERNVRFPRARPNATTTF

SEQ ID NO: 31315 - protein, 121 aa, Diabrotica virgifera
  misc_feature: Coding regions on vcDNA: vcDNA=SeqID_11012; Strand=+; Position=331-696
  misc_feature: Homolog annotation: Hit_ID=AAT02773.1; Match level="QueryCoverage =99%, HitCoverage=76%, E-value=3e-47, Identity=79%"; Hit description =cytochrome oxidase subunit I [Diabrotica virgifera virgifera]
  misc_feature (2)..(2): Xaa can be any naturally occurring amino acid
  misc_feature (10)..(10): Xaa can be any naturally occurring amino acid
  misc_feature (35)..(43): Xaa can be any naturally occurring amino acid
  misc_feature (70)..(70): Xaa can be any naturally occurring amino acid
LXERGVGTGXTVYPPLSSNIAHGGPSVDLAIFRLXXXXXXXXXGAINFITTVINIRPIGITFDRIPLFVXAVVITAILLLLSLPVLAGAITILLTDRNLNTSFFDPAGGGDPILHPERIWI

SEQ ID NO: 31316 - protein, 90 aa, Diabrotica virgifera
  misc_feature: Coding regions on vcDNA: vcDNA=SeqID_11013; Strand=-; Position=80-352
  misc_feature (16)..(23): Xaa can be any naturally occurring amino acid
SSVYVWVFSCGSTTLXXXXXXXXRFFWFDVINIVSFPPCPPGSSVSSLPPRDLWGYYQFPDIFHFKTCIPETGSCAFSPFHLRTLCLCQF

SEQ ID NO: 31317 - protein, 131 aa, Diabrotica virgifera; identical to SEQ ID NO: 26802
  misc_feature: Coding regions on vcDNA: vcDNA=SeqID_11014; Strand=-; Position=1-393
  misc_feature (1)..(131): Xaa can be any naturally occurring amino acid

SEQ ID NO: 31318 - protein, 78 aa, Diabrotica virgifera
  misc_feature: Coding regions on vcDNA: vcDNA=SeqID_11015; Strand=-; Position=0-233
  misc_feature (1)..(77): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXT

SEQ ID NO: 31319 - protein, 49 aa, Diabrotica virgifera
  misc_feature: Coding regions on vcDNA: vcDNA=SeqID_11016; Strand=+; Position=6-152
  misc_feature (43)..(49): Xaa can be any naturally occurring amino acid
GINRVIFLEKVQFHKKKMRTPMFGFKLFNLGASSFIIIIFVLXXXXXXX

SEQ ID NO: 31320 - protein, 95 aa, Diabrotica virgifera
  misc_feature: Coding regions on vcDNA: vcDNA=SeqID_11017; Strand=+; Position=214-501
QECMTSCTPSLATNPGHTLCHICSTLFTTRPSLNRLIKIIHTIDETTNNMNLCHIICPLCEHDTNVNRHENLQKHLQELHQVSIELITFEFSNEP

SEQ ID NO: 31321 - protein, 200 aa, Diabrotica virgifera
  misc_feature: Coding regions on vcDNA: vcDNA=SeqID_11018; Strand=+; Position=76-679
  misc_feature: Homolog annotation: Hit_ID=XP_394966.1; Match level="QueryCoverage =100%, HitCoverage=100%, E-value=2e-46, Identity=45%"; Hit description=similar to HDC00027 [Apis mellifera]
  misc_feature: Gene Ontology Annotation: Molecular function=molecular_function unknown; Cellular component=cytoplasmic vesicle; Biological process =intracellular protein transport
  misc_feature: Pfam annotation: Pfam_ID=SFT2; Match level="Score=157.9, E-value=2.3e- 44, Copies=1"; Pfam description=SFT2-like protein
  misc_feature (62)..(62): Xaa can be any naturally occurring amino acid
  misc_feature (187)..(187): Xaa can be any naturally occurring amino acid
MVDLKKDLDEYLLLHSDQKKSFNLQMPSIEAPSITRWFKKESLQQEDHTWCQRITNQCFPTXFQRIVFFAVCIGLGFLCFLMSSIYIPVLVFKARKFALLFTLGSIFFVLGFFFLWGPLAFIRYMFARERLLVTVTYGGSLAATLFCALHLQNLPFTILFAVLQIVSLLWSLIAIIPGGTSGLSFTXKVLCRSSMSSLPI

SEQ ID NO: 31322 - protein, 87 aa, Diabrotica virgifera
  misc_feature: Coding regions on vcDNA: vcDNA=SeqID_11019; Strand=-; Position=121-384
  misc_feature (10)..(17): Xaa can be any naturally occurring amino acid
  misc_feature (26)..(73): Xaa can be any naturally occurring amino acid
YQLNNSFPIXXXXXXXXILILLIISXXXXXXXXXXXXXXXXXXXXXXXXXXXXXXXXXXXXXXXXXXXXXXXXLSYKLIYYPIFKQY

SEQ ID NO: 31323 - protein, 89 aa, Diabrotica virgifera
  misc_feature: Coding regions on vcDNA: vcDNA=SeqID_11020; Strand=+; Position=2-271
  misc_feature (2)..(9): Xaa can be any naturally occurring amino acid
  misc_feature (26)..(35): Xaa can be any naturally occurring amino acid
YXXXXXXXXETNSTSKNFTKRQLRNXXXXXXXXXXPYNGRFRPEDDYAFKKHYYRQERGSKKYKWKRKSRPSSPMEGSEEYMSQKIQKN

SEQ ID NO: 31324 - protein, 233 aa, Diabrotica virgifera
  misc_feature: Coding regions on vcDNA: vcDNA=SeqID_11021; Strand=+; Position=107-808
  misc_feature: Homolog annotation: Hit_ID=CAG07292.1; Match level="QueryCoverage =87%, HitCoverage=31%, E-value=9e-41, Identity=41%"; Hit description =unnamed protein product [Tetraodon nigroviridis]
  misc_feature (123)..(130): Xaa can be any naturally occurring amino acid
YGLITDKNNKMDNSQKYITISVAAFICYCNTLGGSFVFDDNEAIIKNKDVMPHTPILNIFKNDFWGTDITLNSSHKSYRPLTILSYRLNVLYSKNKLDAFQFHATNIILYGLLCLLTVPVFEXXXXXXXXATNIHDVAFLSGLLFTVHPVHTEAVAGLVGRADILSSVLFFVVILLFHKFRNSFGESVIFWYILVAILTCCAVLCKETAIAVVGVLILYDVYRERKSVSWAEM

SEQ ID NO: 31325 - protein, 121 aa, Diabrotica virgifera
  misc_feature: Coding regions on vcDNA: vcDNA=SeqID_11022; Strand=+; Position=1-363
EIIFNNLTYYVLALSYRCHHQLQGSILVDSAVEIHVKQTDLIVKSINVNLLDGIALNLHRDLPALFFSIQYNVFILHGCRHDRDLHHHCDLLVLFIHLHYCIIILEYTLRCKKIDPLKLWP

SEQ ID NO: 31326 - protein, 58 aa, Diabrotica virgifera
  misc_feature: Coding regions on vcDNA: vcDNA=SeqID_11023; Strand=+; Position=198-374
CNEHTNNHKYSQAVMKGLYIVPYNNKYFCLCKALLGKYLSRSCHVSLRHNRNLRLPRE

SEQ ID NO: 31327 - protein, 66 aa, Diabrotica virgifera; identical to SEQ ID NO: 26808
  misc_feature: Coding regions on vcDNA: vcDNA=SeqID_11024; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 31328 - protein, 110 aa, Diabrotica virgifera
  misc_feature: Coding regions on vcDNA: vcDNA=SeqID_11025; Strand=-; Position=378-710
FLNSCICRLPAPPSLTTTSHQLNNIFKNVVLKLFSYGIFIIKYIQMGNKPQFHLKTTLSTFRRPSRVSLSKYKTIPNKQKRCCLVKNSSNNPPNLTHSYRQFRHALYTLK

SEQ ID NO: 31329 - protein, 274 aa, Diabrotica virgifera
  misc_feature: Coding regions on vcDNA: vcDNA=SeqID_11026; Strand=+; Position=16-840
  misc_feature: Homolog annotation: Hit_ID=XP_392002.1; Match level="QueryCoverage =99%, HitCoverage=44%, E-value=3e-49, Identity=36%"; Hit description =similar to ENSANGP00000024998 [Apis mellifera]
  misc_feature: Gene Ontology Annotation: Cellular component=membrane; Biological process=electron transport
  misc_feature (255)..(255): Xaa can be any naturally occurring amino acid
  misc_feature (274)..(274): Xaa can be any naturally occurring amino acid
MLTFWLLAVIIALFYYYAIRPMSYWRRKGVISEDGYWLFGSQLRVLFNLESSYEMLQRVYQLAPNARYIGMYELTTPVLMIKNPKLLKQITVKEFDHFANHKAVIPEGADSLWSNNLLSLKDERWKEIRAVLSPSFTSSKMKMMFDLMSEFSKNLVQHFSKINEDIIEINTKDATSRFANDIIASTAFGVSTDSLNNPNDEFYSMAGNLTNFTLWANLKVIGFVFMPKLLKLLKANVFYSPARRFFIDIIESTIXAREERNIKRPDMLNLLLQX

SEQ ID NO: 31330 - protein, 45 aa, Diabrotica virgifera
  misc_feature: Coding regions on vcDNA: vcDNA=SeqID_11027; Strand=-; Position=63-200
  misc_feature (2)..(12): Xaa can be any naturally occurring amino acid
  misc_feature (23)..(30): Xaa can be any naturally occurring amino acid
  misc_feature (35)..(41): Xaa can be any naturally occurring amino acid
  misc_feature (45)..(45): Xaa can be any naturally occurring amino acid
LXXXXXXXXXXXETNLAHTGLNXXXXXXXXSNRLXXXXXXXNYKX

SEQ ID NO: 31331 - protein, 97 aa, Diabrotica virgifera
  misc_feature: Coding regions on vcDNA: vcDNA=SeqID_11028; Strand=-; Position=1-291
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(97): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXX

SEQ ID NO: 31332 - protein, 59 aa, Diabrotica virgifera
  misc_feature: Coding regions on vcDNA: vcDNA=SeqID_11029; Strand=+; Position=1-177
  misc_feature (5)..(26): Xaa can be any naturally occurring amino acid
  misc_feature (31)..(59): Xaa can be any naturally occurring amino acid
KTRRXXXXXXXXXXXXXXXXXXXXXXNLFNXXXXXXXXXXXXXXXXXXXXXXXXXXXXX

SEQ ID NO: 31333 - protein, 194 aa, Diabrotica virgifera
  misc_feature: Coding regions on vcDNA: vcDNA=SeqID_11030; Strand=+; Position=13-594
  misc_feature: Homolog annotation: Hit_ID=EAA13809.3; Match level="QueryCoverage =100%, HitCoverage=88%, E-value=7e-51, Identity=53%"; Hit description= ENSANGP00000012279 [Anopheles gambiae str. PEST] ref|XP_554099.1| ENSANGP00000012279 [Anopheles gambiae s
  misc_feature (29)..(29): Xaa can be any naturally occurring amino acid
  misc_feature (45)..(45): Xaa can be any naturally occurring amino acid
  misc_feature (68)..(68): Xaa can be any naturally occurring amino acid
  misc_feature (85)..(91): Xaa can be any naturally occurring amino acid
  misc_feature (107)..(107): Xaa can be any naturally occurring amino acid
  misc_feature (127)..(127): Xaa can be any naturally occurring amino acid
MLLTLMLLLVITAPLKYHTMLPLPDPRRXANMSHHATYSYSKAIXHSYFFRWELGPATTLQSDCFDAXNFCKGHCMDAVSLETPXXXXXXXHRIAICNVRHIWTSDXRCNFAGCERTHLQPPNINRXICTGSVATIVPTTQINTDDRSYTEVSGQLQPHYTETAQGNDESCPSNLNNFYDDDIICYDAACHHTK

SEQ ID NO: 31334 - protein, 72 aa, Diabrotica virgifera
  misc_feature: Coding regions on vcDNA: vcDNA=SeqID_11031; Strand=-; Position=70-288
WLDPWCSSSNNLVYSLCVLSPVIISWIVLPMLSAAGSTVVFLNPVGYMSFKRCCKDNFLEQRSIDSSYLFCL

SEQ ID NO: 31335 - protein, 35 aa, Diabrotica virgifera
  misc_feature: Coding regions on vcDNA: vcDNA=SeqID_11032; Strand=-; Position=0-104
  misc_feature (11)..(11): Xaa can be any naturally occurring amino acid
  misc_feature (33)..(33): Xaa can be any naturally occurring amino acid
AATPNYKLLSXPSRSASFIIDLTLPIKITLLSXKV

SEQ ID NO: 31336 - protein, 128 aa, Diabrotica virgifera
  misc_feature: Coding regions on vcDNA: vcDNA=SeqID_11033; Strand=+; Position=3-385
  misc_feature: Homolog annotation: Hit_ID=XP_311299.1; Match level="QueryCoverage =85%, HitCoverage=47%, E-value=1e-27, Identity=51%"; Hit description =ENSANGP00000017419 [Anopheles gambiae] gb|AAM61893.1| glutathione S -transferase [Anopheles
  misc_feature: Gene Ontology Annotation: Molecular function=glutathione transferase activity; Biological process=glutathione metabolism
  misc_feature: Pfam annotation: Pfam_ID=GST_N; Match level="Score=42.4, E-value=1.3e- 09, Copies=1"; Pfam description=Glutathione S-transferase, N-terminal
  misc_feature (19)..(25): Xaa can be any naturally occurring amino acid
  misc_feature (100)..(100): Xaa can be any naturally occurring amino acid
DAWVKLYYDLLSQPSRSLXXXXXXXQVPFEACLVNLGKGEHLKKEYLENVSRIPKVPVVHDGDFRLNESVGIVRYISRQYPVADNLYPKDSKKQALVDEXLEWHHLNVRVNCSKTKARGKETETRREE

SEQ ID NO: 31337 - protein, 54 aa, Diabrotica virgifera
  misc_feature: Coding regions on vcDNA: vcDNA=SeqID_11034; Strand=+; Position=69-233
LHQMFWAQTRYYFLIHRHNTEQDTEIERYDTGAGLQRFYALRSWSYIMLIARVL

SEQ ID NO: 31338 - protein, 76 aa, Diabrotica virgifera
  misc_feature: Coding regions on vcDNA: vcDNA=SeqID_11035; Strand=-; Position=350-580
  misc_feature (48)..(54): Xaa can be any naturally occurring amino acid
  misc_feature (56)..(62): Xaa can be any naturally occurring amino acid
IQFTASYFRAVDIIRVLEENNSLSIIIELSRILLNFRQICSYTKTNGXXXXXXXIXXXXXXXVIIIDSTYAVKARS

SEQ ID NO: 31339 - protein, 76 aa, Diabrotica virgifera
  misc_feature: Coding regions on vcDNA: vcDNA=SeqID_11036; Strand=-; Position=383-613
  misc_feature (59)..(65): Xaa can be any naturally occurring amino acid
ELKWLKIRFSIIHFIAIFFRAVDIFRVLEENNSLSIIIELSRLLLVFRQKCTYTKTNRXXXXXXXIPLIFFARVNI

SEQ ID NO: 31340 - protein, 71 aa, Diabrotica virgifera
  misc_feature: Coding regions on vcDNA: vcDNA=SeqID_11037; Strand=-; Position=3-215
  misc_feature (59)..(68): Xaa can be any naturally occurring amino acid
SKNFNLYSIRLYQNHYYIIDYCSATSHRQYYFAFVKIKYEFPSLPSLPFINLIVSCLTXXXXXXXXXXAGE

SEQ ID NO: 31341 - protein, 233 aa, Diabrotica virgifera
  misc_feature: Coding regions on vcDNA: vcDNA=SeqID_11038; Strand=+; Position=38-736
  misc_feature: Homolog annotation: Hit_ID=JC7249; Match level="QueryCoverage=86%, HitCoverage=66%, E-value=2e-32, Identity=40%"; Hit description =anterior fat body protein - flesh fly (Sarcophaga peregrina) dbj|BAA99282.1| anterior fat body
  misc_feature: Gene Ontology Annotation: Cellular component=nucleus
  misc_feature: Pfam annotation: Pfam_ID=SMP-30; Match level="Score=-4.5, E-value =2.1e-10, Copies=1"; Pfam description=Senescence marker protein-30 (SMP-30)
MTPLNIFIFLFSFWTCGLATVIYLPEHKMSNKYEFIPISDPLDCGTRIHYDECTNSAFFVDVPNGNAYRYDLGSGNVTKTKVGNEPIAFMFPVVGSNNKFIAGLNNKFVSVEWDGVSPQVSKVKTIKEIETDPQLKGNRLNGGKVDPWGRLWAGTMGPAGADGETIPQKGALYSVEKGSVKKHLSNIRISNGLAWNTKKMKMYYLDTLPPQVFPYDISKDGDLSNQKVIFEFG

SEQ ID NO: 31342 - protein, 61 aa, Diabrotica virgifera
  misc_feature: Coding regions on vcDNA: vcDNA=SeqID_11039; Strand=+; Position=2-187
  misc_feature (9)..(16): Xaa can be any naturally occurring amino acid
GGPGRNPRXXXXXXXXERWKDCLVYLYINVIVLTRLVVTEGTPPNRQPDHKYFTIFDIRLF

SEQ ID NO: 31343 - protein, 211 aa, Diabrotica virgifera
  misc_feature: Coding regions on vcDNA: vcDNA=SeqID_11040; Strand=+; Position=135-770
  misc_feature (114)..(121): Xaa can be any naturally occurring amino acid
CNLYYYLGSCHHEIIMSKFSSFIELLVKQTCRRASHEFELESKQQSAPQVVRAVQDDVGIYSLEFLKALHDNTRDSLYKLIRTKDPNDPNSVEVPVGLNWLNNKDFTAPERKAXXXXXXXXKDMAPSNSKNWIDLHHFTHYVYRNFASVSPDPTAEYLTPYFLDEMRGLVRSLIQEDKSQLYLRVLALLREYCIFAPWNYTKQEREDHLYY

SEQ ID NO: 31344 - protein, 95 aa, Diabrotica virgifera
  misc_feature: Coding regions on vcDNA: vcDNA=SeqID_11041; Strand=-; Position=1-285
  misc_feature (32)..(38): Xaa can be any naturally occurring amino acid
  misc_feature (42)..(95): Xaa can be any naturally occurring amino acid
FPPIKNLKSHLGGGNFFFDLNFPKKITPLSLXXXXXXXQKMXXXXXXXXXXXXXXXXXXXXXXXXXXXXXXXXXXXXXXXXXXXXXXXXXXXXXX

SEQ ID NO: 31345 - protein, 76 aa, Diabrotica virgifera
  misc_feature: Coding regions on vcDNA: vcDNA=SeqID_11042; Strand=-; Position=1-228
  misc_feature (1)..(10): Xaa can be any naturally occurring amino acid
  misc_feature (13)..(22): Xaa can be any naturally occurring amino acid
  misc_feature (33)..(40): Xaa can be any naturally occurring amino acid
  misc_feature (43)..(55): Xaa can be any naturally occurring amino acid
  misc_feature (62)..(74): Xaa can be any naturally occurring amino acid
XXXXXXXXXXSFXXXXXXXXXXETNLAHTGLNXXXXXXXXRPXXXXXXXXXXXXXIQHRGRXXXXXXXXXXXXXLL

SEQ ID NO: 31346 - protein, 53 aa, Diabrotica virgifera
  misc_feature: Coding regions on vcDNA: vcDNA=SeqID_11043; Strand=-; Position=86-247
YLEKYHNIASSNHFSSVKYPITVILNSLGMRETYYIYSFIQNFPFSQDYQSEF

SEQ ID NO: 31347 - protein, 61 aa, Diabrotica virgifera
  misc_feature: Coding regions on vcDNA: vcDNA=SeqID_11044; Strand=+; Position=1-183
  misc_feature (1)..(23): Xaa can be any naturally occurring amino acid
  misc_feature (25)..(59): Xaa can be any naturally occurring amino acid
XXXXXXXXXXXXXXXXXXXXXXXKXXXXXXXXXXXXXXXXXXXXXXXXXXXXXXXXXXXGG

SEQ ID NO: 31348 - protein, 120 aa, Diabrotica virgifera
  misc_feature: Coding regions on vcDNA: vcDNA=SeqID_11045; Strand=+; Position=504-863
  misc_feature (23)..(30): Xaa can be any naturally occurring amino acid
  misc_feature (67)..(77): Xaa can be any naturally occurring amino acid
  misc_feature (105)..(116): Xaa can be any naturally occurring amino acid
WSNNFYCSVLGINRFLFILIIKXXXXXXXXKALIINVPSVLSLELHCFFTNCYFYPLCVSYRFYSMXXXXXXXXXXXFGYLFYLQYFSRYCTAYHYSILLIIVIXXXXXXXXXXXXLNQN

SEQ ID NO: 31349 - protein, 310 aa, Diabrotica virgifera
  misc_feature: Coding regions on vcDNA: vcDNA=SeqID_11046; Strand=-; Position=1-930
  misc_feature (1)..(33): Xaa can be any naturally occurring amino acid
  misc_feature (36)..(308): Xaa can be any naturally occurring amino acid
XXXXXXXXXXXXXXXXXXXXXXXXXXXXXXXXXAFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTK

SEQ ID NO: 31350 - protein, 18 aa, Diabrotica virgifera
  misc_feature: Coding regions on vcDNA: vcDNA=SeqID_11047; Strand=-; Position=2-55
YIGYINIHFSNPNIIIIA

SEQ ID NO: 31351 - protein, 34 aa, Diabrotica virgifera
  misc_feature: Coding regions on vcDNA: vcDNA=SeqID_11048; Strand=-; Position=2-103
  misc_feature (7)..(14): Xaa can be any naturally occurring amino acid
VQPFFPXXXXXXXXLSFLPPAKIRRPFKINQGAG

SEQ ID NO: 31352 - protein, 30 aa, Diabrotica virgifera
  misc_feature: Coding regions on vcDNA: vcDNA=SeqID_11049; Strand=-; Position=0-89
KREVDSICVKNIQGTNTNEATIKNFMTRLR

SEQ ID NO: 31353 - protein, 103 aa, Diabrotica virgifera
  misc_feature: Coding regions on vcDNA: vcDNA=SeqID_11050; Strand=-; Position=515-826
  misc_feature (94)..(102): Xaa can be any naturally occurring amino acid
MFYDRVELPPMFFKFFSRGQISGRNHFRTRAQTNGPSISGRFLARPKSSWWEQTFIKAYISKNAKRITLVLQILLLLSLFTILVRNKRSLWLIXXXXXXXXXI

SEQ ID NO: 31354 - protein, 108 aa, Diabrotica virgifera
  misc_feature: Coding regions on vcDNA: vcDNA=SeqID_11051; Strand=+; Position=67-396
  misc_feature: Homolog annotation: Hit_ID=AAN10050.1; Match level="QueryCoverage =99%, HitCoverage=33%, E-value=4e-21, Identity=48%"; Hit description =Y-box protein Ct-p50 [Chironomus tentans]
  misc_feature: Gene Ontology Annotation: Molecular function=DNA binding; Cellular component=nucleus; Biological process=negative regulation of transcription from Pol II promoter
  misc_feature: Pfam annotation: Pfam_ID=CSD; Match level="Score=33.1, E-value=8.3e -07, Copies=1"; Pfam description='Cold-shock' DNA-binding domain
  misc_feature (27)..(27): Xaa can be any naturally occurring amino acid
  misc_feature (35)..(35): Xaa can be any naturally occurring amino acid
  misc_feature (60)..(60): Xaa can be any naturally occurring amino acid
QLRAAAEQPNALAVLKEVLASTVTGTXGWLNGRSXYGVISRNDTKEDVIVHQSSTTKNTXLNFVFSLFYGENEHFSAGGREKGNEARNVNGPNGDPKKGSPHAADRRR

SEQ ID NO: 31355 - protein, 72 aa, Diabrotica virgifera
  misc_feature: Coding regions on vcDNA: vcDNA=SeqID_11052; Strand=-; Position=32-250
  misc_feature (5)..(10): Xaa can be any naturally occurring amino acid
  misc_feature (12)..(18): Xaa can be any naturally occurring amino acid
  misc_feature (51)..(57): Xaa can be any naturally occurring amino acid
KQLYXXXXXXQXXXXXXXTGTDTKLLRHIFLSESITVAKFVVWFLLKRFEXXXXXXXIWFIQMSVWKHKCRP

SEQ ID NO: 31356 - protein, 61 aa, Diabrotica virgifera
  misc_feature: Coding regions on vcDNA: vcDNA=SeqID_11053; Strand=-; Position=46-231
LCTKILKQNLHLTFYLFDNVKFYTITRDRNNIHLPLRSVNFRVISYALNDDARDLNKMLSP

SEQ ID NO: 31357 - protein, 25 aa, Diabrotica virgifera
  misc_feature: Coding regions on vcDNA: vcDNA=SeqID_11054; Strand=-; Position=0-74
PIISIFTILQEYVKSTLPVKSTSQA

SEQ ID NO: 31358 - protein, 65 aa, Diabrotica virgifera
  misc_feature: Coding regions on vcDNA: vcDNA=SeqID_11055; Strand=+; Position=388-585
NNVLLFFILYKIASNIIKAVSDKNETYFLKKHQNYINHNNSIDRCTIIRYLSRLCNLVCFLFLRN

SEQ ID NO: 31359 - protein, 274 aa, Diabrotica virgifera
  misc_feature: Coding regions on vcDNA: vcDNA=SeqID_11056; Strand=+; Position=1-825
  misc_feature: Homolog annotation: Hit_ID=NP_611300.2; Match level="QueryCoverage =98%, HitCoverage=40%, E-value=5e-39, Identity=34%"; Hit description =CG5733-PA [Drosophila melanogaster] gb|AAF57735.1| CG5733-PA [Drosophila melanogaster]
AKTFLIPNDVCKKSGIAGTWVPLDHISIFGYEKRNIKQKDEPSHFASTTPVSVFHLRQDVVLFHSILRKLVNESNGVFLSIQALVGNKTPDIRSELFKISRQYRSIRACLENLQDELTKSKPEDKIELQNYITVFYSIECIWHLCEILFIDTVPGNVVLSQVLEWVRFHFPEHERNAADMLAENKIGLESNPEYWNTVLGALLQGRIPLVRALLRQHSASDNSTFRMGDQILRAMPIFNGASGTPINEFNMQWRHWTMDVHSKIEAKLFSSEQI

SEQ ID NO: 31360 - protein, 110 aa, Diabrotica virgifera
  misc_feature: Coding regions on vcDNA: vcDNA=SeqID_11057; Strand=+; Position=24-353
  misc_feature (15)..(15): Xaa can be any naturally occurring amino acid
  misc_feature (17)..(17): Xaa can be any naturally occurring amino acid
  misc_feature (19)..(19): Xaa can be any naturally occurring amino acid
  misc_feature (21)..(22): Xaa can be any naturally occurring amino acid
  misc_feature (28)..(28): Xaa can be any naturally occurring amino acid
  misc_feature (43)..(43): Xaa can be any naturally occurring amino acid
  misc_feature (49)..(49): Xaa can be any naturally occurring amino acid
  misc_feature (55)..(55): Xaa can be any naturally occurring amino acid
  misc_feature (61)..(61): Xaa can be any naturally occurring amino acid
  misc_feature (64)..(64): Xaa can be any naturally occurring amino acid
  misc_feature (66)..(66): Xaa can be any naturally occurring amino acid
  misc_feature (72)..(73): Xaa can be any naturally occurring amino acid
  misc_feature (75)..(75): Xaa can be any naturally occurring amino acid
  misc_feature (77)..(78): Xaa can be any naturally occurring amino acid
LRPHKKKQTFEPKDXRXRXRXXPRKNRXNRNNKGENSRERSKXRGPREXRSRRPXQNRGNXTNXPXEDRGQXXKXRXXSKSGDGNNEERPEEDNDKPRGSGTDEPNDTDL

SEQ ID NO: 31361 - protein, 66 aa, Diabrotica virgifera
  misc_feature: Coding regions on vcDNA: vcDNA=SeqID_11058; Strand=-; Position=260-460
DDASTSLNFIQFVYPKELFSQYYCPENNNDTATPRKQHERRIVMFSTHLKKSLKSHFYHSENILLK

SEQ ID NO: 31362 - protein, 51 aa, Diabrotica virgifera
  misc_feature: Coding regions on vcDNA: vcDNA=SeqID_11059; Strand=-; Position=1-153
  misc_feature (19)..(50): Xaa can be any naturally occurring amino acid
NFYYLVGNSPIKIPLFTLXXXXXXXXXXXXXXXXXXXXXXXXXXXXXXXXP

SEQ ID NO: 31363 - protein, 51 aa, Diabrotica virgifera
  misc_feature: Coding regions on vcDNA: vcDNA=SeqID_11060; Strand=-; Position=83-238
FHICIQFKLCYACSHYLVLQQQLRSKDVIFSDISPYPPHIVLQKSIYSFCS

SEQ ID NO: 31364 - protein, 244 aa, Diabrotica virgifera
  misc_feature: Coding regions on vcDNA: vcDNA=SeqID_11061; Strand=+; Position=74-809
  misc_feature: Homolog annotation: Hit_ID=XP_393931.1; Match level="QueryCoverage =80%, HitCoverage=43%, E-value=6e-40, Identity=46%"; Hit description =similar to ENSANGP00000009426 [Apis mellifera]
  misc_feature: Gene Ontology Annotation: Molecular function=carboxypeptidase C activity; Cellular component=vacuole; Biological process=proteolysis and peptidolysis
  misc_feature: Pfam annotation: Pfam_ID=Peptidase_S10; Match level="Score=-170.6, E -value=0.00036, Copies=1"; Pfam description=Serine carboxypeptidase
  misc_feature (114)..(133): Xaa can be any naturally occurring amino acid
  misc_feature (159)..(167): Xaa can be any naturally occurring amino acid
  misc_feature (192)..(192): Xaa can be any naturally occurring amino acid
MKSFLSISFGLFLFLGIESKSLNDNIVKKRVFADLYGKLNPTVRGDPGEPLILTDLIEAGKLDEAQDKARVQGLDTDIESYSGYLTVDKEHDSNLFFWFFPSQGNASFDPVVLXXXXXXXXXXXXXXXXXXXXVLLKDGKLDIRETTWNKNNSLIYIDXXXXXXXXXTTDGYASNQTKVAADLYEALHQFFXLFYQYQHQDFYVTGESYAGKYVPAVSYKNHSANTESKLKINLKGLVIVNGSY

SEQ ID NO: 31365 - protein, 61 aa, Diabrotica virgifera
  misc_feature: Coding regions on vcDNA: vcDNA=SeqID_11062; Strand=+; Position=1-186
  misc_feature (5)..(5): Xaa can be any naturally occurring amino acid
TKHSXLYKFKITFYLRKLYLKKRSRAIFFKSDGFRVISDLKSEKCENTYAFSMFENSCVNY

SEQ ID NO: 31366 - protein, 56 aa, Diabrotica virgifera
  misc_feature: Coding regions on vcDNA: vcDNA=SeqID_11063; Strand=-; Position=0-167
  misc_feature (34)..(41): Xaa can be any naturally occurring amino acid
QLSAICVQSSEFPLLSLPNIYNPGALKRRKNVSXXXXXXXXSMLDIYIFSLLIYYR

SEQ ID NO: 31367 - protein, 59 aa, Diabrotica virgifera
  misc_feature: Coding regions on vcDNA: vcDNA=SeqID_11064; Strand=-; Position=1-177
  misc_feature (3)..(25): Xaa can be any naturally occurring amino acid
  misc_feature (29)..(37): Xaa can be any naturally occurring amino acid
  misc_feature (39)..(59): Xaa can be any naturally occurring amino acid
PPXXXXXXXXXXXXXXXXXXXXXXXSIGXXXXXXXXXAXXXXXXXXXXXXXXXXXXXXX

SEQ ID NO: 31368 - protein, 113 aa, Diabrotica virgifera
  misc_feature: Coding regions on vcDNA: vcDNA=SeqID_11065; Strand=+; Position=93-431
  misc_feature: Homolog annotation: Hit_ID=XP_540960.1; Match level="QueryCoverage =84%, HitCoverage=11%, E-value=3e-24, Identity=58%"; Hit description =PREDICTED: similar to spermatogenesis associated factor SPAF [Canis familiaris]
  misc_feature: Gene Ontology Annotation: Molecular function=ATPase activity; Cellular component=intracellular; Biological process=response to drug
  misc_feature (42)..(42): Xaa can be any naturally occurring amino acid
  misc_feature (99)..(99): Xaa can be any naturally occurring amino acid
MAALNANRRSGGGTVADFEYALKRGRPSAKREAQIEVSNVKXTDIGGQENLSTILKQAIEWPLKNPQSFIIPRVTPPKGVPLFGPPGCTETLIDTALAXESGLTFSAIKVRKC

SEQ ID NO: 31369 - protein, 207 aa, Diabrotica virgifera
  misc_feature: Coding regions on vcDNA: vcDNA=SeqID_11066; Strand=+; Position=219-839
  misc_feature (149)..(154): Xaa can be any naturally occurring amino acid
  misc_feature (178)..(178): Xaa can be any naturally occurring amino acid
  misc_feature (192)..(192): Xaa can be any naturally occurring amino acid
TIQCAKMSTSASQQNSPVSLNQDMATDVATERSQVTKRPSNLDLTKKSPSLDLPDSSEPPTPVADSNIALLQDFEDSDNQIKPKNEGNVIKPKVQIHLDANQNSSQSLSLDTSNCCAKYKSHSTRVTSPSGSSKNPKSLMESLLVAKMXXXXXXHPGRQLVRTDSADSSSSFGSINSXTASDVCRCDDCLLXIGDSWHKMEVRPRRK

SEQ ID NO: 31370 - protein, 294 aa, Diabrotica virgifera
  misc_feature: Coding regions on vcDNA: vcDNA=SeqID_11067; Strand=-; Position=2-881
  misc_feature: Homolog annotation: Hit_ID=XP_320907.1; Match level="QueryCoverage =95%, HitCoverage=49%, E-value=1e-86, Identity=56%"; Hit description =ENSANGP00000017603 [Anopheles gambiae]
  misc_feature: Gene Ontology Annotation: Molecular function=nuclear localization sequence binding; Cellular component=soluble fraction; Biological process=protein modification
  misc_feature: Pfam annotation: Pfam_ID=zf-UBP; Match level="Score=109.9, E-value =6.4e-30, Copies=1"; Pfam description=Zn-finger in ubiquitin -hydrolases and
  misc_feature (20)..(20): Xaa can be any naturally occurring amino acid
VTTHSHASCLEQWGDSTCPXVCRCVQSPETAESSECEECGSSVPSPDSLWICLICGHVGCGRYQGGHAASHYRETGHCYALQLGSHRVWDYKGDNFVHRLLQNKADGKLVPSEGPPSEAEGAQEKVDSVQLEFTYLLTSQLEEQRMYFEDKMSLLESQLSEETKILRENMAAVSEENKQLRTKLANVTKEKQALEKKLQQQHSKLTSTLNDLSEERQLGKALRNNQQQWQTKINKLEENFNELRSHKEREITDLKEQVRDLMFFIDAQRVIEKSDEKEDIATGTVTIGEAPETS

SEQ ID NO: 31371 - protein, 200 aa, Diabrotica virgifera
  misc_feature: Coding regions on vcDNA: vcDNA=SeqID_11068; Strand=-; Position=84-686
  misc_feature: Homolog annotation: Hit_ID=AAO43225.1; Match level="QueryCoverage =97%, HitCoverage=31%, E-value=1e-24, Identity=34%"; Hit description =piggyBac transposase [piggyBac ubiquitin-transposase P replacement vector EP3005] gb|AAO43224.1| piggyBac
LWFRYIPKIHRMVHLLSSQHDSDIICQDSQNKPLMILDYNNTKGGVDNADKLIREYSCKRRTARWPFRLFMNIIDICALNAYILYIEKNPDWKKNNFSRRRIFLLQLGAELARNNMEKRAKYIKHKAYVKSALKDCGIPMVNPTTEVATQSVHSAKKRARCYQCPRNCDRKVNTVCSFCKKFICQVHRKEEKTIVCKNCN

SEQ ID NO: 31372 - protein, 123 aa, Diabrotica virgifera
  misc_feature: Coding regions on vcDNA: vcDNA=SeqID_11069; Strand=+; Position=17-388
  misc_feature: Homolog annotation: Hit_ID=XP_316907.1; Match level="QueryCoverage =100%, HitCoverage=79%, E-value=1e-69, Identity=65%"; Hit description= ENSANGP00000023768 [Anopheles gambiae] gb|EAA12524.3| ENSANGP00000011015 [Anopheles gambiae
  misc_feature: Gene Ontology Annotation: Molecular function=transcription co -activator activity; Cellular component=focal adhesion; Biological process=integrin-mediated signaling pathway
  misc_feature: Pfam annotation: Pfam_ID=LIM; Match level="Score=166.3, E-value=6.6e -47, Copies=2"; Pfam description=LIM domain
FDMFAPKCGGCNRAIMENYISALNAQWHPDCFVCRDCRQPFIGGSFFDHEGQPYCETHYHLKRGSLCAGCHKPISGRCVTAMFRKFHPEHFVCAFCLKQLNKGTFKEQNDKPYCHTCFEKLFG

SEQ ID NO: 31373 - protein, 29 aa, Diabrotica virgifera
  misc_feature: Coding regions on vcDNA: vcDNA=SeqID_11070; Strand=-; Position=1-87
  misc_feature (3)..(28): Xaa can be any naturally occurring amino acid
LRXXXXXXXXXXXXXXXXXXXXXXXXXXF

SEQ ID NO: 31374 - protein, 47 aa, Diabrotica virgifera
  misc_feature: Coding regions on vcDNA: vcDNA=SeqID_11071; Strand=-; Position=216-359
ARPLRIFNSISIHICNYGYLGLYINFIQIDIHQRYYYRIQNITIKLV

SEQ ID NO: 31375 - protein, 346 aa, Diabrotica virgifera
  misc_feature: Coding regions on vcDNA: vcDNA=SeqID_11072; Strand=-; Position=0-1037
  misc_feature (33)..(342): Xaa can be any naturally occurring amino acid
PLIQHSGVAIFIIGLELSNKITLFSLKVIYSFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRSTR

SEQ ID NO: 31376 - protein, 66 aa, Diabrotica virgifera; identical to SEQ ID NO: 26808
  misc_feature: Coding regions on vcDNA: vcDNA=SeqID_11073; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 31377 - protein, 105 aa, Diabrotica virgifera
  misc_feature: Coding regions on vcDNA: vcDNA=SeqID_11074; Strand=-; Position=198-515
PPLPGEDGPSNPGLLYGDLDQTRADGSRMGGKSSKDEVQENGVVNSNFIVNNKDIKLDTEVQVLLYIITTVLIMRLAWSLWKTHRRNLKRNIHRGLARSTANIDV

SEQ ID NO: 31378 - protein, 66 aa, Diabrotica virgifera
  misc_feature: Coding regions on vcDNA: vcDNA=SeqID_11075; Strand=-; Position=425-625
  misc_feature (38)..(45): Xaa can be any naturally occurring amino acid
IQYSTRSRHYLLGLVLSCLMVTNILKIVVILAHSAFLXXXXXXXXWIRHSNTARSPLMIFHPTLRL

SEQ ID NO: 31379 - protein, 191 aa, Diabrotica virgifera
  misc_feature: Coding regions on vcDNA: vcDNA=SeqID_11076; Strand=+; Position=1-573
  misc_feature: Homolog annotation: Hit_ID=AAF87758.1; Match level="QueryCoverage =100%, HitCoverage=43%, E-value=3e-70, Identity=72%"; Hit description= cytochrome oxidase subunit I [Diabrotica porracea]
  misc_feature: Pfam annotation: Pfam_ID=COX1; Match level="Score=-196.0, E-value =0.00014, Copies=1"; Pfam description=Cytochrome C and Quinol oxidase polyp
  misc_feature (19)..(27): Xaa can be any naturally occurring amino acid
  misc_feature (31)..(37): Xaa can be any naturally occurring amino acid
  misc_feature (48)..(55): Xaa can be any naturally occurring amino acid
  misc_feature (76)..(76): Xaa can be any naturally occurring amino acid
  misc_feature (111)..(111): Xaa can be any naturally occurring amino acid
  misc_feature (128)..(128): Xaa can be any naturally occurring amino acid
  misc_feature (131)..(137): Xaa can be any naturally occurring amino acid
  misc_feature (164)..(170): Xaa can be any naturally occurring amino acid
  misc_feature (184)..(184): Xaa can be any naturally occurring amino acid
RNLNTSFFDPAGGGDPILXXXXXXXXXHPEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGI

SEQ ID NO: 31380 - protein, 39 aa, Diabrotica virgifera
  misc_feature: Coding regions on vcDNA: vcDNA=SeqID_11077; Strand=-; Position=1-117
  misc_feature (6)..(24): Xaa can be any naturally occurring amino acid
  misc_feature (26)..(39): Xaa can be any naturally occurring amino acid
SKNWVXXXXXXXXXXXXXXXXXXXPXXXXXXXXXXXXXX

SEQ ID NO: 31381 - protein, 291 aa, Diabrotica virgifera
  misc_feature: Coding regions on vcDNA: vcDNA=SeqID_11078; Strand=-; Position=1-873
  misc_feature (12)..(291): Xaa can be any naturally occurring amino acid
RLTLQIKFTLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31382 - protein, 37 aa, Diabrotica virgifera
  misc_feature: Coding regions on vcDNA: vcDNA=SeqID_11079; Strand=+; Position=101-211
STKRCFFTGHFYLQHFFLPLKGIWPMTFWQREPNEIL

SEQ ID NO: 31383 - protein, 180 aa, Diabrotica virgifera
  misc_feature: Coding regions on vcDNA: vcDNA=SeqID_11080; Strand=+; Position=67-606
  misc_feature: Homolog annotation: Hit_ID=CAC14874.1; Match level="QueryCoverage =84%, HitCoverage=29%, E-value=3e-25, Identity=42%"; Hit description =zinc/iron regulated transporter-related protein 3, DZIP3 protein [Drosophila melanogaster]
  misc_feature: Pfam annotation: Pfam_ID=Zip; Match level="Score=-91.5, E-value =0.017, Copies=1"; Pfam description=ZIP Zinc transporter
MPPRVLLHSHHDHLEHQDSEGNATLPKATAMCVLFTASFIIGNIPIKLNQWLNWSSDAKSNSYVKLLLGLGGGVLLCTTFIHLLPEVSEHFEELDLTPNIEIHYAEVLMCIGFFIMYLVEECVHVYLEYKEKPPDMKIPLEPVDVDLGLALKRSISIRRGEIPDIKKIPPELAVQAEHHR

SEQ ID NO: 31384 - protein, 48 aa, Diabrotica virgifera
  misc_feature: Coding regions on vcDNA: vcDNA=SeqID_11081; Strand=-; Position=0-143
  misc_feature (1)..(15): Xaa can be any naturally occurring amino acid
  misc_feature (17)..(47): Xaa can be any naturally occurring amino acid
XXXXXXXXXXXXXXXVXXXXXXXXXXXXXXXXXXXXXXXXXXXXXXXS

SEQ ID NO: 31385 - protein, 21 aa, Diabrotica virgifera
  misc_feature: Coding regions on vcDNA: vcDNA=SeqID_11082; Strand=-; Position=0-62
IYDIFCMGARAGGAAGTAPRP

SEQ ID NO: 31386 - protein, 223 aa, Diabrotica virgifera
  misc_feature: Coding regions on vcDNA: vcDNA=SeqID_11083; Strand=-; Position=1-669
  misc_feature (2)..(7): Xaa can be any naturally occurring amino acid
  misc_feature (20)..(40): Xaa can be any naturally occurring amino acid
  misc_feature (53)..(84): Xaa can be any naturally occurring amino acid
  misc_feature (91)..(104): Xaa can be any naturally occurring amino acid
  misc_feature (107)..(198): Xaa can be any naturally occurring amino acid
  misc_feature (204)..(223): Xaa can be any naturally occurring amino acid
LXXXXXXTSHTLFFSLLPLXXXXXXXXXXXXXXXXXXXXXPLPPLPPLGLCGXXXXXXXXXXXXXXXXXXXXXXXXXXXXXXXXLPPPPPXXXXXXXXXXXXXXGGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGGGVPXXXXXXXXXXXXXXXXXXXX

SEQ ID NO: 31387 - protein, 250 aa, Diabrotica virgifera
  misc_feature: Coding regions on vcDNA: vcDNA=SeqID_11084; Strand=-; Position=1-750
  misc_feature (9)..(9): Xaa can be any naturally occurring amino acid
  misc_feature (12)..(12): Xaa can be any naturally occurring amino acid
  misc_feature (14)..(250): Xaa can be any naturally occurring amino acid
ITPNLNKLXYNXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31388 - protein, 37 aa, Diabrotica virgifera
  misc_feature: Coding regions on vcDNA: vcDNA=SeqID_11085; Strand=+; Position=1-111
  misc_feature (3)..(11): Xaa can be any naturally occurring amino acid
  misc_feature (15)..(15): Xaa can be any naturally occurring amino acid
  misc_feature (19)..(19): Xaa can be any naturally occurring amino acid
  misc_feature (21)..(37): Xaa can be any naturally occurring amino acid
IIXXXXXXXXXLLYXKFIXLXXXXXXXXXXXXXXXXX

SEQ ID NO: 31389 - protein, 58 aa, Diabrotica virgifera
  misc_feature: Coding regions on vcDNA: vcDNA=SeqID_11086; Strand=-; Position=0-173
  misc_feature (2)..(28): Xaa can be any naturally occurring amino acid
  misc_feature (30)..(57): Xaa can be any naturally occurring amino acid
PXXXXXXXXXXXXXXXXXXXXXXXXXXXVXXXXXXXXXXXXXXXXXXXXXXXXXXXXP

SEQ ID NO: 31390 - protein, 42 aa, Diabrotica virgifera
  misc_feature: Coding regions on vcDNA: vcDNA=SeqID_11087; Strand=+; Position=2-127
  misc_feature (3)..(32): Xaa can be any naturally occurring amino acid
  misc_feature (36)..(36): Xaa can be any naturally occurring amino acid
  misc_feature (39)..(39): Xaa can be any naturally occurring amino acid
KLXXXXXXXXXXXXXXXXXXXXXXXXXXXXXXLFIXGDXKIN

SEQ ID NO: 31391 - protein, 72 aa, Diabrotica virgifera
  misc_feature: Coding regions on vcDNA: vcDNA=SeqID_11088; Strand=-; Position=384-602
  misc_feature (10)..(20): Xaa can be any naturally occurring amino acid
LKKYIILNKXXXXXXXXXXXLIISVILVCFQHLQKLNQKGGIRYHCLAQTKFIMVNTPFTSCFRRKSYFYTC

SEQ ID NO: 31392 - protein, 61 aa, Diabrotica virgifera
  misc_feature: Coding regions on vcDNA: vcDNA=SeqID_11089; Strand=-; Position=14-199
  misc_feature (6)..(14): Xaa can be any naturally occurring amino acid
  misc_feature (24)..(31): Xaa can be any naturally occurring amino acid
  misc_feature (57)..(57): Xaa can be any naturally occurring amino acid
LVFCSXXXXXXXXXPTRASTGLTXXXXXXXXEQTYNIAATPIINLIQHRGPNLYYRXELSQ

SEQ ID NO: 31393 - protein, 66 aa, Diabrotica virgifera; identical to SEQ ID NO: 26808
  misc_feature: Coding regions on vcDNA: vcDNA=SeqID_11090; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 31394 - protein, 67 aa, Diabrotica virgifera
  misc_feature: Coding regions on vcDNA: vcDNA=SeqID_11091; Strand=-; Position=334-537
  misc_feature (18)..(24): Xaa can be any naturally occurring amino acid
  misc_feature (48)..(54): Xaa can be any naturally occurring amino acid
YSFVLSLLYYAHIPKVIXXXXXXXRIKILVSKLIISIKVNFFLNPPNXXXXXXXINLMLKQLNNNFI

SEQ ID NO: 31395 - protein, 195 aa, Diabrotica virgifera
  misc_feature: Coding regions on vcDNA: vcDNA=SeqID_11092; Strand=+; Position=214-798
  misc_feature (83)..(89): Xaa can be any naturally occurring amino acid
QVLMHGRRNLDAKVQLSSDELPQVLKHLPIPLESDLVPEIVSEEKAQVASEVENNAVKSLIQPEDQERVEVLPEKPIDLPIEXXXXXXXKSLLAPEPLSDSNTVLQKVAPKPAQTLDSVLQETQNIIRVGLKNLRDSFKPYKGELGPTAELWATLEKQVEEYFSEEKTNSLLNISSIRRWIYSSFSISTSLQNNW

SEQ ID NO: 31396 - protein, 96 aa, Diabrotica virgifera
  misc_feature: Coding regions on vcDNA: vcDNA=SeqID_11093; Strand=+; Position=1-291
  misc_feature (4)..(10): Xaa can be any naturally occurring amino acid
  misc_feature (12)..(24): Xaa can be any naturally occurring amino acid
KFQXXXXXXXLXXXXXXXXXXXXXNITCKSKNRIRLCISSIQPCLHWESRPGAEGILERICGKGSKLCLIKELTTDSKYIPLSNRDKYWHTATRRR

SEQ ID NO: 31397 - protein, 294 aa, Diabrotica virgifera
  misc_feature: Coding regions on vcDNA: vcDNA=SeqID_11094; Strand=+; Position=24-905
  misc_feature: Homolog annotation: Hit_ID=XP_311420.1; Match level="QueryCoverage =97%, HitCoverage=74%, E-value=9e-50, Identity=37%"; Hit description =ENSANGP00000000566 [Anopheles gambiae]
  misc_feature (68)..(74): Xaa can be any naturally occurring amino acid
  misc_feature (234)..(234): Xaa can be any naturally occurring amino acid
MINTKKERCLKEVENILSLAKLSKDDIKPLSQAIYFTEQNLYNHNFRLLQLDPRLLQEITEGSELCFXXXXXXXLVICSETQTFQVVEAETSNSLLLVNDMKFPKDIDDSLSSTVHGVKVKGIFYEYLEASVGKPHLKKLDDLLKSFPYKGPEHEFEVNKENLYSFDDLCDKIQASKSELKEALSTMTVVEISGKIRTLDIEYHFRILSYMLKLLEENSWELDEVDFKETVDSXKELAPKEVVSHLFDKYTEESKEIDGIALYKYKEDEVCKFFAKVLLHETGKFNLNEFLQAW

SEQ ID NO: 31398 - protein, 114 aa, Diabrotica virgifera
  misc_feature: Coding regions on vcDNA: vcDNA=SeqID_11095; Strand=+; Position=541-885
  misc_feature (87)..(96): Xaa can be any naturally occurring amino acid
  misc_feature (113)..(113): Xaa can be any naturally occurring amino acid
RIIMRSNTFFVTAHTRNRSRTVFVTGWNKSISKYSIQMQGPYTMNLDTNVAFGFDPAHARVPACTGDSLSEEIMAFTLQNSTIEEQXXXXXXXXXXGVKPAVIHRWMQKKVHXE

SEQ ID NO: 31399 - protein, 119 aa, Diabrotica virgifera
  misc_feature: Coding regions on vcDNA: vcDNA=SeqID_11096; Strand=-; Position=169-528
  misc_feature: Homolog annotation: Hit_ID=S36442; Match level="QueryCoverage=74%, HitCoverage=61%, E-value=7e-09, Identity=38%"; Hit description =reverse transcriptase-like protein - bovine (fragment)
SATSETRKLLKQKNVDSRDKRVIVNVYWIQKAKVRIENVETETKEIKRGVRQGCVLSTLLFNLYSKAVFKEAISGEKQGISRKGKIWNNIRFTDDIAIFADILKALQRLVNRLLSQYKI

SEQ ID NO: 31400 - protein, 64 aa, Diabrotica virgifera
  misc_feature: Coding regions on vcDNA: vcDNA=SeqID_11097; Strand=-; Position=71-265
CIGSTEIYLIRIPLPMIIRAVKKRQKVVTVVSLGGRNPKRKIRRRGIIRCCDSTSYGALAGAVY

SEQ ID NO: 31401 - protein, 44 aa, Diabrotica virgifera
  misc_feature: Coding regions on vcDNA: vcDNA=SeqID_11098; Strand=-; Position=2-133
  misc_feature (27)..(38): Xaa can be any naturally occurring amino acid
KFSMPILSVSARSYMILSRPVNLNISXXXXXXXXXXXXTYYKIR

SEQ ID NO: 31402 - protein, 92 aa, Diabrotica virgifera
  misc_feature: Coding regions on vcDNA: vcDNA=SeqID_11099; Strand=-; Position=2-277
  misc_feature (3)..(91): Xaa can be any naturally occurring amino acid
KNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXI

SEQ ID NO: 31403 - protein, 80 aa, Diabrotica virgifera
  misc_feature: Coding regions on vcDNA: vcDNA=SeqID_11100; Strand=+; Position=447-689
PIEVPETPCVRSGLAPEPRSDSNTVLLTVYPKSDHTLHRDLLNTQNIIRTGLRNFIESFKTYKRRIDSHCYTTVYDVQAS

SEQ ID NO: 31404 - protein, 157 aa, Diabrotica virgifera
  misc_feature: Coding regions on vcDNA: vcDNA=SeqID_11101; Strand=-; Position=203-676
  misc_feature (5)..(14): Xaa can be any naturally occurring amino acid
SLKNXXXXXXXXXXAFTIHLIMGVSLGNGNTLMVHRGHRAGSRYTTFPAPPTSRTELQGASSILPTSFPSHNPRTTLYILSTFGTHISQSKPKRPTYQPQEKSRSGLTNNYKAIVSLKQHPVYQNSENPLAYLKRPQKIKFNGLHKFFGRTTLRLQS

SEQ ID NO: 31405 - protein, 66 aa, Diabrotica virgifera; identical to SEQ ID NO: 26808
  misc_feature: Coding regions on vcDNA: vcDNA=SeqID_11102; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 31406 - protein, 231 aa, Diabrotica virgifera
  misc_feature: Coding regions on vcDNA: vcDNA=SeqID_11103; Strand=+; Position=2-697
  misc_feature: Homolog annotation: Hit_ID=XP_309184.1; Match level="QueryCoverage =90%, HitCoverage=79%, E-value=2e-96, Identity=72%"; Hit description =ENSANGP00000018544 [Anopheles gambiae]
  misc_feature: Pfam annotation: Pfam_ID=CBM_14; Match level="Score=155.9, E-value =8.9e-44, Copies=3"; Pfam description=Chitin binding Peritrophin-A domain
AAASAQFKCPPKDGQYPDPIQCDKFYECEDGIAKTKLCPDGLVFDPEIRKRNKCDQPFNVDCGDRDQLQPPQPKGVCPRLNGFFAHEDPTVCNKFYNCIQGDNTEQTCTAGLVFDEYNGLCVWPETIDRKGCNMQGNTLKDGFTCPKETQKDANGNLVVHPKFPHTTDCQRFYVCLNGVEPRDLGCQVGEVYNDVTQRCDAPENVPGCEDWYQSEETPSSGNSKPAKPKSK

SEQ ID NO: 31407 - protein, 89 aa, Diabrotica virgifera
  misc_feature: Coding regions on vcDNA: vcDNA=SeqID_11104; Strand=-; Position=19-288
  misc_feature (44)..(89): Xaa can be any naturally occurring amino acid
AHPSIRLCVPLMFWSYRILPPVIPIPKYVRAVRRSTRWGVHVSXXXXXXXXXXXXXXXXXXXXXXXXXXXXXXXXXXXXXXXXXXXXXX

SEQ ID NO: 31408 - protein, 105 aa, Diabrotica virgifera
  misc_feature: Coding regions on vcDNA: vcDNA=SeqID_11105; Strand=-; Position=282-599
  misc_feature (13)..(20): Xaa can be any naturally occurring amino acid
YCYKYLARIKFSXXXXXXXXCRRNDSNSIYKRIQNLHNFDLIVFTYESSIIYAFFLGFLLGTLDFCQVCHMVIIKNVVTFCLALVNMICFQNNTNMLIFFFKMYD

SEQ ID NO: 31409 - protein, 78 aa, Diabrotica virgifera
  misc_feature: Coding regions on vcDNA: vcDNA=SeqID_11106; Strand=-; Position=1-234
  misc_feature (9)..(62): Xaa can be any naturally occurring amino acid
  misc_feature (64)..(78): Xaa can be any naturally occurring amino acid
PKNFPCILXXXXXXXXXXXXXXXXXXXXXXXXXXXXXXXXXXXXXXXXXXXXXXXXXXXXXXLXXXXXXXXXXXXXXX

SEQ ID NO: 31410 - protein, 35 aa, Diabrotica virgifera
  misc_feature: Coding regions on vcDNA: vcDNA=SeqID_11107; Strand=+; Position=1-108
  misc_feature (4)..(24): Xaa can be any naturally occurring amino acid
HELXXXXXXXXXXXXXXXXXXXXXLEQSFIHSYPE

SEQ ID NO: 31411 - protein, 65 aa, Diabrotica virgifera
  misc_feature: Coding regions on vcDNA: vcDNA=SeqID_11108; Strand=-; Position=3-197
  misc_feature (1)..(12): Xaa can be any naturally occurring amino acid
  misc_feature (28)..(28): Xaa can be any naturally occurring amino acid
  misc_feature (32)..(45): Xaa can be any naturally occurring amino acid
  misc_feature (52)..(64): Xaa can be any naturally occurring amino acid
XXXXXXXXXXXXNQPGSHRFKLRSCKIXKVEXXXXXXXXXXXXXXSNIEVAXXXXXXXXXXXXXC

SEQ ID NO: 31412 - protein, 100 aa, Diabrotica virgifera
  misc_feature: Coding regions on vcDNA: vcDNA=SeqID_11109; Strand=+; Position=99-401
TIYVLYSKKLRRLVQSNFLRLRLLENISLTVFLGPTVSHLPLRVFYTHSGVFIRTLGFSVSRVCCSHSSRVTLYLWSVHQYFRSLHLASEAFDWMPARCL

SEQ ID NO: 31413 - protein, 405 aa, Diabrotica virgifera
  misc_feature: Coding regions on vcDNA: vcDNA=SeqID_11110; Strand=-; Position=2-1216
  misc_feature (11)..(107): Xaa can be any naturally occurring amino acid
  misc_feature (109)..(137): Xaa can be any naturally occurring amino acid
  misc_feature (149)..(185): Xaa can be any naturally occurring amino acid
  misc_feature (193)..(227): Xaa can be any naturally occurring amino acid
  misc_feature (230)..(238): Xaa can be any naturally occurring amino acid
  misc_feature (241)..(335): Xaa can be any naturally occurring amino acid
  misc_feature (337)..(346): Xaa can be any naturally occurring amino acid
  misc_feature (348)..(399): Xaa can be any naturally occurring amino acid
PFPSLLINKHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXXXXXXXXXXXXXPPAVSPFLPPRXXXXXXXXXXXXXXXXXXXXXXXXXXXXXXXXXXXXXSPSPLPPXXXXXXXXXXXXXXXXXXXXXXXXXXXXXXXXXXXLFXXXXXXXXXPPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXYXXXXXXXXXXXXXXXXXXXXXXXXXXXXXXXXXXXXXXXXXXXXXXXXXXXXRSRSRT

SEQ ID NO: 31414 - protein, 31 aa, Diabrotica virgifera
  misc_feature: Coding regions on vcDNA: vcDNA=SeqID_11111; Strand=-; Position=2-94
  misc_feature (6)..(25): Xaa can be any naturally occurring amino acid
  misc_feature (28)..(28): Xaa can be any naturally occurring amino acid
  misc_feature (31)..(31): Xaa can be any naturally occurring amino acid
KKKGRXXXXXXXXXXXXXXXXXXXXYFXITX

SEQ ID NO: 31415 - protein, 66 aa, Diabrotica virgifera; identical to SEQ ID NO: 26808
  misc_feature: Coding regions on vcDNA: vcDNA=SeqID_11112; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 31416 - protein, 417 aa, Diabrotica virgifera
  misc_feature: Coding regions on vcDNA: vcDNA=SeqID_11113; Strand=-; Position=1-1251
  misc_feature (3)..(43): Xaa can be any naturally occurring amino acid
  misc_feature (45)..(62): Xaa can be any naturally occurring amino acid
  misc_feature (64)..(85): Xaa can be any naturally occurring amino acid
  misc_feature (88)..(103): Xaa can be any naturally occurring amino acid
  misc_feature (111)..(120): Xaa can be any naturally occurring amino acid
  misc_feature (122)..(141): Xaa can be any naturally occurring amino acid
  misc_feature (148)..(154): Xaa can be any naturally occurring amino acid
  misc_feature (157)..(165): Xaa can be any naturally occurring amino acid
  misc_feature (177)..(243): Xaa can be any naturally occurring amino acid
  misc_feature (246)..(261): Xaa can be any naturally occurring amino acid
  misc_feature (263)..(270): Xaa can be any naturally occurring amino acid
  misc_feature (274)..(311): Xaa can be any naturally occurring amino acid
  misc_feature (323)..(348): Xaa can be any naturally occurring amino acid
  misc_feature (351)..(379): Xaa can be any naturally occurring amino acid
  misc_feature (396)..(417): Xaa can be any naturally occurring amino acid
WWXXXXXXXXXXXXXXXXXXXXXXXXXXXXXXXXXXXXXXXXXRXXXXXXXXXXXXXXXXXXGXXXXXXXXXXXXXXXXXXXXXXRGXXXXXXXXXXXXXXXXGVFGGGFXXXXXXXXXXGXXXXXXXXXXXXXXXXXXXXLLRGGRXXXXXXXPGXXXXXXXXXRGGGSPAVGSPXXXXXXXXXXXXXXXXXXXXXXXXXXXXXXXXXXXXXXXXXXXXXXXXXXXXXXXXXXXXXXXXXXXGPXXXXXXXXXXXXXXXXGXXXXXXXXFPPXXXXXXXXXXXXXXXXXXXXXXXXXXXXXXXXXXXXXXPRVFSPSPFRGXXXXXXXXXXXXXXXXXXXXXXXXXXRFXXXXXXXXXXXXXXXXXXXXXXXXXXXXXIPFVTVWFDFWGLFKGXXXXXXXXXXXXXXXXXXXXXX

SEQ ID NO: 31417 - protein, 184 aa, Diabrotica virgifera
  misc_feature: Coding regions on vcDNA: vcDNA=SeqID_11114; Strand=+; Position=270-824
  misc_feature: Homolog annotation: Hit_ID=NP_733324.1; Match level="QueryCoverage =84%, HitCoverage=43%, E-value=3e-53, Identity=67%"; Hit description =CG7816-PG, isoform G [Drosophila melanogaster] ref|NP_733323.1| CG7816-PF, isoform F [Drosophila
  misc_feature: Gene Ontology Annotation: Molecular function=molecular_function unknown; Cellular component=membrane; Biological process=nurse cell/oocyte transport (sensu Insecta)
  misc_feature: Pfam annotation: Pfam_ID=Zip; Match level="Score=43.6, E-value=5.7e -10, Copies=1"; Pfam description=ZIP Zinc transporter
  misc_feature (120)..(126): Xaa can be any naturally occurring amino acid
  misc_feature (172)..(172): Xaa can be any naturally occurring amino acid
FVPAVAVIKLRNLNFKLGLDTYKGLSQPIEHKKSVSGYLNLVANTMDNFTHGLSLGGAFLVSLRLGLLTTFAILVHEIPHEVGDFAILLKSGFTRWHAGVFQLLTAGGGLIGAMAAILFXXXXXXXEARSSWILPFTAGTFLHIALVTVLPDLLKEEDPKESFKQLLALILXITVMAFVTNAFE

SEQ ID NO: 31418 - protein, 19 aa, Diabrotica virgifera
  misc_feature: Coding regions on vcDNA: vcDNA=SeqID_11115; Strand=-; Position=1-57
LVPVYLIIVTTCSINIYNL

SEQ ID NO: 31419 - protein, 29 aa, Diabrotica virgifera
  misc_feature: Coding regions on vcDNA: vcDNA=SeqID_11116; Strand=-; Position=191-280
MYKHISTYDHSFSSNVSYPPIIIDPSALV

SEQ ID NO: 31420 - protein, 46 aa, Diabrotica virgifera
  misc_feature: Coding regions on vcDNA: vcDNA=SeqID_11117; Strand=-; Position=2-139
  misc_feature (6)..(16): Xaa can be any naturally occurring amino acid
  misc_feature (30)..(43): Xaa can be any naturally occurring amino acid
LGYELXXXXXXXXXXXLNNISRVLFFRIIXXXXXXXXXXXXXXPIY

SEQ ID NO: 31421 - protein, 108 aa, Diabrotica virgifera; identical to SEQ ID NO: 27732
  misc_feature: Coding regions on vcDNA: vcDNA=SeqID_11118; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 31422 - protein, 103 aa, Diabrotica virgifera
  misc_feature: Coding regions on vcDNA: vcDNA=SeqID_11119; Strand=-; Position=58-369
  misc_feature (12)..(19): Xaa can be any naturally occurring amino acid
  misc_feature (61)..(82): Xaa can be any naturally occurring amino acid
NADATLGTSSVXXXXXXXXSSASGTIFSSSDRVCGANRHFAFVLFHPWIVTVSLNKNHERXXXXXXXXXXXXXXXXXXXXXXCAAALLLHNVYIIFHFLPIEA

SEQ ID NO: 31423 - protein, 124 aa, Diabrotica virgifera
  misc_feature: Coding regions on vcDNA: vcDNA=SeqID_11120; Strand=-; Position=1-372
  misc_feature (1)..(1): Xaa can be any naturally occurring amino acid
  misc_feature (15)..(22): Xaa can be any naturally occurring amino acid
  misc_feature (25)..(37): Xaa can be any naturally occurring amino acid
  misc_feature (44)..(56): Xaa can be any naturally occurring amino acid
  misc_feature (58)..(121): Xaa can be any naturally occurring amino acid
XIKDRNQPGSHRLNXXXXXXXXRTXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXKKM

SEQ ID NO: 31424 - protein, 77 aa, Diabrotica virgifera
  misc_feature: Coding regions on vcDNA: vcDNA=SeqID_11121; Strand=-; Position=225-458
PSIYFANLSDFALSVFFTHPNAICHTILKSKFNKDQRRSAGTNLQKGCVNFTSSEIIVKTMYSGTPISRPPITRKSG

SEQ ID NO: 31425 - protein, 66 aa, Diabrotica virgifera; identical to SEQ ID NO: 26808
  misc_feature: Coding regions on vcDNA: vcDNA=SeqID_11122; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 31426 - protein, 57 aa, Diabrotica virgifera
  misc_feature: Coding regions on vcDNA: vcDNA=SeqID_11123; Strand=+; Position=175-348
ETQHLLFVPCACRYHYVIIISIILFSPKRAELLNLFLPSKSINYPFCTEMKSLPPHI

SEQ ID NO: 31427 - protein, 117 aa, Diabrotica virgifera
  misc_feature: Coding regions on vcDNA: vcDNA=SeqID_11124; Strand=+; Position=744 -1094
  misc_feature (60)..(80): Xaa can be any naturally occurring amino acid
  misc_feature (83)..(91): Xaa can be any naturally occurring amino acid
  misc_feature (98)..(112): Xaa can be any naturally occurring amino acid
TDYVCSLVLVLLLHHSPSSLTLHLHRSIDDTNNEIMPVFFFIFYGFFLSLIHSGNRIECXXXXXXXXXXXXXXXXXXXXXNFXXXXXXXXXFSRLPGXXXXXXXXXXXXXXXLPPPG

SEQ ID NO: 31428 - protein, 143 aa, Diabrotica virgifera
  misc_feature: Coding regions on vcDNA: vcDNA=SeqID_11125; Strand=+; Position=102-533
FVEEMPWVVLRFPESETIEAVPAKWYDKANKLCKFPPVDDHTEKELSNFIIEEYDPLEEWPIHEAVLESQTEFVLFNKAHIRASKACNSQNYKSDKETVLPQKRPPKPRKIASSSSEQDSDGSDLVFEHSFPRYTKNILFRRF

SEQ ID NO: 31429 - protein, 204 aa, Diabrotica virgifera
  misc_feature: Coding regions on vcDNA: vcDNA=SeqID_11126; Strand=+; Position=93-707
ALICTMLQFLKKANKSGQQKYSSNNPPHGSKEKDHPIIPHENVSDSFKANCGKTTPLPLSSFDDEGLFDIGELEATKDQSRLTRTLQETISDKNALAYFTHYMESRGACDYIHCWSEIQTFKSFLKDNQNLQTMKNFPHSPVPHSNFDHDSLSVSTDCDSYTADSNSLYDYSATTLSEGKTPQDNTCDKESDESNFSEKRRYKV

SEQ ID NO: 31430 - protein, 128 aa, Diabrotica virgifera
  misc_feature: Coding regions on vcDNA: vcDNA=SeqID_11127; Strand=+; Position=1-387
  misc_feature (87)..(94): Xaa can be any naturally occurring amino acid
HVNIQLKLVRKIKCNNMEIKQETSEKTCKMEVCAGLLDTFKIEIKEEPKTEAVYDTFVDSELNEFPLKTEVEQDEYKFSQFEEKPTXXXXXXXXNRSQRRRKYGAKRYNKQADRCRKKDKIRSFHNNR

SEQ ID NO: 31431 - protein, 47 aa, Diabrotica virgifera
  misc_feature: Coding regions on vcDNA: vcDNA=SeqID_11128; Strand=-; Position=69-212
QFLDLLRIGEGCFFIKFCKIYGCKKITRVMPPWNTLFVENEYFSLSI

SEQ ID NO: 31432 - protein, 198 aa, Diabrotica virgifera
  misc_feature: Coding regions on vcDNA: vcDNA=SeqID_11129; Strand=+; Position=143-739
  misc_feature: Homolog annotation: Hit_ID=AAM44044.1; Match level="QueryCoverage =91%, HitCoverage=78%, E-value=3e-22, Identity=33%"; Hit description =ferritin 2 [Apriona germari]
  misc_feature: Pfam annotation: Pfam_ID=Ferritin; Match level="Score=-21.9, E-value =0.045, Copies=1"; Pfam description=Ferritin-like domain
  misc_feature (55)..(55): Xaa can be any naturally occurring amino acid
  misc_feature (106)..(106): Xaa can be any naturally occurring amino acid
DTAGDPTAAKYDDKFNCTAIFAAIYALESDLHNLIIQHFIKSFQYLLLATYFATXERNRTRFQELFHGLCDDKSDESIEFITHVTSLDVHVIFNDISRDNEGEQAXDRSFDLGVVTAIDIDLNIDNKFDPEPHSIHREATKNHKQVHDPDISNYLENEDVHHDRDLIRNITDYSTDLTGLHNASDLSLALDMLDDYLL

SEQ ID NO: 31433 - protein, 176 aa, Diabrotica virgifera
  misc_feature: Coding regions on vcDNA: vcDNA=SeqID_11130; Strand=+; Position=596 -1123
  misc_feature (14)..(30): Xaa can be any naturally occurring amino acid
  misc_feature (32)..(85): Xaa can be any naturally occurring amino acid
  misc_feature (88)..(125): Xaa can be any naturally occurring amino acid
  misc_feature (128)..(150): Xaa can be any naturally occurring amino acid
  misc_feature (153)..(169): Xaa can be any naturally occurring amino acid
TGEKKCCRIPLLNXXXXXXXXXXXXXXXXXYXXXXXXXXXXXXXXXXXXXXXXXXXXXXXXXXXXXXXXXXXXXXXXXXXXXXXXSSXXXXXXXXXXXXXXXXXXXXXXXXXXXXXXXXXXXXXXFSXXXXXXXXXXXXXXXXXXXXXXXLFXXXXXXXXXXXXXXXXXPLGNPQG

SEQ ID NO: 31434 - protein, 233 aa, Diabrotica virgifera
  misc_feature: Coding regions on vcDNA: vcDNA=SeqID_11131; Strand=+; Position=131-833
  misc_feature: Homolog annotation: Hit_ID=NP_777225.1; Match level="QueryCoverage =89%, HitCoverage=37%, E-value=2e-27, Identity=34%"; Hit description =p97 protein [Bos taurus] dbj|BAA20065.1| bucentaur [Bos taurus]
  misc_feature: Pfam annotation: Pfam_ID=Exo_endo_phos; Match level="Score=31.5, E -value=2.5e-06, Copies=1"; Pfam description =Endonuclease/Exonuclease/phosphatase f
  misc_feature (149)..(149): Xaa can be any naturally occurring amino acid
  misc_feature (198)..(198): Xaa can be any naturally occurring amino acid
RSDSRHLGSGSDGVKFATGCQGVRDQAPGRNCETESKFSFNLRKCQRIGTWNVQGLIQNPGKLHIIEKEMADHNLSVLGLSETHWRGKEHFKTTAGNVVYFSGPDNKSTNEVAIIVPSKLNDCVIGYNTIDGRISLKMRISTNTLHLVXVYAPTTAAQEEDINRFYGRLEETVRAIPKRELIIIFGDFNAKVGSSNEXIEGVLGKNGLGQRNENGDVLVGGLCRTHPVDHIID

SEQ ID NO: 31435 - protein, 61 aa, Diabrotica virgifera
  misc_feature: Coding regions on vcDNA: vcDNA=SeqID_11132; Strand=+; Position=4-189
  misc_feature (2)..(14): Xaa can be any naturally occurring amino acid
  misc_feature (21)..(33): Xaa can be any naturally occurring amino acid
  misc_feature (36)..(43): Xaa can be any naturally occurring amino acid
  misc_feature (61)..(61): Xaa can be any naturally occurring amino acid
QXXXXXXXXXXXXXATSMLDXXXXXXXXXXXXXCSXXXXXXXXSLNRCEPGWFLSLFINIX

SEQ ID NO: 31436 - protein, 75 aa, Diabrotica virgifera
  misc_feature: Coding regions on vcDNA: vcDNA=SeqID_11133; Strand=-; Position=232-459
  misc_feature (27)..(35): Xaa can be any naturally occurring amino acid
  misc_feature (55)..(61): Xaa can be any naturally occurring amino acid
LVRSYIKNQICSVPLALSQVGVYTEPXXXXXXXXXKYPHRWIEAQIRSQICYFKXXXXXXXFRVIRYLRLVYSIA

SEQ ID NO: 31437 - protein, 252 aa, Diabrotica virgifera
  misc_feature: Coding regions on vcDNA: vcDNA=SeqID_11134; Strand=+; Position=3-761
  misc_feature: Homolog annotation: Hit_ID=NP_729053.2; Match level="QueryCoverage =99%, HitCoverage=58%, E-value=1e-66, Identity=43%"; Hit description =CG10671-PB, isoform B [Drosophila melanogaster] gb|AAN12239.2| CG10671-PB, isoform B [Drosophila
  misc_feature: Gene Ontology Annotation: Biological process=positive regulation of growth rate
  misc_feature (190)..(196): Xaa can be any naturally occurring amino acid
FLILTSVVYCCGNKQKILKQHFPRILIATFFWWLWTTVFNVIEASLGRCATPGFNSKVVCLHEGHVWNGFDLSGHSFILIYGSLLLIEETRCIVNWDTIKDYIRLEEHQRLARDANEKPNPLRNLSDLELKEMKTNYEKFTPYIRLLFIVIAVIQILWDIMLISTMLYYHIMIEKFLGGVVAIVTWFFTXXXXXXXPSLLPRLPGEGKFKYMKKQSAQTPPESLTTDQVPRFMGRPIYTNLRPESATASVSR

SEQ ID NO: 31438 - protein, 58 aa, Diabrotica virgifera
  misc_feature: Coding regions on vcDNA: vcDNA=SeqID_11135; Strand=+; Position=463-636
LVLPSIIRRTRENYYQVSRITPLALNGNHTIIKLGSYVKFERNATTNIGYVRRNKRNT

SEQ ID NO: 31439 - protein, 189 aa, Diabrotica virgifera
  misc_feature: Coding regions on vcDNA: vcDNA=SeqID_11136; Strand=+; Position=3-572
  misc_feature: Homolog annotation: Hit_ID=XP_320377.1; Match level="QueryCoverage =90%, HitCoverage=72%, E-value=9e-58, Identity=49%"; Hit description =ENSANGP00000009155 [Anopheles gambiae]
  misc_feature: Gene Ontology Annotation: Molecular function=ATP-binding cassette (ABC) transporter activity; Cellular component=integral to membrane; Biological process=transport
KLCVGMALCGNSKVVMLDEPTAGMDPSARRVLWELLQKQKEGRTILLSTHFMDEADLLGDRIAIMAGGELQCCGSSFFLKKKYGAGYSLIMDKAKTCNPHKVTELLKKFIPEIEIHSNVGSELTYLLSENNAPVFEAMLKQIEQESNELGIRSYGISLTTMEEVFMKVGADHGQEEIYNEKQKKYTHFC

SEQ ID NO: 31440 - protein, 57 aa, Diabrotica virgifera
  misc_feature: Coding regions on vcDNA: vcDNA=SeqID_11137; Strand=-; Position=2-172
  misc_feature (13)..(13): Xaa can be any naturally occurring amino acid
  misc_feature (17)..(17): Xaa can be any naturally occurring amino acid
  misc_feature (23)..(30): Xaa can be any naturally occurring amino acid
  misc_feature (32)..(32): Xaa can be any naturally occurring amino acid
  misc_feature (35)..(57): Xaa can be any naturally occurring amino acid
KNYGCYSLRGNLXLILXKKFGIXXXXXXXXNXYKXXXXXXXXXXXXXXXXXXXXXXX

SEQ ID NO: 31441 - protein, 106 aa, Diabrotica virgifera
  misc_feature: Coding regions on vcDNA: vcDNA=SeqID_11138; Strand=+; Position=22-342
AKDTYTDLRTFLLFKEIWTPFEKSSNSHIEYLLDIFRTYGNQFRDIHLRFLIGSNWAIIYHPMASMPFLFLYSKTYFVCIRHLINNSPKKVTEIKIGTFYNVYLNL

SEQ ID NO: 31442 - protein, 268 aa, Diabrotica virgifera
  misc_feature: Coding regions on vcDNA: vcDNA=SeqID_11139; Strand=+; Position=40-843
  misc_feature: Homolog annotation: Hit_ID=XP_308535.1; Match level="QueryCoverage =97%, HitCoverage=54%, E-value=7e-91, Identity=56%"; Hit description =ENSANGP00000015968 [Anopheles gambiae]
  misc_feature: Gene Ontology Annotation: Molecular function=alpha-L-fucosidase activity; Cellular component=cellular_component unknown; Biological process=fucose metabolism
  misc_feature: Pfam annotation: Pfam_ID=Alpha_L_fucos; Match level="Score=226.9, E -value=3.9e-65, Copies=1"; Pfam description=Alpha-L-fucosidase
  misc_feature (125)..(130): Xaa can be any naturally occurring amino acid
  misc_feature (232)..(232): Xaa can be any naturally occurring amino acid
  misc_feature (244)..(244): Xaa can be any naturally occurring amino acid
  misc_feature (254)..(254): Xaa can be any naturally occurring amino acid
  misc_feature (265)..(265): Xaa can be any naturally occurring amino acid
MVIQKLLVGLFALFCLCQAKYQPTAKYQPTWESIDSRPLPSWYDEDKIGIFLHWGVFSVPSVKSEWFWADWKAGDSEVVNYLKNYYSPNWKYQNFAKDFTAEFYDPNEWAEIFANSGAKYIVLTXXXXXXYCLWPSKYSYSWNAQDVGPGRDILGELATAVRAKNLKFGLYHSYYEWFNQLYLADKANGYKTQDFVDRKTDPELRELVNTYKPSVIWSDGDWDAPDTYWKSXEFLAWLYNESPXQDEVVVNDRXGSGIPCTHGGXFSC

SEQ ID NO: 31443 - protein, 66 aa, Diabrotica virgifera; identical to SEQ ID NO: 26808
  misc_feature: Coding regions on vcDNA: vcDNA=SeqID_11140; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 31444 - protein, 63 aa, Diabrotica virgifera
  misc_feature: Coding regions on vcDNA: vcDNA=SeqID_11141; Strand=-; Position=185-376
  misc_feature (8)..(22): Xaa can be any naturally occurring amino acid
KYSMFIMXXXXXXXXXXXXXXXLFLKQLDYIEEQISYQYCKRNENSCLTMKRHSTHMMLISKS

SEQ ID NO: 31445 - protein, 66 aa, Diabrotica virgifera
  misc_feature: Coding regions on vcDNA: vcDNA=SeqID_11142; Strand=-; Position=527-727
RDFTPGSMPTIKYRFGPSLRAVNHKILREITLFHVTLTPVFSFYLIPITYFIFLVACRSTFRWTPA

SEQ ID NO: 31446 - protein, 72 aa, Diabrotica virgifera
  misc_feature: Coding regions on vcDNA: vcDNA=SeqID_11143; Strand=-; Position=2-217
SFPYISLSVWYEYSHLVFLAFFCNYGVMISRSCGCIWLFMNLPSVTQKGTLFSQSFSHLIFLIAATHTRLLL

SEQ ID NO: 31447 - protein, 105 aa, Diabrotica virgifera
  misc_feature: Coding regions on vcDNA: vcDNA=SeqID_11144; Strand=+; Position=2-319
  misc_feature (2)..(51): Xaa can be any naturally occurring amino acid
  misc_feature (55)..(62): Xaa can be any naturally occurring amino acid
  misc_feature (74)..(92): Xaa can be any naturally occurring amino acid
  misc_feature (96)..(102): Xaa can be any naturally occurring amino acid
SXXXXXXXXXXXXXXXXXXXXXXXXXXXXXXXXXXXXXXXXXXXXXXXXXXRKKXXXXXXXXRRPYRSFIKIIXXXXXXXXXXXXXXXXXXXLGAXXXXXXXLFL

SEQ ID NO: 31448 - protein, 71 aa, Diabrotica virgifera
  misc_feature: Coding regions on vcDNA: vcDNA=SeqID_11145; Strand=-; Position=184-399
  misc_feature (63)..(69): Xaa can be any naturally occurring amino acid
TLANLHNGWIVSGKTVTYVDWVGCVVTIISVERRDTSDREHKHSRSVRLGCLQLLSLVENSNXXXXXXXQP

SEQ ID NO: 31449 - protein, 179 aa, Diabrotica virgifera
  misc_feature: Coding regions on vcDNA: vcDNA=SeqID_11146; Strand=+; Position=206-745
  misc_feature (161)..(161): Xaa can be any naturally occurring amino acid
NNMEVEDIMCDQSILHPEVNVQFDSKSPYPVIPASKLWIFIDLVARSIVPPISTICYTVFKNPQVVIQNVRYQIFPAVVAFLVNNISGSLASVQNITLPVTLRITRGPDGRDRAVISDTNEDTDSETPEKSVDCLVLFEPEDIDIDVIFLHGLHGAINKTXETRSLENKLPQAQQTIAL

SEQ ID NO: 31450 - protein, 39 aa, Diabrotica virgifera
  misc_feature: Coding regions on vcDNA: vcDNA=SeqID_11147; Strand=+; Position=2-121
ITIRNFPILKHAIIDICLALWLLGYKFLISTYNRTVYIL

SEQ ID NO: 31451 - protein, 58 aa, Diabrotica virgifera
  misc_feature: Coding regions on vcDNA: vcDNA=SeqID_11148; Strand=-; Position=2-175
ICNNQLRIHYQFYTNLSNRASVNLHMHHFHWRPTLLSLKQYHNCRTTKEQRHLQIQGH

SEQ ID NO: 31452 - protein, 46 aa, Diabrotica virgifera
  misc_feature: Coding regions on vcDNA: vcDNA=SeqID_11149; Strand=-; Position=375-515
HLLAPSHLPSLYNRYNYTKNISDTKFLERSNLRRRCQQRRYPSHKT

SEQ ID NO: 31453 - protein, 130 aa, Diabrotica virgifera
  misc_feature: Coding regions on vcDNA: vcDNA=SeqID_11150; Strand=+; Position=1-393
  misc_feature (1)..(55): Xaa can be any naturally occurring amino acid
  misc_feature (57)..(90): Xaa can be any naturally occurring amino acid
  misc_feature (96)..(110): Xaa can be any naturally occurring amino acid
XXXXXXXXXXXXXXXXXXXXXXXXXXXXXXXXXXXXXXXXXXXXXXXXXXXXXXXGXXXXXXXXXXXXXXXXXXXXXXXXXXXXXXXXXXLREKPXXXXXXXXXXXXXXXHPPRGELKFIKLGGNTQYLI

SEQ ID NO: 31454 - protein, 112 aa, Diabrotica virgifera
  misc_feature: Coding regions on vcDNA: vcDNA=SeqID_11151; Strand=+; Position=2-340
  misc_feature (1)..(17): Xaa can be any naturally occurring amino acid
  misc_feature (19)..(28): Xaa can be any naturally occurring amino acid
  misc_feature (83)..(91): Xaa can be any naturally occurring amino acid
  misc_feature (94)..(102): Xaa can be any naturally occurring amino acid
XXXXXXXXXXXXXXXXXVXXXXXXXXXXLGKRGNFFEKFNPKIKIATPAGVLNFLYGGGAPVIFKTFSPFLKNFLSLSRLNPXXXXXXXXXSFXXXXXXXXXFVFLAKEGPP

SEQ ID NO: 31455 - protein, 130 aa, Diabrotica virgifera
  misc_feature: Coding regions on vcDNA: vcDNA=SeqID_11152; Strand=-; Position=3-395
  misc_feature (9)..(28): Xaa can be any naturally occurring amino acid
  misc_feature (45)..(50): Xaa can be any naturally occurring amino acid
  misc_feature (53)..(83): Xaa can be any naturally occurring amino acid
  misc_feature (92)..(101): Xaa can be any naturally occurring amino acid
  misc_feature (114)..(125): Xaa can be any naturally occurring amino acid
ILYINILLXXXXXXXXXXXXXXXXXXXXICKLLHSYCLFKNSIVXXXXXXVHXXXXXXXXXXXXXXXXXXXXXXXXXXXXXXXYVYSRYYYXXXXXXXXXXYLTITIIIFNLYXXXXXXXXXXXXLIHNP

SEQ ID NO: 31456 - protein, 123 aa, Diabrotica virgifera
  misc_feature: Coding regions on vcDNA: vcDNA=SeqID_11153; Strand=+; Position=39-410
  misc_feature (116)..(122): Xaa can be any naturally occurring amino acid
EIINILKSVISDFLRRDLKCDFPYFVPENYKVFSDRQEFLRYAEACELRQTLETTKNHETLQEIGKKVHETLKTLKRTNDEMYFNAPHLKRFTAESVYCGILTSICETLKTKYADXXXXXXXI

SEQ ID NO: 31457 - protein, 258 aa, Diabrotica virgifera
  misc_feature: Coding regions on vcDNA: vcDNA=SeqID_11154; Strand=+; Position=1-777
  misc_feature: Homolog annotation: Hit_ID=XP_391957.1; Match level="QueryCoverage =84%, HitCoverage=20%, E-value=1e-09, Identity=26%"; Hit description =similar to CG6621-PA [Apis mellifera]
EPSKPPENEYENKLRAFLDQTKGDSDYEDKLRKFLEETKWKKGKGEESIKRKQSFDLSELDDHKKLRDAIKKELSKEKKSKRHSLASEDDEYILQKSGYSKNIKERSASPPKRIIDSPSPTREQKARQAVAEATASAGAQKWKMQIAGSSGNSRFKKKPERAPPASDWQSDRDKRERERERDRERERERERAKSSSASDDSPPPKKMSLPPLPPAEKAVSVRKAMALKEPPLKSLSLQKVKTDSSSTLAENTAGTSCA

SEQ ID NO: 31458 - protein, 158 aa, Diabrotica virgifera
  misc_feature: Coding regions on vcDNA: vcDNA=SeqID_11155; Strand=+; Position=1-477
  misc_feature: Homolog annotation: Hit_ID=XP_311433.1; Match level="QueryCoverage =100%, HitCoverage=29%, E-value=1e-55, Identity=62%"; Hit description= ENSANGP00000018445 [Anopheles gambiae]
  misc_feature: Gene Ontology Annotation: Biological process=intracellular protein transport
  misc_feature: Pfam annotation: Pfam_ID=Adap_comp_sub; Match level="Score=23.7, E -value=6.9e-07, Copies=1"; Pfam description=Adaptor complexes medium subunit famil
LNTDVGVLKWRLQSTEEALIPLLINCWPSEAGDGSCDVNIEYELAHTNLELVDVNIVIPLPIGCSPIVGECDGMYTHEAKRNQLVWNLPLIDASNKTGSLEFNAPRAIPADFFPLSVGFNSKSSYASIKITEVVLVDDDSPIKYSVETALYPDKYEVV

SEQ ID NO: 31459 - protein, 54 aa, Diabrotica virgifera
  misc_feature: Coding regions on vcDNA: vcDNA=SeqID_11156; Strand=-; Position=118-282
NASLQVSSHLTFFLLTYREGLSIRNYSIIQQLLKGGFIAIRLCCVTACFSLSRR

SEQ ID NO: 31460 - protein, 66 aa, Diabrotica virgifera
  misc_feature: Coding regions on vcDNA: vcDNA=SeqID_11157; Strand=-; Position=2-199
  misc_feature (2)..(12): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
FXXXXXXXXXXXNQPGAHTGLNXXXXXXXXSNXXXXXXXXXXXXXXPTSRSXXXXXXXXXXXXXXV

SEQ ID NO: 31461 - protein, 285 aa, Diabrotica virgifera
  misc_feature: Coding regions on vcDNA: vcDNA=SeqID_11158; Strand=+; Position=113-967
  misc_feature: Homolog annotation: Hit_ID=NP_476982.1; Match level="QueryCoverage =100%, HitCoverage=93%, E-value=4e-84, Identity=77%"; Hit description= CG3959-PA [Drosophila melanogaster] gb|AAF52799.1| CG3959-PA [Drosophila melanogaster]
  misc_feature: Gene Ontology Annotation: Molecular function=molecular_function unknown; Cellular component=cellular_component unknown; Biological process=protein biosynthesis
  misc_feature: Pfam annotation: Pfam_ID=eRF1_3; Match level="Score=128.3, E-value =1.8e-35, Copies=1"; Pfam description=eRF1 domain 3
  misc_feature (268)..(268): Xaa can be any naturally occurring amino acid
MKLISQDVDKNGEGTVALIPEEPEDMWHAYNLISEGDSVKSTTIRKVQSESSTGSSTSSRVRTTLTISVENIDFDTQACMLRLKGRNIEENQYVKGLAKFYDTVMQAILRDINFDIVKCILVASPGFVKDQFYEYMFQTAVKTDNKILLENKSKFMLIHSSSGFKHSLQEILQDPSVINKISDTKAAGEVKILENFYTMLQCEPAKAFYGKKHVEKANSEQAIETLLISDNLFRCQNVKLRKEYVNLVDSVRESGGDVKIFSSLHISXEQLEQLTGVAAILRFPM

SEQ ID NO: 31462 - protein, 107 aa, Diabrotica virgifera
  misc_feature: Coding regions on vcDNA: vcDNA=SeqID_11159; Strand=+; Position=18-341
  misc_feature (17)..(44): Xaa can be any naturally occurring amino acid
ITNTVFRTSKPKTFIDXXXXXXXXXXXXXXXXXXXXXXXXXXXXESNNYITITFHFIAYNVDPFLWLSSVIDISYGQSSGRTRYVNALPFSLLKNTSTFTPKLQIAP

SEQ ID NO: 31463 - protein, 64 aa, Diabrotica virgifera
  misc_feature: Coding regions on vcDNA: vcDNA=SeqID_11160; Strand=+; Position=393-587
  misc_feature (56)..(63): Xaa can be any naturally occurring amino acid
NLILNSELGLPLFIFKNRLLFTLLYYYFYPSYIFYYNIIVNYFNLEDVIRLTSFSXXXXXXXXA

SEQ ID NO: 31464 - protein, 56 aa, Diabrotica virgifera
  misc_feature: Coding regions on vcDNA: vcDNA=SeqID_11161; Strand=-; Position=1-168
  misc_feature (5)..(12): Xaa can be any naturally occurring amino acid
  misc_feature (25)..(30): Xaa can be any naturally occurring amino acid
LKPSXXXXXXXXGNQTLKKLVGNPXXXXXXPTLGGPHFYFSIWTSPKKNYAVIPLG

SEQ ID NO: 31465 - protein, 301 aa, Diabrotica virgifera
  misc_feature: Coding regions on vcDNA: vcDNA=SeqID_11162; Strand=+; Position=3-903
  misc_feature: Homolog annotation: Hit_ID=XP_308573.1; Match level="QueryCoverage =100%, HitCoverage=23%, E-value=1e-160, Identity=95%"; Hit description=ENSANGP00000015955 [Anopheles gambiae]
  misc_feature: Gene Ontology Annotation: Molecular function=pre-mRNA splicing factor activity; Cellular component=spliceosome complex; Biological process =RNA splicing
  misc_feature: Pfam annotation: Pfam_ID=Helicase_C; Match level="Score=52.4, E-value= 1.3e-12, Copies=1"; Pfam description=Helicase conserved C-terminal domain
  misc_feature (275)..(275): Xaa can be any naturally occurring amino acid
DLKQYSVIMLDEAHERTIHTDVLFGLLKQAVMKREELKLIVTSATLDAVKFSQYFFKAPIFTIPGRTFPVEVLYTKEPETDYLDASLITVMQIHLREPPGDILLFLTGQEEIDTACEILYERMKSLGPDVPELIILPVYSALPSEMQTRIFEPAPPGSRKVVIATNIAETSLTIDGIYYVVDPGFVKQKVYNSKTGMDSLVVTPISQAQAKQRAGRAGRTGPGKCYRLYTERAYRDEMLPTPVPEIQRTNLATTVLQLKTMGINDLLHFDFMDAXPPVESLIMALETVHSLSALDDEGVLT

SEQ ID NO: 31466 - protein, 62 aa, Diabrotica virgifera
  misc_feature: Coding regions on vcDNA: vcDNA=SeqID_11163; Strand=+; Position=3-191
  misc_feature (4)..(30): Xaa can be any naturally occurring amino acid
  misc_feature (32)..(39): Xaa can be any naturally occurring amino acid
ALPXXXXXXXXXXXXXXXXXXXXXXXXXXXRXXXXXXXXDRNQPGSHRFKLRSCKILKVEQT

SEQ ID NO: 31467 - protein, 44 aa, Diabrotica virgifera
  misc_feature: Coding regions on vcDNA: vcDNA=SeqID_11164; Strand=+; Position=83-217
  misc_feature (8)..(18): Xaa can be any naturally occurring amino acid
DCERRFYXXXXXXXXXXXEYQGLLVNRYTFIIHKYKRAKELKVL

SEQ ID NO: 31468 - protein, 56 aa, Diabrotica virgifera
  misc_feature: Coding regions on vcDNA: vcDNA=SeqID_11165; Strand=+; Position=12-182
FYSVYRILNPFLVGITLHYFMSLVNYSLKVKVGSELVSSLQMQLISVRTLKLATTV

SEQ ID NO: 31469 - protein, 74 aa, Diabrotica virgifera
  misc_feature: Coding regions on vcDNA: vcDNA=SeqID_11166; Strand=-; Position=1-222
MAQNQLIHHNYSFLIRTMTNYIPLFPIEHSHQSTRAYCNCRKYRLTITLYSIIISYTANTSRRRGGPANSAPLP

SEQ ID NO: 31470 - protein, 265 aa, Diabrotica virgifera
  misc_feature: Coding regions on vcDNA: vcDNA=SeqID_11167; Strand=-; Position=1-798
  misc_feature (2)..(11): Xaa can be any naturally occurring amino acid
  misc_feature (13)..(23): Xaa can be any naturally occurring amino acid
  misc_feature (33)..(41): Xaa can be any naturally occurring amino acid
  misc_feature (43)..(56): Xaa can be any naturally occurring amino acid
  misc_feature (63)..(75): Xaa can be any naturally occurring amino acid
  misc_feature (77)..(265): Xaa can be any naturally occurring amino acid
LXXXXXXXXXXFXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31471 - protein, 76 aa, Diabrotica virgifera
  misc_feature: Coding regions on vcDNA: vcDNA=SeqID_11168; Strand=+; Position=556-782
  misc_feature: Homolog annotation: Hit_ID=XP_394111.1; Match level="QueryCoverage =93%, HitCoverage=4%, E-value=5e-15, Identity=54%"; Hit description =similar to CG12863-PA [Apis mellifera]
  misc_feature (16)..(16): Xaa can be any naturally occurring amino acid
NKRFHNFFGPLQFCWXYTWFNNHFFFKEAKDVFMDFLQSEGGKDMVIITDPPFGGRTELISATFKSINNQYQKLTQ

SEQ ID NO: 31472 - protein, 32 aa, Diabrotica virgifera
  misc_feature: Coding regions on vcDNA: vcDNA=SeqID_11169; Strand=-; Position=0-95
  misc_feature (2)..(30): Xaa can be any naturally occurring amino acid
RXXXXXXXXXXXXXXXXXXXXXXXXXXXXXHP

SEQ ID NO: 31473 - protein, 200 aa, Diabrotica virgifera
  misc_feature: Coding regions on vcDNA: vcDNA=SeqID_11170; Strand=-; Position=2-601
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(178): Xaa can be any naturally occurring amino acid
  misc_feature (183)..(200): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVQINXXXXXXXXXXXXXXXXXX

SEQ ID NO: 31474 - protein, 41 aa, Diabrotica virgifera
  misc_feature: Coding regions on vcDNA: vcDNA=SeqID_11171; Strand=-; Position=3-125
  misc_feature (16)..(26): Xaa can be any naturally occurring amino acid
IILGSINFTNLLRITXXXXXXXXXXXVVELQSVVELQEPVG

SEQ ID NO: 31475 - protein, 192 aa, Diabrotica virgifera
  misc_feature: Coding regions on vcDNA: vcDNA=SeqID_11172; Strand=-; Position=223-801
  misc_feature (31)..(37): Xaa can be any naturally occurring amino acid
  misc_feature (73)..(79): Xaa can be any naturally occurring amino acid
  misc_feature (92)..(133): Xaa can be any naturally occurring amino acid
PPPPPFKCPFKGGSPFPFRGAKFWEGGWGGXXXXXXXLGKRGIFPKGLNWGTPGFSPPPRFKNPPRELNFGAXXXXXXXPTPRFLNLVPLKXXXXXXXXXXXXXXXXXXXXXXXXXXXXXXXXXXXXXXXXXXIYVFPMKYPIHMPKYQQKMIGLDFTISTHIKKCCLQFKNNNRDQENVSKKFRLLKVNVS

SEQ ID NO: 31476 - protein, 233 aa, Diabrotica virgifera
  misc_feature: Coding regions on vcDNA: vcDNA=SeqID_11173; Strand=+; Position=177-875
MSQLPKQGTEERRDHFQVTNNGNVTIDAEVTHVERILHLGPRHLVTLLPGQSHTFDLSGTHFNMAVLKVRNHEDGEALFSAEGGNVLEDMEKNIQKLPPSEQVRHKVENVRLPGRSSMLVMRQPTRNGEEQRHDQFFVTNKGNVKIDAEVTHIERMVHLGPSHLVTILPGQSHTFDLSDLHYRNTLLKVINHEDGEAVFSAEGGDVLKPLKRLYRNSKMKLRYHKKLKTSIFP

SEQ ID NO: 31477 - protein, 276 aa, Diabrotica virgifera
  misc_feature: Coding regions on vcDNA: vcDNA=SeqID_11174; Strand=+; Position=53-882
  misc_feature: Homolog annotation: Hit_ID=EAL31656.1; Match level="QueryCoverage =98%, HitCoverage=71%, E-value=1e-92, Identity=60%"; Hit description =GA10780-PA [Drosophila pseudoobscura]
  misc_feature: Gene Ontology Annotation: Molecular function=RNA-3'-phosphate cyclase activity; Cellular component=nucleolus; Biological process=35S primary transcript processing
  misc_feature: Pfam annotation: Pfam_ID=RTC; Match level="Score=213.8, E-value=3.3e -61, Copies=1"; Pfam description=RNA 3'-terminal phosphate cyclase
  misc_feature (245)..(245): Xaa can be any naturally occurring amino acid
MPIKKGNTLLYKGSNYLRQRLILSVLSGKPVQISEIRIQEDEPGLREFEVSLIRLLDKVTNGTVIELNETGTSLYFQPGLLYGGEIEHDCCTDRAIGYYLEALVIFGIFCKQPVKAKLKGVTANNIDPSVDLIKTSMIQTLKRFVLDDDDLDLKISKRGSRPLGGGEVTFRCPVRKQTRPVQLLKNGMVKRIRGTAYALRVSPAIANRMVDKAKGVLLNFIPDVYINTDQCRGKQSGNSPGFGYXLVAETTEGVHYSAEQVSNVVANNEDPSVPKD

SEQ ID NO: 31478 - protein, 266 aa, Diabrotica virgifera
  misc_feature: Coding regions on vcDNA: vcDNA=SeqID_11175; Strand=+; Position=161-957
  misc_feature: Homolog annotation: Hit_ID=NP_579857.1; Match level="QueryCoverage =86%, HitCoverage=71%, E-value=2e-45, Identity=39%"; Hit description =zinc finger protein 111 [Rattus norvegicus] gb|AAB60512.1| Cys2/His2 zinc finger protein
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=111.6, E-value =2e-30, Copies=6"; Pfam description=Zinc finger, C2H2 type
  misc_feature (115)..(121): Xaa can be any naturally occurring amino acid
  misc_feature (143)..(158): Xaa can be any naturally occurring amino acid
  misc_feature (245)..(245): Xaa can be any naturally occurring amino acid
MELSAKVKEEIAESDQGYTEHQVFTSEPEEDEGFSQNRMEIMKKLACSTEQQISANSGETTTNSISKCIICCKQFKHEWYLKRHMRIHTGEKPYQCETCFKQFIQANGLKTHLRXXXXXXXFQCELCFKQFFQKSNLKAHLAXXXXXXXXXXXXXXXXFFQKSNLKSHLRAHTGEKPHKCEICFKQFSRVNVLKIHLRVHTGEKPHKCEICLKQFTRAHDLKIHLRVHTGKKPYKCENCFSHTVXKTTLKTHLKTHTPEKTRTVSN

SEQ ID NO: 31479 - protein, 206 aa, Diabrotica virgifera
  misc_feature: Coding regions on vcDNA: vcDNA=SeqID_11176; Strand=+; Position=1-618
  misc_feature: Homolog annotation: Hit_ID=AAL05409.1; Match level="QueryCoverage =91%, HitCoverage=93%, E-value=2e-22, Identity=33%"; Hit description =peritrophin [Aedes aegypti]
  misc_feature: Pfam annotation: Pfam_ID=CBM_14; Match level="Score=141.5, E-value=2e- 39, Copies=2"; Pfam description=Chitin binding Peritrophin-A domain
FRPATQSTPSQVPTESTAAPGPYTTPDLICTDENNYFPYIYDCSKYYECSNGVPVLMDCPKGEFWNIKLNNCDWPQNVDCSYVVTTSGASTVSTEAPTKAPTEAPTDVPTDAPTEGPGPYYTTPEIICKEDNTYFPYIFDCSKYYECSNGQPILMTCPAGQLWSNLLKTCDWPANVDCSYVVTTPGPDTATVENQILSINKILNPC

SEQ ID NO: 31480 - protein, 349 aa, Diabrotica virgifera
  misc_feature: Coding regions on vcDNA: vcDNA=SeqID_11177; Strand=+; Position=3-1049
  misc_feature (6)..(21): Xaa can be any naturally occurring amino acid
  misc_feature (27)..(38): Xaa can be any naturally occurring amino acid
  misc_feature (40)..(59): Xaa can be any naturally occurring amino acid
  misc_feature (66)..(120): Xaa can be any naturally occurring amino acid
  misc_feature (128)..(158): Xaa can be any naturally occurring amino acid
  misc_feature (169)..(186): Xaa can be any naturally occurring amino acid
  misc_feature (198)..(206): Xaa can be any naturally occurring amino acid
  misc_feature (208)..(215): Xaa can be any naturally occurring amino acid
  misc_feature (218)..(242): Xaa can be any naturally occurring amino acid
  misc_feature (250)..(258): Xaa can be any naturally occurring amino acid
  misc_feature (267)..(275): Xaa can be any naturally occurring amino acid
  misc_feature (284)..(348): Xaa can be any naturally occurring amino acid
KLVFVXXXXXXXXXXXXXXXXPWGSRXXXXXXXXXXXXIXXXXXXXXXXXXXXXXXXXXKDPFKIXXXXXXXXXXXXXXXXXXXXXXXXXXXXXXXXXXXXXXXXXXXXXXXXXXXXXXXSIFKKGGXXXXXXXXXXXXXXXXXXXXXXXXXXXXXXXFGGGEGREFIXXXXXXXXXXXXXXXXXXGVCVKKGDLRRXXXXXXXXXSXXXXXXXXPFXXXXXXXXXXXXXXXXXXXXXXXXXRAARGPLXXXXXXXXXEKTHKNSFXXXXXXXXXRRKRGEEGXXXXXXXXXXXXXXXXXXXXXXXXXXXXXXXXXXXXXXXXXXXXXXXXXXXXXXXXXXXXXXXXXA

SEQ ID NO: 31481 - protein, 359 aa, Diabrotica virgifera
  misc_feature: Coding regions on vcDNA: vcDNA=SeqID_11178; Strand=-; Position=0-1076
  misc_feature (7)..(35): Xaa can be any naturally occurring amino acid
  misc_feature (40)..(46): Xaa can be any naturally occurring amino acid
  misc_feature (48)..(49): Xaa can be any naturally occurring amino acid
  misc_feature (58)..(58): Xaa can be any naturally occurring amino acid
  misc_feature (60)..(67): Xaa can be any naturally occurring amino acid
  misc_feature (70)..(82): Xaa can be any naturally occurring amino acid
  misc_feature (89)..(101): Xaa can be any naturally occurring amino acid
  misc_feature (104)..(358): Xaa can be any naturally occurring amino acid
PPWLFVXXXXXXXXXXXXXXXXXXXXXXXXXXXXXIGPFXXXXXXXIXXRNPPGSHRXNXXXXXXXXRPXXXXXXXXXXXXXIQHRGRXXXXXXXXXXXXXLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXV

SEQ ID NO: 31482 - protein, 147 aa, Diabrotica virgifera
  misc_feature: Coding regions on vcDNA: vcDNA=SeqID_11179; Strand=+; Position=323-766
  misc_feature: Homolog annotation: Hit_ID=AAF87759.1; Match level="QueryCoverage =100%, HitCoverage=38%, E-value=4e-57, Identity=71%"; Hit description= cytochrome oxidase subunit I [Diabrotica virgifera virgifera]
  misc_feature: Pfam annotation: Pfam_ID=COX1; Match level="Score=-243.8, E-value =0.0057, Copies=1"; Pfam description=Cytochrome C and Quinol oxidase polyp
  misc_feature (2)..(2): Xaa can be any naturally occurring amino acid
  misc_feature (10)..(10): Xaa can be any naturally occurring amino acid
  misc_feature (35)..(43): Xaa can be any naturally occurring amino acid
  misc_feature (70)..(70): Xaa can be any naturally occurring amino acid
LXERGVGTGXTVYPPLSSNIAHGGPSVDLAIFRLXXXXXXXXXGAINFITTVINIRPIGITFDRIPLFVXAVVITAILLLLSLPVLAGAITILLTDRNLNTSFFDPAGGGDPILHPEGFGLISHIVRFGTLGIIYAIIAIGLLGFIV

SEQ ID NO: 31483 - protein, 190 aa, Diabrotica virgifera
  misc_feature: Coding regions on vcDNA: vcDNA=SeqID_11180; Strand=+; Position=68-637
  misc_feature (10)..(158): Xaa can be any naturally occurring amino acid
  misc_feature (160)..(190): Xaa can be any naturally occurring amino acid
RKVISFLNHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXX

SEQ ID NO: 31484 - protein, 258 aa, Diabrotica virgifera
  misc_feature: Coding regions on vcDNA: vcDNA=SeqID_11181; Strand=+; Position=2-777
  misc_feature: Homolog annotation: Hit_ID=EAA08476.2; Match level="QueryCoverage =99%, HitCoverage=25%, E-value=3e-68, Identity=48%"; Hit description =ENSANGP00000014710 [Anopheles gambiae str. PEST] ref|XP_562956.1| ENSANGP00000014710 [Anopheles gambiae st
  misc_feature: Gene Ontology Annotation: Molecular function=ATP dependent RNA helicase activity; Cellular component=cytoplasm; Biological process =regulation of translation
  misc_feature: Pfam annotation: Pfam_ID=Helicase_C; Match level="Score=9.1, E-value =0.0042, Copies=1"; Pfam description=Helicase conserved C-terminal domain
  misc_feature (27)..(27): Xaa can be any naturally occurring amino acid
  misc_feature (36)..(36): Xaa can be any naturally occurring amino acid
  misc_feature (121)..(121): Xaa can be any naturally occurring amino acid
  misc_feature (134)..(134): Xaa can be any naturally occurring amino acid
RTHQRPVPLKHFLYTGKGGSTRDNRFXILNADKWIXNGFIKAKESMKVDPHKNFNQRLSPAQEKTLWSGLISHLKKNDLLPVVAFTFSRQKCDNNATNLTSLDLTTQKEKAHITLSFNRWXQLLFATETFAMGXVNMPARTVVFDSVRKHDGKELRDLEAAEYTQMAGRAGRRGLDAEGTVIILCKQTIPLEENFKKMMLGKPSSLVSQFRLTYGMVLSLLRVESISVEGMMSRSFREADHQKNMVEIRKKLEKVDEE

SEQ ID NO: 31485 - protein, 145 aa, Diabrotica virgifera
  misc_feature: Coding regions on vcDNA: vcDNA=SeqID_11182; Strand=+; Position=145-633
  misc_feature: Homolog annotation: Hit_ID=AAF87760.1; Match level="QueryCoverage =99%, HitCoverage=43%, E-value=8e-58, Identity=68%"; Hit description =cytochrome oxidase subunit I [Diabrotica virgifera zeae]
  misc_feature: Pfam annotation: Pfam_ID=COX1; Match level="Score=-197.1, E-value =0.00015, Copies=1"; Pfam description=Cytochrome C and Quinol oxidase polyp
  misc_feature (62)..(62): Xaa can be any naturally occurring amino acid
  misc_feature (97)..(97): Xaa can be any naturally occurring amino acid
LGAITILLTDRNLNTSFFDPAGGGDPILHPEGFGLISHIVRFGTLGIIYAIIAIGLLGFIVXAHHIFTVGMDVDTRAYFTSATIIIAVPTGIKVFRXLATYHGTTITYRLTGVVLANSSIDIVLHDTYYVVAIGAVFAIIAGFIQ

SEQ ID NO: 31486 - protein, 183 aa, Diabrotica virgifera
  misc_feature: Coding regions on vcDNA: vcDNA=SeqID_11183; Strand=+; Position=77-628
  misc_feature: Homolog annotation: Hit_ID=AAV91469.1; Match level="QueryCoverage =94%, HitCoverage=96%, E-value=2e-74, Identity=78%"; Hit description =ribosomal protein 31 [Lonomia obliqua]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_L22; Match level="Score=224.0, E -value=2.9e-64, Copies=1"; Pfam description=Ribosomal protein L22p/L17e
RYAREPENAAKSCKAKGSNLRVHFKNTCETANAIRKMPLKRAVAYLKNVIIQKECIPFRRFNGGVGRCAQAKQFGTTQGRWPKKSAEFLLQLLRNAESNADYSGLDVDRLVVEHIQVNRAACLRRRTYRAHGRINPYMSSPCHIELWLTEGESSQDAPKKASQKKKSTLDKVKRPKAPPAVTH

SEQ ID NO: 31487 - protein, 258 aa, Diabrotica virgifera
  misc_feature: Coding regions on vcDNA: vcDNA=SeqID_11184; Strand=-; Position=73-849
  misc_feature: Homolog annotation: Hit_ID=XP_316569.1; Match level="QueryCoverage =92%, HitCoverage=76%, E-value=2e-72, Identity=52%"; Hit description =ENSANGP00000011487 [Anopheles gambiae]
  misc_feature: Gene Ontology Annotation: Molecular function=heme transporter activity; Cellular component=mitochondrial inner membrane; Biological process=cytochrome c oxidase biogenesis
  misc_feature: Pfam annotation: Pfam_ID=SURF1; Match level="Score=147.7, E-value =2.7e-41, Copies=1"; Pfam description=SURF1 family
ANYSIQANILHVKVSRDERIGPFGWFLLIIPVSTFSLGVWQVQRKKWKEGLLDELQEKTYSQPLQLPTNLDDLSALEYKPIHVKGQFLHDKELYMGPRSVLKKGDASAKSSLVSGSAGSSQGYLVVSPLKLEGRDETILVNRGWVPSKQKDPKTRERGQVNGVVDVIGVVRTHEPRPNFTMKNIEGSNIYFYRDLDRMAEVTGASPIFLDATIDFDVPNGPIGGQTRISLRNEHMSYILTWFSLCGATSYMWIKKFIK

SEQ ID NO: 31488 - protein, 155 aa, Diabrotica virgifera
  misc_feature: Coding regions on vcDNA: vcDNA=SeqID_11185; Strand=-; Position=2-466
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(152): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXARG

SEQ ID NO: 31489 - protein, 86 aa, Diabrotica virgifera
  misc_feature: Coding regions on vcDNA: vcDNA=SeqID_11186; Strand=+; Position=349-609
  misc_feature (1)..(7): Xaa can be any naturally occurring amino acid
XXXXXXXLFSCFLGGGRGALLFIRWCPPNFTIFKMCPPSKKGCRPLSKSIVCQIGAPRWAPIIQFNHVQFNIFHLIISATELSTIN

SEQ ID NO: 31490 - protein, 113 aa, Diabrotica virgifera
  misc_feature: Coding regions on vcDNA: vcDNA=SeqID_11187; Strand=+; Position=172-513
  misc_feature (18)..(24): Xaa can be any naturally occurring amino acid
  misc_feature (104)..(109): Xaa can be any naturally occurring amino acid
VQIFMLHENKKGPFIAWXXXXXXXDLYIPVLRVISFTVFLIGRLIGRPFFGHYYLLINNCVKLNPIKTKFILSLFLNHFRNNKRTKLEYDWSLCLTNSNCKWFXXXXXXQFFP

SEQ ID NO: 31491 - protein, 78 aa, Diabrotica virgifera
  misc_feature: Coding regions on vcDNA: vcDNA=SeqID_11188; Strand=+; Position=129-365
  misc_feature (30)..(43): Xaa can be any naturally occurring amino acid
  misc_feature (63)..(70): Xaa can be any naturally occurring amino acid
YDVTTNEGAFWAGCYNLNFLLILIFFRGQXXXXXXXXXXXXXXVVIYSIFSNLLFYASSLLLXXXXXXXXRFDFQLEI

SEQ ID NO: 31492 - protein, 65 aa, Diabrotica virgifera
  misc_feature: Coding regions on vcDNA: vcDNA=SeqID_11189; Strand=+; Position=2-196
  misc_feature (19)..(28): Xaa can be any naturally occurring amino acid
  misc_feature (31)..(38): Xaa can be any naturally occurring amino acid
LACPLINLNGPRDFDRAKXXXXXXXXXXLEXXXXXXXXALLTFYTIFFFPLNNYIFFKGYKTLNT

SEQ ID NO: 31493 - protein, 381 aa, Diabrotica virgifera
  misc_feature: Coding regions on vcDNA: vcDNA=SeqID_11190; Strand=+; Position=2-1144
  misc_feature (1)..(297): Xaa can be any naturally occurring amino acid
  misc_feature (299)..(307): Xaa can be any naturally occurring amino acid
  misc_feature (331)..(336): Xaa can be any naturally occurring amino acid
  misc_feature (364)..(381): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXLRVTAEFYLGESNRIKKLGPSRLXXXXXXGVSTFFFNVGRLFKFFNVSGFKTGGGPXXXXXXXXXXXXXXXXXX

SEQ ID NO: 31494 - protein, 37 aa, Diabrotica virgifera
  misc_feature: Coding regions on vcDNA: vcDNA=SeqID_11191; Strand=-; Position=0-110
PEASSDNISFLHSYLGNHPRPGMVDFIILFGETFSHV

SEQ ID NO: 31495 - protein, 119 aa, Diabrotica virgifera
  misc_feature: Coding regions on vcDNA: vcDNA=SeqID_11192; Strand=+; Position=101-460
  misc_feature (26)..(32): Xaa can be any naturally occurring amino acid
  misc_feature (83)..(89): Xaa can be any naturally occurring amino acid
  misc_feature (110)..(115): Xaa can be any naturally occurring amino acid
TRPVQSAPSPWQLNTKLTPKTGSFHXXXXXXXNNSILTLRIVPLRIVSLRCELSPLRINLATNCPLPFLRGYELLRYEMSRHXXXXXXXPKNTTFRQNIYGFIKYSSLDXXXXXXISVH

SEQ ID NO: 31496 - protein, 77 aa, Diabrotica virgifera
  misc_feature: Coding regions on vcDNA: vcDNA=SeqID_11193; Strand=-; Position=1-231
  misc_feature (1)..(24): Xaa can be any naturally occurring amino acid
  misc_feature (26)..(77): Xaa can be any naturally occurring amino acid
XXXXXXXXXXXXXXXXXXXXXXXXYXXXXXXXXXXXXXXXXXXXXXXXXXXXXXXXXXXXXXXXXXXXXXXXXXXXX

SEQ ID NO: 31497 - protein, 45 aa, Diabrotica virgifera
  misc_feature: Coding regions on vcDNA: vcDNA=SeqID_11194; Strand=-; Position=285-422
  misc_feature (29)..(35): Xaa can be any naturally occurring amino acid
LTLKQIQQLSKVVRLGLANAESMHIKHNXXXXXXXQIYCWYVIVM

SEQ ID NO: 31498 - protein, 223 aa, Diabrotica virgifera
  misc_feature: Coding regions on vcDNA: vcDNA=SeqID_11195; Strand=-; Position=14-685
  misc_feature (7)..(22): Xaa can be any naturally occurring amino acid
  misc_feature (25)..(34): Xaa can be any naturally occurring amino acid
  misc_feature (40)..(50): Xaa can be any naturally occurring amino acid
  misc_feature (52)..(133): Xaa can be any naturally occurring amino acid
  misc_feature (139)..(152): Xaa can be any naturally occurring amino acid
  misc_feature (156)..(188): Xaa can be any naturally occurring amino acid
  misc_feature (192)..(202): Xaa can be any naturally occurring amino acid
  misc_feature (204)..(210): Xaa can be any naturally occurring amino acid
  misc_feature (216)..(222): Xaa can be any naturally occurring amino acid
LDRKSIXXXXXXXXXXXXXXXXQLXXXXXXXXXXVKKVSXXXXXXXXXXXSXXXXXXXXXXXXXXXXXXXXXXXXXXXXXXXXXXXXXXXXXXXXXXXXXXXXXXXXXXXXXXXXXXXXXXXXXXXXXXXXXXEPIYYXXXXXXXXXXXXXXVNLXXXXXXXXXXXXXXXXXXXXXXXXXXXXXXXXXIVMXXXXXXXXXXXLXXXXXXXFYFKGXXXXXXXT

SEQ ID NO: 31499 - protein, 323 aa, Diabrotica virgifera
  misc_feature: Coding regions on vcDNA: vcDNA=SeqID_11196; Strand=-; Position=192 -1163
  misc_feature (10)..(20): Xaa can be any naturally occurring amino acid
  misc_feature (22)..(27): Xaa can be any naturally occurring amino acid
  misc_feature (41)..(52): Xaa can be any naturally occurring amino acid
  misc_feature (57)..(83): Xaa can be any naturally occurring amino acid
  misc_feature (85)..(96): Xaa can be any naturally occurring amino acid
  misc_feature (103)..(117): Xaa can be any naturally occurring amino acid
  misc_feature (119)..(304): Xaa can be any naturally occurring amino acid
KKKTPAPSPXXXXXXXXXXXGXXXXXXPSTKILVFTPRGGXXXXXXXXXXXXRFTLXXXXXXXXXXXXXXXXXXXXXXXXXXXPXXXXXXXXXXXXKKLSKYXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHLITEGGHEKFHYNDNEKY

SEQ ID NO: 31500 - protein, 78 aa, Diabrotica virgifera
  misc_feature: Coding regions on vcDNA: vcDNA=SeqID_11197; Strand=-; Position=595-831
MRIKYLSSYEMSTVVRALYLFFVIEIMLPKWVTLKSHWTNIVHKFEILLHNSPPDDQTNIYLICNKFSRVTHNFKTIY

SEQ ID NO: 31501 - protein, 155 aa, Diabrotica virgifera
  misc_feature: Coding regions on vcDNA: vcDNA=SeqID_11198; Strand=+; Position=10-478
  misc_feature: Homolog annotation: Hit_ID=AAL17607.1; Match level="QueryCoverage =83%, HitCoverage=85%, E-value=7e-36, Identity=58%"; Hit description =cytochrome c oxidase subunit Va [Rhyzopertha dominica]
  misc_feature: Gene Ontology Annotation: Molecular function=cytochrome c oxidase activity; Cellular component=mitochondrion
  misc_feature: Pfam annotation: Pfam_ID=COX5A; Match level="Score=133.9, E-value =3.8e-37, Copies=1"; Pfam description=Cytochrome c oxidase subunit Va
  misc_feature (100)..(100): Xaa can be any naturally occurring amino acid
  misc_feature (115)..(115): Xaa can be any naturally occurring amino acid
MGKKVKFQSNLLTLLRNTALRAHSILRTALVAPKPNVSTMRLMSSHSTETDEQFDSRYENFFNRKDIDGWEIRRGINDLWGHDLVPEPKILIAALKACRXVNDFALVVRILYNTXDKCVSKGFEIYPYIILDLRSTLRVLGLIFSNMFSFGLDDW

SEQ ID NO: 31502 - protein, 67 aa, Diabrotica virgifera
  misc_feature: Coding regions on vcDNA: vcDNA=SeqID_11199; Strand=-; Position=1-201
  misc_feature (3)..(13): Xaa can be any naturally occurring amino acid
  misc_feature (24)..(31): Xaa can be any naturally occurring amino acid
  misc_feature (34)..(46): Xaa can be any naturally occurring amino acid
  misc_feature (53)..(65): Xaa can be any naturally occurring amino acid
LSXXXXXXXXXXXEPNLAHTGLNXXXXXXXXRTXXXXXXXXXXXXXIQHRGRXXXXXXXXXXXXXLL

SEQ ID NO: 31503 - protein, 37 aa, Diabrotica virgifera
  misc_feature: Coding regions on vcDNA: vcDNA=SeqID_11200; Strand=+; Position=110-223
  misc_feature (15)..(23): Xaa can be any naturally occurring amino acid
ILHPTASRMINNITXXXXXXXXXPIKNEISFIHQQES

SEQ ID NO: 31504 - protein, 162 aa, Diabrotica virgifera
  misc_feature: Coding regions on vcDNA: vcDNA=SeqID_11201; Strand=+; Position=47-535
  misc_feature: Homolog annotation: Hit_ID=XP_308352.1; Match level="QueryCoverage =68%, HitCoverage=73%, E-value=2e-33, Identity=53%"; Hit description =ENSANGP00000019150 [Anopheles gambiae]
MSQQLFTNIIFVLESIPLKLGSNMFYTNFTLCFIIFSAFVQLSLSLDCYQCSGSDPNKPFQCNEWLSGDIDITPEPCDNVFGAKYCIKHVGRFEGGIGTKRFCSSLDLGNYCNYVKQPGDTLTYRTCLYTCTGDGCNPAASKKPQSLLLLMTIAGIVFYRMI

SEQ ID NO: 31505 - protein, 97 aa, Diabrotica virgifera
  misc_feature: Coding regions on vcDNA: vcDNA=SeqID_11202; Strand=-; Position=1-291
  misc_feature (8)..(16): Xaa can be any naturally occurring amino acid
  misc_feature (18)..(37): Xaa can be any naturally occurring amino acid
  misc_feature (39)..(62): Xaa can be any naturally occurring amino acid
  misc_feature (66)..(97): Xaa can be any naturally occurring amino acid
NLRVFPGXXXXXXXXXGXXXXXXXXXXXXXXXXXXXXPXXXXXXXXXXXXXXXXXXXXXXXXVFAXXXXXXXXXXXXXXXXXXXXXXXXXXXXXXXX

SEQ ID NO: 31506 - protein, 202 aa, Diabrotica virgifera
  misc_feature: Coding regions on vcDNA: vcDNA=SeqID_11203; Strand=+; Position=1-606
  misc_feature (5)..(61): Xaa can be any naturally occurring amino acid
  misc_feature (67)..(87): Xaa can be any naturally occurring amino acid
  misc_feature (89)..(107): Xaa can be any naturally occurring amino acid
  misc_feature (109)..(117): Xaa can be any naturally occurring amino acid
  misc_feature (130)..(136): Xaa can be any naturally occurring amino acid
  misc_feature (161)..(166): Xaa can be any naturally occurring amino acid
  misc_feature (180)..(197): Xaa can be any naturally occurring amino acid
TRLPXXXXXXXXXXXXXXXXXXXXXXXXXXXXXXXXXXXXXXXXXXXXXXXXXXXXXXXXXENPKKXXXXXXXXXXXXXXXXXXXXXGXXXXXXXXXXXXXXXXXXXPXXXXXXXXXPRGNPGIFFGKVXXXXXXXRPPPGGLKFYNWGGTAFFYNSGSPXXXXXXVLGVLKPGGGAPGXXXXXXXXXXXXXXXXXXWGARP

SEQ ID NO: 31507 - protein, 196 aa, Diabrotica virgifera
  misc_feature: Coding regions on vcDNA: vcDNA=SeqID_11204; Strand=-; Position=593 -1183
  misc_feature (21)..(38): Xaa can be any naturally occurring amino acid
  misc_feature (56)..(70): Xaa can be any naturally occurring amino acid
  misc_feature (80)..(100): Xaa can be any naturally occurring amino acid
  misc_feature (108)..(116): Xaa can be any naturally occurring amino acid
  misc_feature (131)..(137): Xaa can be any naturally occurring amino acid
  misc_feature (162)..(170): Xaa can be any naturally occurring amino acid
LPGWCCVLHASHEQPTTVRGXXXXXXXXXXXXXXXXXXSPSCVFCEFFGTAPRGKXXXXXXXXXXXXXXXIGGLGGCVYXXXXXXXXXXXXXXXXXXXXXFFLQKKKXXXXXXXXXPSSSFVGVFVGGGRXXXXXXXLFPVLFLGWFFIGSYKRFFPAWPFXXXXXXXXXGGFFLSLYPFPQLFPYGAVSCGESTN

SEQ ID NO: 31508 - protein, 109 aa, Diabrotica virgifera
  misc_feature: Coding regions on vcDNA: vcDNA=SeqID_11205; Strand=-; Position=17-346
  misc_feature (20)..(26): Xaa can be any naturally occurring amino acid
YMVYSQLQENFSSWIFNNKXXXXXXXLHRRLYYCVNDSANIIFQIYVKIILILSNNSTICYATSYPYNMKLIKLDVVDVFNLQSGYRCYCYINIKLLSITPSVSSVSNY

SEQ ID NO: 31509 - protein, 323 aa, Diabrotica virgifera
  misc_feature: Coding regions on vcDNA: vcDNA=SeqID_11206; Strand=-; Position=1-969
  misc_feature (2)..(8): Xaa can be any naturally occurring amino acid
  misc_feature (27)..(33): Xaa can be any naturally occurring amino acid
  misc_feature (36)..(42): Xaa can be any naturally occurring amino acid
  misc_feature (48)..(100): Xaa can be any naturally occurring amino acid
  misc_feature (106)..(323): Xaa can be any naturally occurring amino acid
EXXXXXXXSSLPPQIIKLLNPTRGGSXXXXXXXLNXXXXXXXLFSPKXXXXXXXXXXXXXXXXXXXXXXXXXXXXXXXXXXXXXXXXXXXXXXXXXXXXXLYRVFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31510 - protein, 280 aa, Diabrotica virgifera
  misc_feature: Coding regions on vcDNA: vcDNA=SeqID_11207; Strand=+; Position=46-888
  misc_feature (8)..(218): Xaa can be any naturally occurring amino acid
YQIAALQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYVIERGFVSHIPQKQERLQTLRGVSRKAGVHREHRKMGMVGVASEFTKKAKQNLNFLQPHFP

SEQ ID NO: 31511 - protein, 69 aa, Diabrotica virgifera
  misc_feature: Coding regions on vcDNA: vcDNA=SeqID_11208; Strand=+; Position=235-441
CTFGQLLLSIKYEDIGTFQRVLYLLGHCLDYVKTRFEIWKPSHDLNNTFYKIYLFTKLLHFIILIHIFT

SEQ ID NO: 31512 - protein, 122 aa, Diabrotica virgifera
  misc_feature: Coding regions on vcDNA: vcDNA=SeqID_11209; Strand=-; Position=1-366
  misc_feature (5)..(11): Xaa can be any naturally occurring amino acid
  misc_feature (16)..(24): Xaa can be any naturally occurring amino acid
  misc_feature (27)..(32): Xaa can be any naturally occurring amino acid
  misc_feature (43)..(52): Xaa can be any naturally occurring amino acid
  misc_feature (66)..(93): Xaa can be any naturally occurring amino acid
  misc_feature (95)..(119): Xaa can be any naturally occurring amino acid
PPAPXXXXXXXLKPQXXXXXXXXXWTXXXXXXASPPKLKLLTXXXXXXXXXXIGPHKKIPLVSLGXXXXXXXXXXXXXXXXXXXXXXXXXXXXPXXXXXXXXXXXXXXXXXXXXXXXXXLLV

SEQ ID NO: 31513 - protein, 102 aa, Diabrotica virgifera
  misc_feature: Coding regions on vcDNA: vcDNA=SeqID_11210; Strand=-; Position=0-305
  misc_feature (25)..(31): Xaa can be any naturally occurring amino acid
  misc_feature (54)..(73): Xaa can be any naturally occurring amino acid
  misc_feature (75)..(101): Xaa can be any naturally occurring amino acid
REPRFKKIIGGPPQLKIFKPRRGGXXXXXXXELFQKNSGGFPRGIFFYKPKKWXXXXXXXXXXXXXXXXXXXXTXXXXXXXXXXXXXXXXXXXXXXXXXXXS

SEQ ID NO: 31514 - protein, 142 aa, Diabrotica virgifera
  misc_feature: Coding regions on vcDNA: vcDNA=SeqID_11211; Strand=+; Position=281-706
  misc_feature (3)..(27): Xaa can be any naturally occurring amino acid
  misc_feature (34)..(50): Xaa can be any naturally occurring amino acid
  misc_feature (54)..(87): Xaa can be any naturally occurring amino acid
  misc_feature (92)..(103): Xaa can be any naturally occurring amino acid
YLXXXXXXXXXXXXXXXXXXXXXXXXXDIIKNNXXXXXXXXXXXXXXXXXVKYXXXXXXXXXXXXXXXXXXXXXXXXXXXXXXXXXXVDNMXXXXXXXXXXXXCLIIDFTCILFTCLLESCIYALLTTAHLPCAQYDCPANV

SEQ ID NO: 31515 - protein, 200 aa, Diabrotica virgifera
  misc_feature: Coding regions on vcDNA: vcDNA=SeqID_11212; Strand=-; Position=2-601
  misc_feature (45)..(51): Xaa can be any naturally occurring amino acid
  misc_feature (66)..(93): Xaa can be any naturally occurring amino acid
  misc_feature (96)..(117): Xaa can be any naturally occurring amino acid
  misc_feature (125)..(145): Xaa can be any naturally occurring amino acid
  misc_feature (154)..(200): Xaa can be any naturally occurring amino acid
TPPRAAPPGFKPRIYEKIFRKRETKYIKYGLPPPIFNLLTPAWGXXXXXXXFGPSQKNSAFFPFGXXXXXXXXXXXXXXXXXXXXXXXXXXXXPPXXXXXXXXXXXXXXXXXXXXXXLLWGSSGXXXXXXXXXXXXXXXXXXXXXDQFFFHSNXXXXXXXXXXXXXXXXXXXXXXXXXXXXXXXXXXXXXXXXXXXXXXX

SEQ ID NO: 31516 - protein, 85 aa, Diabrotica virgifera
  misc_feature: Coding regions on vcDNA: vcDNA=SeqID_11213; Strand=-; Position=1-255
  misc_feature (11)..(33): Xaa can be any naturally occurring amino acid
  misc_feature (37)..(68): Xaa can be any naturally occurring amino acid
  misc_feature (74)..(83): Xaa can be any naturally occurring amino acid
KEVDFFFYPPXXXXXXXXXXXXXXXXXXXXXXXLWGXXXXXXXXXXXXXXXXXXXXXXXXXXXXXXXXPLPFPXXXXXXXXXXLP

SEQ ID NO: 31517 - protein, 61 aa, Diabrotica virgifera
  misc_feature: Coding regions on vcDNA: vcDNA=SeqID_11214; Strand=-; Position=1-183
  misc_feature (1)..(22): Xaa can be any naturally occurring amino acid
  misc_feature (24)..(49): Xaa can be any naturally occurring amino acid
  misc_feature (52)..(61): Xaa can be any naturally occurring amino acid
XXXXXXXXXXXXXXXXXXXXXXPXXXXXXXXXXXXXXXXXXXXXXXXXXIGXXXXXXXXXX

SEQ ID NO: 31518 - protein, 117 aa, Diabrotica virgifera
  misc_feature: Coding regions on vcDNA: vcDNA=SeqID_11215; Strand=-; Position=750 -1103
  misc_feature (8)..(18): Xaa can be any naturally occurring amino acid
  misc_feature (35)..(63): Xaa can be any naturally occurring amino acid
  misc_feature (82)..(93): Xaa can be any naturally occurring amino acid
LKKGRGLXXXXXXXXXXXGTFPGKSPGFFRSNSQXXXXXXXXXXXXXXXXXXXXXXXXXXXXXSFLLFFAQPEITNWGLNRXXXXXXXXXXXXFQFPRPLIFFVRGPKTRQAHPPPT

SEQ ID NO: 31519 - protein, 63 aa, Diabrotica virgifera
  misc_feature: Coding regions on vcDNA: vcDNA=SeqID_11216; Strand=-; Position=1-189
  misc_feature (1)..(22): Xaa can be any naturally occurring amino acid
  misc_feature (25)..(62): Xaa can be any naturally occurring amino acid
XXXXXXXXXXXXXXXXXXXXXXNNXXXXXXXXXXXXXXXXXXXXXXXXXXXXXXXXXXXXXXL

SEQ ID NO: 31520 - protein, 29 aa, Diabrotica virgifera
  misc_feature: Coding regions on vcDNA: vcDNA=SeqID_11217; Strand=-; Position=1-87
  misc_feature (2)..(29): Xaa can be any naturally occurring amino acid
YXXXXXXXXXXXXXXXXXXXXXXXXXXXX

SEQ ID NO: 31521 - protein, 140 aa, Diabrotica virgifera
  misc_feature: Coding regions on vcDNA: vcDNA=SeqID_11218; Strand=+; Position=2-424
  misc_feature (1)..(11): Xaa can be any naturally occurring amino acid
  misc_feature (15)..(27): Xaa can be any naturally occurring amino acid
  misc_feature (33)..(66): Xaa can be any naturally occurring amino acid
  misc_feature (81)..(130): Xaa can be any naturally occurring amino acid
XXXXXXXXXXXHIKXXXXXXXXXXXXXFDRAKXXXXXXXXXXXXXXXXXXXXXXXXXXXXXXXXXXKAKIFLKTRNPIKVXXXXXXXXXXXXXXXXXXXXXXXXXXXXXXXXXXXXXXXXXXXXXXXXXXLGKHRIFWGS

SEQ ID NO: 31522 - protein, 85 aa, Diabrotica virgifera
  misc_feature: Coding regions on vcDNA: vcDNA=SeqID_11219; Strand=-; Position=3-257
  misc_feature: Homolog annotation: Hit_ID=CAE47499.1; Match level="QueryCoverage =57%, HitCoverage=15%, E-value=7e-09, Identity=59%"; Hit description =cathepsin L-like proteinase [Diabrotica virgifera virgifera]
  misc_feature (60)..(60): Xaa can be any naturally occurring amino acid
MSMLFGKEIVVCTALVVESVKCVLLEGQRVKEQYVVEVWSSPQLVDRSGEYGNGGSNGGXPHWAYNYIKDHSLLKCFFGLIYRCV

SEQ ID NO: 31523 - protein, 230 aa, Diabrotica virgifera
  misc_feature: Coding regions on vcDNA: vcDNA=SeqID_11220; Strand=+; Position=2-694
  misc_feature (3)..(140): Xaa can be any naturally occurring amino acid
  misc_feature (143)..(185): Xaa can be any naturally occurring amino acid
  misc_feature (187)..(196): Xaa can be any naturally occurring amino acid
CVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYRXXXXXXXXXXXXXXXXXXXXXXXXXXXXXXXXXXXXXXXXXXXSXXXXXXXXXXLRITAEFYWGRQNDNKNMRPPRWIKSYKLGEKPY

SEQ ID NO: 31524 - protein, 271 aa, Diabrotica virgifera
  misc_feature: Coding regions on vcDNA: vcDNA=SeqID_11221; Strand=+; Position=1-813
  misc_feature (94)..(111): Xaa can be any naturally occurring amino acid
  misc_feature (143)..(149): Xaa can be any naturally occurring amino acid
PRAPMKGMEDKSPDSNGVPSASSNPPPPVPVTVPPLPTPRLSSQGDPQDDPRYFPLPKERKRNSFDSSDDGFSSDDDFFGKKHKQKPAPTNSEXXXXXXXXXXXXXXXXXXKIHKPHSDKPKKPRTDKPPKPEKERKHKDKKXXXXXXXKDSLEDLPRRESTKRVAKKKNSLAEVGGKDDEPEEPPEFQDSDSDPAWTPAANNDEEEGAVAVKKNRRGRPLGSKSKKTLKNLISAAAQGAGIGEGDDYSSDHSHKKNSSKSNSRNKLSSKY

SEQ ID NO: 31525 - protein, 91 aa, Diabrotica virgifera
  misc_feature: Coding regions on vcDNA: vcDNA=SeqID_11222; Strand=+; Position=4-279
  misc_feature (5)..(5): Xaa can be any naturally occurring amino acid
  misc_feature (7)..(10): Xaa can be any naturally occurring amino acid
  misc_feature (23)..(24): Xaa can be any naturally occurring amino acid
  misc_feature (26)..(26): Xaa can be any naturally occurring amino acid
  misc_feature (84)..(90): Xaa can be any naturally occurring amino acid
RPGEXEXXXXGEPFLNIPKKKGXXTXRKREQKQTRRKIPVILVESPTLHNINTSVTSIDETLIDEGTTTNPPPLGDYLGRKVQXXXXXXXK

SEQ ID NO: 31526 - protein, 61 aa, Diabrotica virgifera
  misc_feature: Coding regions on vcDNA: vcDNA=SeqID_11223; Strand=+; Position=271-456
VSTITNKRYHLNQFRNVPRYNGFESSNTYRSCNPNHNTKALAENIKKVRKKYGFYSGKTIY

SEQ ID NO: 31527 - protein, 98 aa, Diabrotica virgifera
  misc_feature: Coding regions on vcDNA: vcDNA=SeqID_11224; Strand=-; Position=74-370
  misc_feature (78)..(86): Xaa can be any naturally occurring amino acid
SLFCYRWPLAELGGRVSPSTPVPNFQRILHALLALQMSLFTTNSKNISCIVRPMCCSVKRADVLRQSILFCHFSLIFXXXXXXXXXISLLIKCLTDWA

SEQ ID NO: 31528 - protein, 189 aa, Diabrotica virgifera
  misc_feature: Coding regions on vcDNA: vcDNA=SeqID_11225; Strand=+; Position=113-680
  misc_feature: Homolog annotation: Hit_ID=XP_311028.1; Match level="QueryCoverage =69%, HitCoverage=36%, E-value=3e-69, Identity=79%"; Hit description =ENSANGP00000019906 [Anopheles gambiae]
  misc_feature: Gene Ontology Annotation: Molecular function=ATP binding; Cellular component=extracellular space; Biological process=N signaling pathway
  misc_feature: Pfam annotation: Pfam_ID=EGF; Match level="Score=86.0, E-value=1e-22, Copies=4"; Pfam description=EGF-like domain
  misc_feature (177)..(177): Xaa can be any naturally occurring amino acid
MYTKHSVMWTFNLMILVFNIQMISSRNDPKNDPRSNGDLALWIDEKQVKMFSDPDPECDKKCANQGRCNHEKICQCPEGYMGPYCRTALCYPQCMNGGNCTSPGICSCPPGFQGRHCEGGICGEKCLNGGKCIQKDTCECSKGYYGPHCEYSRCIIPCLNGGKSKAVNKCRCPRGFXGDHCEIGRAKPA

SEQ ID NO: 31529 - protein, 218 aa, Diabrotica virgifera
  misc_feature: Coding regions on vcDNA: vcDNA=SeqID_11226; Strand=+; Position=126-782
  misc_feature: Homolog annotation: Hit_ID=NP_996056.1; Match level="QueryCoverage =97%, HitCoverage=98%, E-value=6e-84, Identity=67%"; Hit description =CG18815-PB, isoform B [Drosophila melanogaster] ref|NP_996055.1| CG18815-PC, isoform C [Drosophila
  misc_feature: Gene Ontology Annotation: Molecular function=lysophospholipase activity; Cellular component=membrane fraction; Biological process =lipid metabolism
  misc_feature: Pfam annotation: Pfam_ID=Abhydrolase_2; Match level="Score=322.6, E -value=6.1e-94, Copies=1"; Pfam description =Phospholipase/Carboxylesterase
  misc_feature (185)..(185): Xaa can be any naturally occurring amino acid
MAAPVVIAATTKHTGTLIFLHGLGDTGQGWASAMAAVRPPHVKVICPTAPTIQVTLNAGFRMPSWFDLKSLDESGPEDEPGIKAATKQIHSLIETEVNAGISVDRIILGGFSQGGALALYSALTYPKKIAGVAALSCWLPLNKSFPAAKKTEDTLPILQCHGDCDPVVPYKWGQMTASVLKNMLXDVEFKSYRGLSHSSSDEELNDIKQFITKNLPSS

SEQ ID NO: 31530 - protein, 75 aa, Diabrotica virgifera
  misc_feature: Coding regions on vcDNA: vcDNA=SeqID_11227; Strand=-; Position=309-536
LHDGWSEVHCPGFFFRCGALALAVCSYKQRLRHHSYCLPTYMANSIDVHESSWRGKICNKFNTCISPLVSQATDK

SEQ ID NO: 31531 - protein, 261 aa, Diabrotica virgifera
  misc_feature: Coding regions on vcDNA: vcDNA=SeqID_11228; Strand=+; Position=20-805
  misc_feature: Homolog annotation: Hit_ID=AAH76555.1; Match level="QueryCoverage =95%, HitCoverage=50%, E-value=5e-26, Identity=29%"; Hit description =Unknown (protein for IMAGE:7044154) [Danio rerio]
  misc_feature: Gene Ontology Annotation: Molecular function=protein binding; Cellular component=nucleolus; Biological process=growth
MSYLVFSTIIQMIGLGMYGGDDSGSSSEDERDRGSYRDSDDELRNLIKRKMSEFQKTEREIEEKLDEAERRKEGSASRSPSPESNDNDSQVDARSQDRRYSQHDMRDASPVYEKHKSKSSSSSSQEDSSSSDESKNSYKRSKKRSPTPERRHSRVASSRWSKSPPSRRSTRRDSSSPIRRDSRGSRKQSTTSSKRSRSRSYSRSRRSRSSSYRRSKRSRSRDKSRRSRSSTRSRYSKRSPSSSRSDRKRRRRSRSDSSSRG

SEQ ID NO: 31532 - protein, 185 aa, Diabrotica virgifera
  misc_feature: Coding regions on vcDNA: vcDNA=SeqID_11229; Strand=-; Position=89-646
  misc_feature: Homolog annotation: Hit_ID=AAC24982.2; Match level="QueryCoverage =94%, HitCoverage=17%, E-value=2e-30, Identity=42%"; Hit description =reverse transcriptase [synthetic construct]
  misc_feature: Pfam annotation: Pfam_ID=RVT_1; Match level="Score=-17.9, E-value =0.0019, Copies=1"; Pfam description=Reverse transcriptase (RNA -dependent
  misc_feature (88)..(88): Xaa can be any naturally occurring amino acid
LFTPIHKKGVTTKCSNYRTISLISHPSKILLRIIKCRMQTYLDRQIPQEQAGFVKGKGTREQILNMRQLIEKARKFKIPMIICFLDYXKAFDCVDWTVLWKVLHEMGVPDHLSALVKSLYENSETRIRIENHKSDPFKIGRGVRQGYILSPSLFNFYGEYIMRKALDKWNGGISIDRYLFIYHNR

SEQ ID NO: 31533 - protein, 34 aa, Diabrotica virgifera; identical to SEQ ID NO: 27603
  misc_feature: Coding regions on vcDNA: vcDNA=SeqID_11230; Strand=-; Position=80-184

SEQ ID NO: 31534 - protein, 66 aa, Diabrotica virgifera; identical to SEQ ID NO: 26808
  misc_feature: Coding regions on vcDNA: vcDNA=SeqID_11231; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 31535 - protein, 302 aa, Diabrotica virgifera
  misc_feature: Coding regions on vcDNA: vcDNA=SeqID_11232; Strand=+; Position=18-924
  misc_feature: Homolog annotation: Hit_ID=NP_725952.1; Match level="QueryCoverage =98%, HitCoverage=81%, E-value=7e-59, Identity=42%"; Hit description =CG11200-PA, isoform A [Drosophila melanogaster] ref|NP_611471.1| CG11200-PB, isoform B [Drosophila
  misc_feature: Gene Ontology Annotation: Molecular function=electron transporter activity; Cellular component=mitochondrion; Biological process =induction of apoptosis
  misc_feature: Pfam annotation: Pfam_ID=adh_short; Match level="Score=57.6, E-value =3.6e-14, Copies=1"; Pfam description=short chain dehydrogenase
  misc_feature (83)..(83): Xaa can be any naturally occurring amino acid
  misc_feature (270)..(270): Xaa can be any naturally occurring amino acid
MIFLIGCSVIILVTIIAIIRSKKPLHTLLEEAKCEMIYNYIGSKGIFQDFIMRGSNKIDLPIETGRNAVITGGTRGIGVEVIXLLKCDINVIMGCRNIKQGELLLQNFRDEGIKTGNIDIINLDISVMDSVRNFVKSVKEKYSVVHYLINNAGIMFGPYIETRDGYESQFSTNYLGHFLLTHLLLPLLKAGGTKEKKARIVNVSSCAHFVVGDINFEDINNRHHYISGVAYAQSKMAQILFTKYLDAILEKQKINVQVHAVHPGLVNTDXVHGTNLKKCAPLIPALVVKSPEKRCNTHSVCL

SEQ ID NO: 31536 - protein, 40 aa, Diabrotica virgifera
  misc_feature: Coding regions on vcDNA: vcDNA=SeqID_11233; Strand=+; Position=1-120
  misc_feature (7)..(30): Xaa can be any naturally occurring amino acid
RKNPIKXXXXXXXXXXXXXXXXXXXXXXXXGDLINILYIF

SEQ ID NO: 31537 - protein, 218 aa, Diabrotica virgifera
  misc_feature: Coding regions on vcDNA: vcDNA=SeqID_11234; Strand=+; Position=7-663
  misc_feature: Homolog annotation: Hit_ID=XP_308816.1; Match level="QueryCoverage =98%, HitCoverage=58%, E-value=9e-21, Identity=29%"; Hit description =ENSANGP00000007703 [Anopheles gambiae]
MSKSELLKEYKKNVVQIKKHAKNLGLSEKEVNILFEQSFLELRKEQNGTNVPKPIKAQSLCTSIRNIFVLFTTLSFFIYILLNVHQPTSSIVLRNVQGLTYPTLKFIRFLSVPIIRLVPSLTDLYDETCLIKNPYFYVADMECWPCENVFAGVNISSMEERYLKSESGTPFIVKSNQKTVTLKTLQQTYKQNRVLLDSETRRLPSTNSSITTLRDLFW

SEQ ID NO: 31538 - protein, 42 aa, Diabrotica virgifera
  misc_feature: Coding regions on vcDNA: vcDNA=SeqID_11235; Strand=-; Position=80-208
ISLWLTALGYLRAQKEYKDRHHDAGLKFLIGVAAISLSLFDF

SEQ ID NO: 31539 - protein, 167 aa, Diabrotica virgifera
  misc_feature: Coding regions on vcDNA: vcDNA=SeqID_11236; Strand=+; Position=182-682
MLGKKVDFKCFIIFLMGITILVCVYQQDNIFSRTEIIENISGEELKLTAEATSNGGVFTINTPGCTIPYLHPYDKSILDYVEQPGKYVCNNGTPALFETDMESIKIIEKSLSFYHITNINDLKCCYKAFWREDPHTMADKKISYSNSCETFVNKTDIKEKFIKVTCH

SEQ ID NO: 31540 - protein, 21 aa, Diabrotica virgifera
  misc_feature: Coding regions on vcDNA: vcDNA=SeqID_11237; Strand=-; Position=1-63
  misc_feature (1)..(21): Xaa can be any naturally occurring amino acid
XXXXXXXXXXXXXXXXXXXXX

SEQ ID NO: 31541 - protein, 239 aa, Diabrotica virgifera
  misc_feature: Coding regions on vcDNA: vcDNA=SeqID_11238; Strand=-; Position=3-719
  misc_feature (14)..(28): Xaa can be any naturally occurring amino acid
  misc_feature (31)..(41): Xaa can be any naturally occurring amino acid
  misc_feature (51)..(58): Xaa can be any naturally occurring amino acid
  misc_feature (61)..(74): Xaa can be any naturally occurring amino acid
  misc_feature (80)..(93): Xaa can be any naturally occurring amino acid
  misc_feature (95)..(179): Xaa can be any naturally occurring amino acid
  misc_feature (183)..(239): Xaa can be any naturally occurring amino acid
LYCVFFECSVSFFXXXXXXXXXXXXXXXPFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXFSSXXXXXXXXXXXXXXXXXXXXXXXXXXXXXXXXXXXXXXXXXXXXXXXXXXXXXXXXX

SEQ ID NO: 31542 - protein, 42 aa, Diabrotica virgifera
  misc_feature: Coding regions on vcDNA: vcDNA=SeqID_11239; Strand=-; Position=2-127
  misc_feature (24)..(32): Xaa can be any naturally occurring amino acid
RVKLVNRFQFRFNSLTILFEGVCXXXXXXXXXNDDLKLKRIF

SEQ ID NO: 31543 - protein, 75 aa, Diabrotica virgifera
  misc_feature: Coding regions on vcDNA: vcDNA=SeqID_11240; Strand=-; Position=1-225
  misc_feature (36)..(42): Xaa can be any naturally occurring amino acid
LHSDYSLVLRSRHDPHFLSGVDLLCGLHFALSQKSXXXXXXXRFRFCRVFSAGFRADDWKPIAKNKVNTANLFIL

SEQ ID NO: 31544 - protein, 36 aa, Diabrotica virgifera
  misc_feature: Coding regions on vcDNA: vcDNA=SeqID_11241; Strand=-; Position=364-474
  misc_feature (3)..(12): Xaa can be any naturally occurring amino acid
  misc_feature (27)..(35): Xaa can be any naturally occurring amino acid
SIXXXXXXXXXXLIVYYKMGKSYFLFXXXXXXXXXL

SEQ ID NO: 31545 - protein, 58 aa, Diabrotica virgifera
  misc_feature: Coding regions on vcDNA: vcDNA=SeqID_11242; Strand=-; Position=78-254
  misc_feature (11)..(19): Xaa can be any naturally occurring amino acid
CIRRYKKCIYXXXXXXXXXYLRIQEQEHLYSSGEIPSDPRFIWLQLLLITIKSNILMS

SEQ ID NO: 31546 - protein, 77 aa, Diabrotica virgifera
  misc_feature: Coding regions on vcDNA: vcDNA=SeqID_11243; Strand=+; Position=177-407
  misc_feature: Homolog annotation: Hit_ID=XP_318532.1; Match level="QueryCoverage =57%, HitCoverage=19%, E-value=7e-10, Identity=54%"; Hit description =ENSANGP00000019684 [Anopheles gambiae]
  misc_feature (35)..(35): Xaa can be any naturally occurring amino acid
SNFYTTILPQDFYREWRDYKFGFGNLDGEFWIGLXNIHHMTAVEPRELIIELIDKGQKSGTCPKYMAKLWPLDRTCT

SEQ ID NO: 31547 - protein, 77 aa, Diabrotica virgifera
  misc_feature: Coding regions on vcDNA: vcDNA=SeqID_11244; Strand=-; Position=0-230
  misc_feature (3)..(33): Xaa can be any naturally occurring amino acid
  misc_feature (36)..(46): Xaa can be any naturally occurring amino acid
  misc_feature (54)..(72): Xaa can be any naturally occurring amino acid
  misc_feature (74)..(74): Xaa can be any naturally occurring amino acid
QKXXXXXXXXXXXXXXXXXXXXXXXXXXXXXXXKKXXXXXXXXXXXSSLKKLSXXXXXXXXXXXXXXXXXXXPXIPA

SEQ ID NO: 31548 - protein, 41 aa, Diabrotica virgifera
  misc_feature: Coding regions on vcDNA: vcDNA=SeqID_11245; Strand=+; Position=18-143
ISAHIHIFMQFIIKTHCMFHQRNLLAKTAIISISLHYDRVS

SEQ ID NO: 31549 - protein, 62 aa, Diabrotica virgifera
  misc_feature: Coding regions on vcDNA: vcDNA=SeqID_11246; Strand=-; Position=1-186
YLYWFSWFISRWPSWCAEVIFFMKDKYLSHAQRRPLLDDLSFTEKYVSCVIKNNYQPGRAGG

SEQ ID NO: 31550 - protein, 294 aa, Diabrotica virgifera
  misc_feature: Coding regions on vcDNA: vcDNA=SeqID_11247; Strand=+; Position=1-885
  misc_feature (20)..(277): Xaa can be any naturally occurring amino acid
QTSGWCDFISRKYQIAALQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNLDFKKPQLRQKQMDHS

SEQ ID NO: 31551 - protein, 333 aa, Diabrotica virgifera
  misc_feature: Coding regions on vcDNA: vcDNA=SeqID_11248; Strand=-; Position=12-1013
  misc_feature (3)..(9): Xaa can be any naturally occurring amino acid
  misc_feature (13)..(32): Xaa can be any naturally occurring amino acid
  misc_feature (35)..(45): Xaa can be any naturally occurring amino acid
  misc_feature (62)..(68): Xaa can be any naturally occurring amino acid
  misc_feature (71)..(153): Xaa can be any naturally occurring amino acid
  misc_feature (158)..(326): Xaa can be any naturally occurring amino acid
PWXXXXXXXKKSXXXXXXXXXXXXXXXXXXXXPPXXXXXXXXXXXAKKSLLIVYKAVWGLCXXXXXXXFLXXXXXXXXXXXXXXXXXXXXXXXXXXXXXXXXXXXXXXXXXXXXXXXXXXXXXXXXXXXXXXXXXXXXXXXXXXXXXXXXXXXQFFNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKNMLLF

SEQ ID NO: 31552 - protein, 149 aa, Diabrotica virgifera
  misc_feature: Coding regions on vcDNA: vcDNA=SeqID_11249; Strand=-; Position=2-448
  misc_feature (1)..(6): Xaa can be any naturally occurring amino acid
  misc_feature (12)..(19): Xaa can be any naturally occurring amino acid
  misc_feature (22)..(28): Xaa can be any naturally occurring amino acid
  misc_feature (43)..(48): Xaa can be any naturally occurring amino acid
  misc_feature (66)..(148): Xaa can be any naturally occurring amino acid
XXXXXXFKSRNXXXXXXXXWKXXXXXXXSSPKYKTLNPPQGGXXXXXXLELPKKNSLFFLKVIFFXXXXXXXXXXXXXXXXXXXXXXXXXXXXXXXXXXXXXXXXXXXXXXXXXXXXXXXXXXXXXXXXXXXXXXXXXXXXXXXXXXXL

SEQ ID NO: 31553 - protein, 40 aa, Diabrotica virgifera
  misc_feature: Coding regions on vcDNA: vcDNA=SeqID_11250; Strand=-; Position=0-119
  misc_feature (24)..(34): Xaa can be any naturally occurring amino acid
KNLYKSSIGSLSGACKKNISIFYXXXXXXXXXXXGQFFYL

SEQ ID NO: 31554 - protein, 145 aa, Diabrotica virgifera
  misc_feature: Coding regions on vcDNA: vcDNA=SeqID_11251; Strand=+; Position=212-649
  misc_feature: Homolog annotation: Hit_ID=CAA10770.1; Match level="QueryCoverage =98%, HitCoverage=42%, E-value=3e-19, Identity=36%"; Hit description =reverse transcriptase-like [Bos taurus]
  misc_feature (25)..(25): Xaa can be any naturally occurring amino acid
  misc_feature (42)..(42): Xaa can be any naturally occurring amino acid
  misc_feature (58)..(58): Xaa can be any naturally occurring amino acid
MTKIWKDSQISRTLKIRLINYLIFXVLTYGSISWILGQAERXKKMDATDMVCWRRKLXILWTDHRTNNSILNELKVSKRLSSKVQLHHLKYFGQFMTADTENMEKLIIQGKIEGRKSRGRYPTRWIGQTTGIRKRPLHQLKEIFR

SEQ ID NO: 31555 - protein, 267 aa, Diabrotica virgifera
  misc_feature: Coding regions on vcDNA: vcDNA=SeqID_11252; Strand=+; Position=2-804
  misc_feature: Homolog annotation: Hit_ID=XP_320691.1; Match level="QueryCoverage =99%, HitCoverage=5%, E-value=1e-118, Identity=75%"; Hit description =ENSANGP00000020044 [Anopheles gambiae]
  misc_feature: Gene Ontology Annotation: Molecular function=guanyl-nucleotide exchange factor activity; Cellular component=cellular_component unknown; Biological process=intracellular protein transport
  misc_feature: Pfam annotation: Pfam_ID=HECT; Match level="Score=119.3, E-value=9.5e- 33, Copies=1"; Pfam description=HECT-domain (ubiquitin-transferase)
  misc_feature (259)..(259): Xaa can be any naturally occurring amino acid
IPTPNGRDEAGANRDCFILNPLAKTCLNLNMFRFLGVLMGIAIRTGSPLSLNLAEPVWKQLAGIELTPADLTEIDRDYVPGLLCIRDMAPEEPLFQNLEMPFSTPSSCGTDVHLSTRYKRITFENRLEYVRLALNFRLHEFDEQVKAVRDGMSRVVPVPLLSLFSGYELETMVCGSPDIPLTLLKSVATYKGIDSSAPLIQWFWDVMEEFTNQERSLFLRFVWGRTRLPRTIADFRGRDFVIQILDKYTPPDNFLPESXTCFFLLKC

SEQ ID NO: 31556 - protein, 161 aa, Diabrotica virgifera
  misc_feature: Coding regions on vcDNA: vcDNA=SeqID_11253; Strand=+; Position=2-682
  misc_feature: Homolog annotation: Hit_ID=AAF87759.1; Match level="QueryCoverage =100%, HitCoverage=52%, E-value=3e-63, Identity=61%"; Hit description= cytochrome oxidase subunit I [Diabrotica virgifera virgifera]
  misc_feature: Pfam annotation: Pfam_ID=COX1; Match level="Score=-139.7, E-value =1.7e-06, Copies=1"; Pfam description=Cytochrome C and Quinol oxidase polyp
  misc_feature (24)..(24): Xaa can be any naturally occurring amino acid
  misc_feature (78)..(78): Xaa can be any naturally occurring amino acid
  misc_feature (113)..(113): Xaa can be any naturally occurring amino acid
NFITTVINIRPIGITFDRIPLFVXAVVITAILLLLSLPVLAGAITILLTDRNLNTSFFDPAGIIYAIIAIGLLGFIVXAHHIFTVGMDVDTRAYFTSATIIIAVPTGIKVFRXLATYHGTTITYRLTGVVLANSSIDIVLHDTYYVVAIGAVFAIIAGFIQ

SEQ ID NO: 31557 - protein, 206 aa, Diabrotica virgifera
  misc_feature: Coding regions on vcDNA: vcDNA=SeqID_11254; Strand=-; Position=1-618
  misc_feature (1)..(40): Xaa can be any naturally occurring amino acid
  misc_feature (42)..(206): Xaa can be any naturally occurring amino acid
XXXXXXXXXXXXXXXXXXXXXXXXXXXXXXXXXXXXXXXXAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31558 - protein, 268 aa, Diabrotica virgifera
  misc_feature: Coding regions on vcDNA: vcDNA=SeqID_11255; Strand=+; Position=2-808
  misc_feature: Homolog annotation: Hit_ID=XP_313526.1; Match level="QueryCoverage =97%, HitCoverage=70%, E-value=1e-35, Identity=33%"; Hit description =ENSANGP00000024994 [Anopheles gambiae]
  misc_feature: Pfam annotation: Pfam_ID=RVT_1; Match level="Score=152.8, E-value =7.7e-43, Copies=1"; Pfam description=Reverse transcriptase (RNA -dependent D
  misc_feature (129)..(137): Xaa can be any naturally occurring amino acid
KSGIFSLSAPLSYLINLSVANGKFPDALKSARVIPIHKKNDPGLISNYRPVAVLSVLSKIFEKVVYNKMVCFLDKFDIISPHQHGFRSKKSTLTAACHFFNYIYRDLDRGRHVAGLFFDLSRAFDWLDXXXXXXXXXNLGFRGDFLDWIVDYLSNRKMLVSYQNSASTVFNIDKGVPQGSVLGPLIFILFMNDLPDYIKSRVITIYADDTALAVSAPSKEELILLSNGVFGSFVDWSKANGLIVNVDKTQFLYFSSQNVLSNVYSLSF

SEQ ID NO: 31559 - protein, 18 aa, Diabrotica virgifera
  misc_feature: Coding regions on vcDNA: vcDNA=SeqID_11256; Strand=-; Position=0-53
  misc_feature (2)..(17): Xaa can be any naturally occurring amino acid
IXXXXXXXXXXXXXXXXL

SEQ ID NO: 31560 - protein, 76 aa, Diabrotica virgifera
  misc_feature: Coding regions on vcDNA: vcDNA=SeqID_11257; Strand=+; Position=401-631
LSPNCMNMEIFSTNASLLGTLPEVPKLKKVPYISCSYEPSLQDVIAEILSELGDIYKIPPVQAPELTEKPVVAILK

SEQ ID NO: 31561 - protein, 80 aa, Diabrotica virgifera
  misc_feature: Coding regions on vcDNA: vcDNA=SeqID_11258; Strand=-; Position=1-240
  misc_feature (3)..(3): Xaa can be any naturally occurring amino acid
  misc_feature (15)..(79): Xaa can be any naturally occurring amino acid
DLXSPIKITLLSPKXXXXXXXXXXXXXXXXXXXXXXXXXXXXXXXXXXXXXXXXXXXXXXXXXXXXXXXXXXXXXXXXXF

SEQ ID NO: 31562 - protein, 27 aa, Diabrotica virgifera
  misc_feature: Coding regions on vcDNA: vcDNA=SeqID_11259; Strand=+; Position=26-106
ILLFSKLKLILDSLIFNREQSYFIYIE

SEQ ID NO: 31563 - protein, 190 aa, Diabrotica virgifera
  misc_feature: Coding regions on vcDNA: vcDNA=SeqID_11260; Strand=+; Position=208-778
  misc_feature: Homolog annotation: Hit_ID=XP_545811.1; Match level="QueryCoverage =81%, HitCoverage=12%, E-value=3e-11, Identity=29%"; Hit description =PREDICTED: similar to MAGEL2 protein [Canis familiaris]
  misc_feature: Gene Ontology Annotation: Molecular function=molecular_function unknown; Cellular component=cellular_component unknown; Biological process=biological_process unknown
  misc_feature (78)..(78): Xaa can be any naturally occurring amino acid
  misc_feature (120)..(120): Xaa can be any naturally occurring amino acid
MGRPTNSSRSKGSQRSLSQLTQESSQRNGNGTDIEDHVNNLVRYFINRAGEHVSFKRTELRKNVLVNVGTQFQEIMNXATKILEEVYGYKILIADSSQNSAKEYLITNVLPYKPDPTEYXPPNGYPEDANKVFTLLVLSHVFMSNNSVSDNSLYSFLKTFGIDVQRRHEIFGSIKDLLNVLKNKKYINME

SEQ ID NO: 31564 - protein, 93 aa, Diabrotica virgifera
  misc_feature: Coding regions on vcDNA: vcDNA=SeqID_11261; Strand=+; Position=270-551
  misc_feature (3)..(12): Xaa can be any naturally occurring amino acid
  misc_feature (53)..(66): Xaa can be any naturally occurring amino acid
EPXXXXXXXXXXYLHTPILLILHIFRHELKTTILLKSNFPIQISTKHFHILQXXXXXXXXXXXXXXINLSLKYKLTLLKPSNDDNISIQKLSI

SEQ ID NO: 31565 - protein, 274 aa, Diabrotica virgifera
  misc_feature: Coding regions on vcDNA: vcDNA=SeqID_11262; Strand=+; Position=4-828
  misc_feature: Homolog annotation: Hit_ID=XP_395312.1; Match level="QueryCoverage =99%, HitCoverage=80%, E-value=4e-55, Identity=42%"; Hit description =similar to PAK1 interacting protein 1 [Apis mellifera]
  misc_feature: Gene Ontology Annotation: Molecular function=molecular_function unknown; Cellular component=membrane fraction; Biological process =virus-host interaction
  misc_feature: Pfam annotation: Pfam_ID=WD40; Match level="Score=66.4, E-value=7.7e -17, Copies=4"; Pfam description=WD domain, G-beta repeat
  misc_feature (183)..(183): Xaa can be any naturally occurring amino acid
  misc_feature (242)..(242): Xaa can be any naturally occurring amino acid
  misc_feature (246)..(246): Xaa can be any naturally occurring amino acid
  misc_feature (252)..(252): Xaa can be any naturally occurring amino acid
  misc_feature (259)..(259): Xaa can be any naturally occurring amino acid
THENTYRMKTFEIVAGTYEEFLIGYEFFEKDSQLVQSFASHDHSASIRSLTRCDHYVASGGADDRIIIYDFRMRKEHCMLSHHSSTVTCLDFTPNHSHILSGSQDGLLAITRVGNWQVEKLWDKAHKGSAIIDIAVHPTGKLALTLGDDCTLRTWNLVKGRQAYAVNLKSKSKDPKSIFKICXAADGVRFILYGGKYTEIWGTESGGILQVIEHDVKVSSCIWYSDKKILVGYEDGNISLVXLSSXEKTTNXVHKDRVXSLANLKIDHIVSSGE

SEQ ID NO: 31566 - protein, 284 aa, Diabrotica virgifera
  misc_feature: Coding regions on vcDNA: vcDNA=SeqID_11263; Strand=-; Position=0-851
  misc_feature (1)..(280): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTRVR

SEQ ID NO: 31567 - protein, 54 aa, Diabrotica virgifera
  misc_feature: Coding regions on vcDNA: vcDNA=SeqID_11264; Strand=-; Position=84-248
  misc_feature (21)..(28): Xaa can be any naturally occurring amino acid
  misc_feature (45)..(51): Xaa can be any naturally occurring amino acid
NTVIYTDPITVSNISIAFESXXXXXXXXVSHLEENNRQVTNVILXXXXXXXPKL

SEQ ID NO: 31568 - protein, 53 aa, Diabrotica virgifera
  misc_feature: Coding regions on vcDNA: vcDNA=SeqID_11265; Strand=+; Position=126-284
NLKKVSPYCDSVGRDMNYYKWICLSLLLDMCTRCPPKMTVDSLLTLVAADRPT

SEQ ID NO: 31569 - protein, 42 aa, Diabrotica virgifera
  misc_feature: Coding regions on vcDNA: vcDNA=SeqID_11266; Strand=+; Position=33-161
CKYNFKLLYKMPRKHTMLKRNRNFYLRTNRGNSPWSNVCRRR

SEQ ID NO: 31570 - protein, 91 aa, Diabrotica virgifera
  misc_feature: Coding regions on vcDNA: vcDNA=SeqID_11267; Strand=-; Position=2-274
  misc_feature (31)..(37): Xaa can be any naturally occurring amino acid
YPHHFLSLQLIVTCQECNYLHFIFLLFFHKXXXXXXXAMILQLPPAQLQTLMYFLPLAFFSFSPSSLNNRSTALTREAADIAVDRLFKELG

SEQ ID NO: 31571 - protein, 65 aa, Diabrotica virgifera
  misc_feature: Coding regions on vcDNA: vcDNA=SeqID_11268; Strand=-; Position=57-254
HLYSTHEQPRKTRYAIRVNSRVLKALAVVNNRTPTQVVTWNVISLHQAGKVHNAVKEMERLNVDL

SEQ ID NO: 31572 - protein, 127 aa, Diabrotica virgifera
  misc_feature: Coding regions on vcDNA: vcDNA=SeqID_11269; Strand=+; Position=426-809
  misc_feature (93)..(93): Xaa can be any naturally occurring amino acid
YSSSNLYSVIGTNIQNNFYSGINSDKAISLCVSTRAAGFGAAHIFNVISHYQNVPNAGNIYQYYRICLAILESKAQVVQRSVTVIQNNEDDYXKLILNYEFITTMIRVMNYLPDQITNVANGIRKIG

SEQ ID NO: 31573 - protein, 125 aa, Diabrotica virgifera
  misc_feature: Coding regions on vcDNA: vcDNA=SeqID_11270; Strand=-; Position=324-701
  misc_feature (15)..(15): Xaa can be any naturally occurring amino acid
  misc_feature (20)..(26): Xaa can be any naturally occurring amino acid
QFHSDLVFILINLYXLSESXXXXXXXFNIRGSKMSLNSIIISYFDVFLQIAKIQDFSFDLACRDVQNLIFLIFTGVNSSVNLISRVNSAVTLAAMLNLKESRFCSISPSFSTFRQKVRRLKLLKI

SEQ ID NO: 31574 - protein, 331 aa, Diabrotica virgifera
  misc_feature: Coding regions on vcDNA: vcDNA=SeqID_11271; Strand=-; Position=34-1028
  misc_feature: Homolog annotation: Hit_ID=EAA07061.2; Match level="QueryCoverage =86%, HitCoverage=92%, E-value=5e-76, Identity=48%"; Hit description =ENSANGP00000016734 [Anopheles gambiae str. PEST] ref|XP_559147.1| ENSANGP00000016734 [Anopheles gambiae st
  misc_feature: Gene Ontology Annotation: Molecular function=structural constituent of ribosome; Cellular component=mitochondrial large ribosomal subunit; Biological process=protein biosynthesis
  misc_feature: Pfam annotation: Pfam_ID=TGS; Match level="Score=-0.1, E-value=0.029, Copies=1"; Pfam description=TGS domain
  misc_feature (44)..(44): Xaa can be any naturally occurring amino acid
  misc_feature (60)..(60): Xaa can be any naturally occurring amino acid
  misc_feature (106)..(106): Xaa can be any naturally occurring amino acid
RVPGQKILVRDGRGPFSVFLRGFFLVIQGTKLYFFQEPSRQREXFGRIEKMEINYVGAPXKEIFLLNKNVSPPFDCAKHMGDTVRNKSVLGLVNGELLGHLHKKLXGACKLELVHYHSPNPTFVNKTFWRTCSFLMGAVASQAFKDNVRLCLHSFPSPNVKSGSFVYDIQLELEDWKPTTSELKVLSIEMIKMCQQELPLECLDVSKDIAFDIFKNNPHKTKQIPSIAEHNGGKVTLFRAGTHIDISKGPMIPNTNHMGRVTIANVIKLETDLEGGPIYRFQGVALPKPLILNHFAYGILEERAKLLNGARIPGTQIIDNEDNSFVASMTA

SEQ ID NO: 31575 - protein, 171 aa, Diabrotica virgifera
  misc_feature: Coding regions on vcDNA: vcDNA=SeqID_11272; Strand=-; Position=1-513
  misc_feature (1)..(57): Xaa can be any naturally occurring amino acid
  misc_feature (59)..(59): Xaa can be any naturally occurring amino acid
  misc_feature (63)..(171): Xaa can be any naturally occurring amino acid
XXXXXXXXXXXXXXXXXXXXXXXXXXXXXXXXXXXXXXXXXXXXXXXXXXXXXXXXXNXSFLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31576 - protein, 66 aa, Diabrotica virgifera
  misc_feature: Coding regions on vcDNA: vcDNA=SeqID_11273; Strand=+; Position=194-394
SQSVCLNCIKFRRARIMDLVMSFYTHSRLYKKTSTLDNQFKTSTHLNAVKKFVCRYKYIFFVKFPF

SEQ ID NO: 31577 - protein, 142 aa, Diabrotica virgifera
  misc_feature: Coding regions on vcDNA: vcDNA=SeqID_11274; Strand=-; Position=1-426
  misc_feature (18)..(142): Xaa can be any naturally occurring amino acid
LYYRFDLSNKITLLSLRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31578 - protein, 65 aa, Diabrotica virgifera
  misc_feature: Coding regions on vcDNA: vcDNA=SeqID_11275; Strand=-; Position=2-196
  misc_feature (2)..(10): Xaa can be any naturally occurring amino acid
  misc_feature (22)..(29): Xaa can be any naturally occurring amino acid
  misc_feature (32)..(45): Xaa can be any naturally occurring amino acid
  misc_feature (51)..(64): Xaa can be any naturally occurring amino acid
FXXXXXXXXXIETNLAHNGLNXXXXXXXXSNXXXXXXXXXXXXXXPTSRSXXXXXXXXXXXXXXV

SEQ ID NO: 31579 - protein, 216 aa, Diabrotica virgifera
  misc_feature: Coding regions on vcDNA: vcDNA=SeqID_11276; Strand=+; Position=187-836
  misc_feature: Homolog annotation: Hit_ID=CAB62280.1; Match level="QueryCoverage =82%, HitCoverage=80%, E-value=1e-27, Identity=46%"; Hit description =hydroxyproline-rich glycoprotein DZ-HRGP [Volvox carteri f. nagariensis]
  misc_feature: Gene Ontology Annotation: Molecular function=protein binding; Cellular component=extracellular space; Biological process=response to pathogenic bacteria
  misc_feature (124)..(124): Xaa can be any naturally occurring amino acid
MSSPSTDIPFFKKSIIFILLTLYLSLPTPLLLTSTHFPGCRSNPPPSFTTSPPTTTVRLQIFIFHSMLLSYFYTLLSLRSYQPLPSHLPTPSLYIHMLTLPPPPPPPHPTHSLPDPVPPPPHPXPSPSSALPPSSPYSPLISPPRPLCFKLPSPFRTPPRLPSPVPTPPPSSSTFLPCSPPPHPPPPTSPPPQLSLPPSPPLSPPLSTPPFHPPPP

SEQ ID NO: 31580 - protein, 75 aa, Diabrotica virgifera
  misc_feature: Coding regions on vcDNA: vcDNA=SeqID_11277; Strand=-; Position=1-225
SVYIQRYCSSSRPMDKPTTCLSLLHPHTPNFITKFALSALSLFAVRIPKLQRRLLADQRSMPNLRAACALNRTKG

SEQ ID NO: 31581 - protein, 88 aa, Diabrotica virgifera
  misc_feature: Coding regions on vcDNA: vcDNA=SeqID_11278; Strand=+; Position=2-265
  misc_feature (4)..(30): Xaa can be any naturally occurring amino acid
  misc_feature (35)..(88): Xaa can be any naturally occurring amino acid
MKGXXXXXXXXXXXXXXXXXXXXXXXXXXXRKPHXXXXXXXXXXXXXXXXXXXXXXXXXXXXXXXXXXXXXXXXXXXXXXXXXXXXXX

SEQ ID NO: 31582 - protein, 26 aa, Diabrotica virgifera
  misc_feature: Coding regions on vcDNA: vcDNA=SeqID_11279; Strand=-; Position=0-77
  misc_feature (1)..(25): Xaa can be any naturally occurring amino acid
XXXXXXXXXXXXXXXXXXXXXXXXXP

SEQ ID NO: 31583 - protein, 47 aa, Diabrotica virgifera
  misc_feature: Coding regions on vcDNA: vcDNA=SeqID_11280; Strand=+; Position=104-244
  misc_feature (13)..(20): Xaa can be any naturally occurring amino acid
  misc_feature (27)..(34): Xaa can be any naturally occurring amino acid
IIFTHVPVTYMKXXXXXXXXTCQFNFXXXXXXXXSVCILLSNINISF

SEQ ID NO: 31584 - protein, 42 aa, Diabrotica virgifera
  misc_feature: Coding regions on vcDNA: vcDNA=SeqID_11281; Strand=-; Position=49-177
NTVLSIATVMGATYLYSQNPVHNPPKPVQDDSIEKERLLEEV

SEQ ID NO: 31585 - protein, 244 aa, Diabrotica virgifera
  misc_feature: Coding regions on vcDNA: vcDNA=SeqID_11282; Strand=-; Position=2-733
  misc_feature (3)..(13): Xaa can be any naturally occurring amino acid
  misc_feature (23)..(31): Xaa can be any naturally occurring amino acid
  misc_feature (33)..(46): Xaa can be any naturally occurring amino acid
  misc_feature (53)..(65): Xaa can be any naturally occurring amino acid
  misc_feature (67)..(238): Xaa can be any naturally occurring amino acid
  misc_feature (240)..(244): Xaa can be any naturally occurring amino acid
PFXXXXXXXXXXXNHPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXX

SEQ ID NO: 31586 - protein, 57 aa, Diabrotica virgifera
  misc_feature: Coding regions on vcDNA: vcDNA=SeqID_11283; Strand=-; Position=1-171
  misc_feature (3)..(57): Xaa can be any naturally occurring amino acid
KNXXXXXXXXXXXXXXXXXXXXXXXXXXXXXXXXXXXXXXXXXXXXXXXXXXXXXXX

SEQ ID NO: 31587 - protein, 59 aa, Diabrotica virgifera
  misc_feature: Coding regions on vcDNA: vcDNA=SeqID_11284; Strand=-; Position=0-176
  misc_feature (1)..(56): Xaa can be any naturally occurring amino acid
XXXXXXXXXXXXXXXXXXXXXXXXXXXXXXXXXXXXXXXXXXXXXXXXXXXXXXXXHPT

SEQ ID NO: 31588 - protein, 121 aa, Diabrotica virgifera
  misc_feature: Coding regions on vcDNA: vcDNA=SeqID_11285; Strand=-; Position=741 -1106
  misc_feature (6)..(19): Xaa can be any naturally occurring amino acid
  misc_feature (69)..(80): Xaa can be any naturally occurring amino acid
KRGCCXXXXXXXXXXXXXXVFFPKVGFFKRNPLLLIFLGAIFPIQSCFFANFPIRGGREILVQNISKNXXXXXXXXXXXXRKGQLIKIPQGNNFRTTLMNMVWRKFHRKWFFASIHSHMYC

SEQ ID NO: 31589 - protein, 57 aa, Diabrotica virgifera
  misc_feature: Coding regions on vcDNA: vcDNA=SeqID_11286; Strand=-; Position=92-265
VMLREHQCFGPAIFVLYKRVKGRRVGTSLLTKNGWVTLDESKKCLYSSEKFINRYIK

SEQ ID NO: 31590 - protein, 34 aa, Diabrotica virgifera; identical to SEQ ID NO: 27603
  misc_feature: Coding regions on vcDNA: vcDNA=SeqID_11287; Strand=-; Position=80-184

SEQ ID NO: 31591 - protein, 81 aa, Diabrotica virgifera
  misc_feature: Coding regions on vcDNA: vcDNA=SeqID_11288; Strand=+; Position=14-256
  misc_feature (55)..(77): Xaa can be any naturally occurring amino acid
YKNNYLGIRVIFIGESIDIRFAPPRGGLRFLNWGAPFFILTWFPFLNFNGSGVKXXXXXXXXXXXXXXXXXXXXXXXTEGP

SEQ ID NO: 31592 - protein, 41 aa, Diabrotica virgifera
  misc_feature: Coding regions on vcDNA: vcDNA=SeqID_11289; Strand=-; Position=112-237
RYRAQGRAIHLQIFWEDLDLPIYVFLFQHREYANNLYFVVA

SEQ ID NO: 31593 - protein, 53 aa, Diabrotica virgifera
  misc_feature: Coding regions on vcDNA: vcDNA=SeqID_11290; Strand=+; Position=2-163
MSHRKFSAPRHLSMGFYPYSVISERPWKDRRLLKRNFHSGSSPVRMSSAERKA

SEQ ID NO: 31594 - protein, 206 aa, Diabrotica virgifera
  misc_feature: Coding regions on vcDNA: vcDNA=SeqID_11291; Strand=+; Position=131-751
  misc_feature: Homolog annotation: Hit_ID=AAF97940.2; Match level="QueryCoverage =100%, HitCoverage=46%, E-value=9e-41, Identity=42%"; Hit description= cytochrome P450 CYP6N4v1 [Aedes albopictus]
  misc_feature (139)..(145): Xaa can be any naturally occurring amino acid
MLVPLLLLLGIVAYLYKKWSYSYWKRRNLYYIEPESFYGNIKDLMVGKASLTDQYKSLYDEFKSKGLRHGGFYEMFAPAYMPVDIEITKSIIQKDFANFRNHGEYTNEKVDPLSGHLLFLTDDKWKNLRAKLTPTFTSXXXXXXXPTMVSCSSGLKDLLKESADLQDAVDIKEIISRFTTDVIGSAAFGLDCNSLKNPNSEFREFG

SEQ ID NO: 31595 - protein, 45 aa, Diabrotica virgifera
  misc_feature: Coding regions on vcDNA: vcDNA=SeqID_11292; Strand=+; Position=2-139
LQLPERNIIRYIDLIFISGNCNITMLFPFFHFWRDVCNINNCIFQ

SEQ ID NO: 31596 - protein, 79 aa, Diabrotica virgifera
  misc_feature: Coding regions on vcDNA: vcDNA=SeqID_11293; Strand=-; Position=1-237
  misc_feature (4)..(13): Xaa can be any naturally occurring amino acid
  misc_feature (15)..(79): Xaa can be any naturally occurring amino acid
LKNXXXXXXXXXXIXXXXXXXXXXXXXXXXXXXXXXXXXXXXXXXXXXXXXXXXXXXXXXXXXXXXXXXXXXXXXXXXX

SEQ ID NO: 31597 - protein, 42 aa, Diabrotica virgifera
  misc_feature: Coding regions on vcDNA: vcDNA=SeqID_11294; Strand=-; Position=16-144
  misc_feature (26)..(26): Xaa can be any naturally occurring amino acid
SGARRIRTTREDRSLKTTFFAKSVLXDQSNPRTIFKMLTGGH

SEQ ID NO: 31598 - protein, 66 aa, Diabrotica virgifera; identical to SEQ ID NO: 26808
  misc_feature: Coding regions on vcDNA: vcDNA=SeqID_11295; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 31599 - protein, 40 aa, Diabrotica virgifera
  misc_feature: Coding regions on vcDNA: vcDNA=SeqID_11296; Strand=-; Position=2-121
  misc_feature (3)..(13): Xaa can be any naturally occurring amino acid
  misc_feature (23)..(30): Xaa can be any naturally occurring amino acid
  misc_feature (33)..(40): Xaa can be any naturally occurring amino acid
PFXXXXXXXXXXXTNLAHTGLNXXXXXXXXSNXXXXXXXX

SEQ ID NO: 31600 - protein, 282 aa, Diabrotica virgifera
  misc_feature: Coding regions on vcDNA: vcDNA=SeqID_11297; Strand=-; Position=1-846
  misc_feature (6)..(30): Xaa can be any naturally occurring amino acid
  misc_feature (32)..(265): Xaa can be any naturally occurring amino acid
  misc_feature (268)..(282): Xaa can be any naturally occurring amino acid
FLIPPXXXXXXXXXXXXXXXXXXXXXXXXXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRYXXXXXXXXXXXXXXX

SEQ ID NO: 31601 - protein, 51 aa, Diabrotica virgifera
  misc_feature: Coding regions on vcDNA: vcDNA=SeqID_11298; Strand=-; Position=82-237
  misc_feature (7)..(12): Xaa can be any naturally occurring amino acid
NCSFRYXXXXXXNNYNLLQKNDSLFTFMFQLYNYVNILTNNIHYLYTYFIS

SEQ ID NO: 31602 - protein, 205 aa, Diabrotica virgifera
  misc_feature: Coding regions on vcDNA: vcDNA=SeqID_11299; Strand=-; Position=1-615
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(198): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHLFIKNM

SEQ ID NO: 31603 - protein, 241 aa, Diabrotica virgifera
  misc_feature: Coding regions on vcDNA: vcDNA=SeqID_11300; Strand=-; Position=1-723
  misc_feature (15)..(40): Xaa can be any naturally occurring amino acid
  misc_feature (46)..(61): Xaa can be any naturally occurring amino acid
  misc_feature (64)..(211): Xaa can be any naturally occurring amino acid
  misc_feature (213)..(213): Xaa can be any naturally occurring amino acid
  misc_feature (219)..(219): Xaa can be any naturally occurring amino acid
  misc_feature (227)..(237): Xaa can be any naturally occurring amino acid
YAALARSKYRDHSKXXXXXXXXXXXXXXXXXXXXXXXXXXNSFSNXXXXXXXXXXXXXXXXIIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSXLIISPXIHFFFSMXXXXXXXXXXXGLGR

SEQ ID NO: 31604 - protein, 108 aa, Diabrotica virgifera
  misc_feature: Coding regions on vcDNA: vcDNA=SeqID_11301; Strand=-; Position=179-505
FDILSRSSEVFLRMGVCNRRTKINRGIQIYYIYRGSLNTLASVELRVAHYLTSVHRASRLELACLSLRITSRTVHVAIQVGRPRSLRLAGYGAQNGRSGLPDRRLRCS

SEQ ID NO: 31605 - protein, 65 aa, Diabrotica virgifera
  misc_feature: Coding regions on vcDNA: vcDNA=SeqID_11302; Strand=+; Position=111-305
  misc_feature (33)..(38): Xaa can be any naturally occurring amino acid
  misc_feature (47)..(62): Xaa can be any naturally occurring amino acid
FFWRVQIDKKMGTPRWDKGFNWGRRLFFKVGSXXXXXXIRGLTGGEXXXXXXXXXXXXXXXXKGA

SEQ ID NO: 31606 - protein, 289 aa, Diabrotica virgifera
  misc_feature: Coding regions on vcDNA: vcDNA=SeqID_11303; Strand=+; Position=57-925
  misc_feature: Homolog annotation: Hit_ID=XP_395642.1; Match level="QueryCoverage =76%, HitCoverage=13%, E-value=5e-54, Identity=44%"; Hit description =similar to CCAAT/enhancer binding protein zeta; CCAAT-box-binding transcription factor [Apis
  misc_feature: Gene Ontology Annotation: Molecular function=molecular_function unknown; Cellular component=nucleolus; Biological process=ribosome biogenesis
  misc_feature (263)..(263): Xaa can be any naturally occurring amino acid
  misc_feature (277)..(277): Xaa can be any naturally occurring amino acid
MQSGNSNHYNVEDEMDNYEEPKQWYEEIQEDPKSFSKSTEQVLIELKDEAKKCHDSEVLHYNTKNSKTNSDFQWMKTVMSKGTLSDKIAAHTVMIQDNPVACLDTIRNLVGMVKVGKKKECTTVMETLTELFLSNLLIPNRKLKAFHQRPLSALNELSSGNAVSRRKILSYWYFEDQLKEIYATFVVALNAVAHDTVDSNKDKAVTALYKLLVDNSEQEKNLLTYIINKLGDPSQKIASKVIYCLTQLLYKHVNMQLVVLNEXEKLVFRPNISTRAXYYSLCFFVPSFI

SEQ ID NO: 31607 - protein, 62 aa, Diabrotica virgifera
  misc_feature: Coding regions on vcDNA: vcDNA=SeqID_11304; Strand=+; Position=95-280
  misc_feature (48)..(58): Xaa can be any naturally occurring amino acid
QRIFWGSHPNKMRPPGGKGYNWGAPILNSVAFKFYGLGVTAGGARGGXXXXXXXXXXXGAPR

SEQ ID NO: 31608 - protein, 73 aa, Diabrotica virgifera
  misc_feature: Coding regions on vcDNA: vcDNA=SeqID_11305; Strand=-; Position=2-220
  misc_feature (4)..(4): Xaa can be any naturally occurring amino acid
  misc_feature (10)..(18): Xaa can be any naturally occurring amino acid
  misc_feature (23)..(23): Xaa can be any naturally occurring amino acid
  misc_feature (30)..(37): Xaa can be any naturally occurring amino acid
  misc_feature (40)..(53): Xaa can be any naturally occurring amino acid
  misc_feature (59)..(72): Xaa can be any naturally occurring amino acid
IKIXLYIVLXXXXXXXXXDRNHXGLHRFKXXXXXXXXSNXXXXXXXXXXXXXXPTSRSXXXXXXXXXXXXXXV

SEQ ID NO: 31609 - protein, 121 aa, Diabrotica virgifera
  misc_feature: Coding regions on vcDNA: vcDNA=SeqID_11306; Strand=-; Position=2-364
  misc_feature (63)..(82): Xaa can be any naturally occurring amino acid
  misc_feature (110)..(110): Xaa can be any naturally occurring amino acid
  misc_feature (112)..(112): Xaa can be any naturally occurring amino acid
  misc_feature (117)..(117): Xaa can be any naturally occurring amino acid
CRSKETLLLIIIGIMSEEGVSDIDKRAAEVGEELLPPKSRKLYEQQCDAFKKWCRLKNVRQPXXXXXXXXXXXXXXXXXXXXLWAHYSMLKSVINIREDIDISTYGELLXFXKKRNXRQWR

SEQ ID NO: 31610 - protein, 34 aa, Diabrotica virgifera; identical to SEQ ID NO: 27603
  misc_feature: Coding regions on vcDNA: vcDNA=SeqID_11307; Strand=-; Position=80-184

SEQ ID NO: 31611 - protein, 70 aa, Diabrotica virgifera
  misc_feature: Coding regions on vcDNA: vcDNA=SeqID_11308; Strand=+; Position=2-214
PFPRRPPDFEIVSDLQLSRKVSTQGIFGFRPQRMKTTNIKPLSLSPRIKTRSFRLTSYNYNLSIDSNRII

SEQ ID NO: 31612 - protein, 76 aa, Diabrotica virgifera
  misc_feature: Coding regions on vcDNA: vcDNA=SeqID_11309; Strand=-; Position=721-951
  misc_feature (15)..(15): Xaa can be any naturally occurring amino acid
  misc_feature (43)..(43): Xaa can be any naturally occurring amino acid
EVFVALDVCRQIMKXLQGKNKTGCDLQKTRKLTALYIYLVQTXCINVSYKNTMEMNNHLMTSFHEYDYLTSGNDMD

SEQ ID NO: 31613 - protein, 38 aa, Diabrotica virgifera
  misc_feature: Coding regions on vcDNA: vcDNA=SeqID_11310; Strand=-; Position=1-114
  misc_feature (5)..(38): Xaa can be any naturally occurring amino acid
FINSXXXXXXXXXXXXXXXXXXXXXXXXXXXXXXXXXX

SEQ ID NO: 31614 - protein, 248 aa, Diabrotica virgifera
  misc_feature: Coding regions on vcDNA: vcDNA=SeqID_11311; Strand=-; Position=1-744
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(248): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31615 - protein, 307 aa, Diabrotica virgifera
  misc_feature: Coding regions on vcDNA: vcDNA=SeqID_11312; Strand=+; Position=1-921
  misc_feature (229)..(234): Xaa can be any naturally occurring amino acid
  misc_feature (272)..(272): Xaa can be any naturally occurring amino acid
  misc_feature (295)..(295): Xaa can be any naturally occurring amino acid
  misc_feature (298)..(298): Xaa can be any naturally occurring amino acid
DEESKMEKYLTTTSSLGSRLRQERRMLIEDEENLSSFLKKLSQCLTISDICSEINNAGITNKFSIGTLETLKSPNADIEEARSLVQEKCQNIITNRAAISLLLDDSKFDSNIKEFIDRFRIITDYPNVDELNIFLSKELGVTFQLLNSDLVTHLFQKEMLDFFKQYFKGRSDFLGKNKVKKFFISLNEKIHTLMTSGLNKAYPEKLKALDITLLHDLVCVNEFLKSNKXXXXXXTDSSRLASIHLLQTLENSNNFRAHDSFVFLRLRTFLLXDIEKLVINSFRSEKSHHFVIIEXTDXLLVDNTVWT

SEQ ID NO: 31616 - protein, 83 aa, Diabrotica virgifera
  misc_feature: Coding regions on vcDNA: vcDNA=SeqID_11313; Strand=-; Position=667-918
IECLYTLEIAEFHFFLALASIVQIIFVPAAFDTPLSDLTFWRTNVPVSFRSEFDICHQTFLEVVDLKQGSEIPLKVAATRGSV

SEQ ID NO: 31617 - protein, 49 aa, Diabrotica virgifera
  misc_feature: Coding regions on vcDNA: vcDNA=SeqID_11314; Strand=+; Position=2-148
  misc_feature (2)..(8): Xaa can be any naturally occurring amino acid
  misc_feature (25)..(33): Xaa can be any naturally occurring amino acid
KXXXXXXXRENPIQFSEFFFKVLLXXXXXXXXXTFLKLGVNKKNQLKLF

SEQ ID NO: 31618 - protein, 53 aa, Diabrotica virgifera
  misc_feature: Coding regions on vcDNA: vcDNA=SeqID_11315; Strand=-; Position=115-276
QYWWDSSYPFCKVEGDISISCLDCSSDPELYLSYLCFGNRPCFLLSNRAQFTN

SEQ ID NO: 31619 - protein, 108 aa, Diabrotica virgifera
  misc_feature: Coding regions on vcDNA: vcDNA=SeqID_11316; Strand=+; Position=177-503
  misc_feature (13)..(37): Xaa can be any naturally occurring amino acid
  misc_feature (39)..(60): Xaa can be any naturally occurring amino acid
  misc_feature (66)..(73): Xaa can be any naturally occurring amino acid
  misc_feature (75)..(93): Xaa can be any naturally occurring amino acid
  misc_feature (98)..(105): Xaa can be any naturally occurring amino acid
NYAVIPKVIYSYXXXXXXXXXXXXXXXXXXXXXXXXXPXXXXXXXXXXXXXXXXXXXXXXSIGSSXXXXXXXXFXXXXXXXXXXXXXXXXXXXPSFQXXXXXXXXMLP

SEQ ID NO: 31620 - protein, 219 aa, Diabrotica virgifera
  misc_feature: Coding regions on vcDNA: vcDNA=SeqID_11317; Strand=+; Position=195-850
  misc_feature: Homolog annotation: Hit_ID=XP_221957.2; Match level="QueryCoverage =98%, HitCoverage=11%, E-value=2e-56, Identity=51%"; Hit description =similar to D5Wsu45e protein [Rattus norvegicus]
  misc_feature: Gene Ontology Annotation: Molecular function=microtubule motor activity; Cellular component=cytoplasmic microtubule; Biological process=mitotic spindle assembly (sensu Saccharomyces)
  misc_feature: Pfam annotation: Pfam_ID=Kinesin; Match level="Score=56.6, E-value =2.1e-18, Copies=1"; Pfam description=Kinesin motor domain
  misc_feature (211)..(211): Xaa can be any naturally occurring amino acid
MMTPETPSSSGSDTSKPGCRSEERLMVAVRIRPLKQDESTRALYALNKKTIILEDADKSDAIRQKKGMEKQYSFDVVFGEDSTQEEVYKVTTKNLITDVLNGYNGTVFAYGPTGAGKTHTMVGTRSAPGIMIRALNDLFEAVKDKEDEYSVTMSYLEIYNEQIRDLLNPSSGFLELREDSKGKSMQVAGLSEVSTNSTDEIMQLLHKGNKXRTIEPTAM

SEQ ID NO: 31621 - protein, 73 aa, Diabrotica virgifera
  misc_feature: Coding regions on vcDNA: vcDNA=SeqID_11318; Strand=+; Position=219-440
KLNAYKCTIEMQRLSNIRKELDVIDLSKFLSGSTHLINESLSKFFPYIYTCYSTVIKFSFPSRNFASHLNLLY

SEQ ID NO: 31622 - protein, 45 aa, Diabrotica virgifera
  misc_feature: Coding regions on vcDNA: vcDNA=SeqID_11319; Strand=+; Position=1-138
  misc_feature (1)..(7): Xaa can be any naturally occurring amino acid
  misc_feature (26)..(32): Xaa can be any naturally occurring amino acid
XXXXXXXLYSYVSMNFILEIGAYRTXXXXXXXDRNQPVSRRIKLR

SEQ ID NO: 31623 - protein, 33 aa, Diabrotica virgifera
  misc_feature: Coding regions on vcDNA: vcDNA=SeqID_11320; Strand=-; Position=1-99
  misc_feature (2)..(32): Xaa can be any naturally occurring amino acid
TXXXXXXXXXXXXXXXXXXXXXXXXXXXXXXXK

SEQ ID NO: 31624 - protein, 76 aa, Diabrotica virgifera
  misc_feature: Coding regions on vcDNA: vcDNA=SeqID_11321; Strand=-; Position=2-229
  misc_feature (1)..(9): Xaa can be any naturally occurring amino acid
  misc_feature (17)..(17): Xaa can be any naturally occurring amino acid
  misc_feature (25)..(25): Xaa can be any naturally occurring amino acid
  misc_feature (33)..(40): Xaa can be any naturally occurring amino acid
  misc_feature (43)..(50): Xaa can be any naturally occurring amino acid
  misc_feature (55)..(55): Xaa can be any naturally occurring amino acid
  misc_feature (62)..(75): Xaa can be any naturally occurring amino acid
XXXXXXXXXGPFVLNIXNKLKIETXLAHTGLNXXXXXXXXSNXXXXXXXXPIINXNPTSRSXXXXXXXXXXXXXXV

SEQ ID NO: 31625 - protein, 74 aa, Diabrotica virgifera
  misc_feature: Coding regions on vcDNA: vcDNA=SeqID_11322; Strand=+; Position=34-257
  misc_feature: Homolog annotation: Hit_ID=CAH04342.1; Match level="QueryCoverage =89%, HitCoverage=50%, E-value=2e-16, Identity=64%"; Hit description =S23e ribosomal protein [Carabus granulatus]
  misc_feature (18)..(18): Xaa can be any naturally occurring amino acid
  misc_feature (34)..(34): Xaa can be any naturally occurring amino acid
MVIPRGLRTDRKHVNHRXRERRWYDKNYRKAHLXLLWKDNPFGGDSHDEGIVLQKEVSAILKSVRVQKITYLRT

SEQ ID NO: 31626 - protein, 54 aa, Diabrotica virgifera
  misc_feature: Coding regions on vcDNA: vcDNA=SeqID_11323; Strand=-; Position=193-357
LSPVLSQSSLSQYGVFWRVTCYFWSVYKFESSSATKYMSVRDVLEKKASEMNIF

SEQ ID NO: 31627 - protein, 81 aa, Diabrotica virgifera
  misc_feature: Coding regions on vcDNA: vcDNA=SeqID_11324; Strand=+; Position=174-419
PSTSNSPRRNLDYQLDLSITITMVYLRNIMHIIYIINSKKYYSLKYDMNGIIYLYDAPNTKTYYINMNKTKLTYQKDDLPP

SEQ ID NO: 31628 - protein, 66 aa, Diabrotica virgifera
  misc_feature: Coding regions on vcDNA: vcDNA=SeqID_11325; Strand=-; Position=305-505
IKNFSICSAEVLLSIWFRWFHDSIGNAAICSEVVNMGIVIWEIRHRLSSMERVKYIGMWTRSVVSV

SEQ ID NO: 31629 - protein, 209 aa, Diabrotica virgifera
  misc_feature: Coding regions on vcDNA: vcDNA=SeqID_11326; Strand=+; Position=2-631
  misc_feature: Homolog annotation: Hit_ID=EAL41003.1; Match level="QueryCoverage =97%, HitCoverage=88%, E-value=1e-22, Identity=31%"; Hit description =ENSANGP00000026624 [Anopheles gambiae str. PEST] ref|XP_558966.1| ENSANGP00000026624 [Anopheles gambiae st
  misc_feature: Pfam annotation: Pfam_ID=CBM_14; Match level="Score=148.3, E-value =1.8e-41, Copies=3"; Pfam description=Chitin binding Peritrophin-A domain
  misc_feature (34)..(39): Xaa can be any naturally occurring amino acid
ATFWPDPVNCSEYIECFAGKASIMECPPDLWWNXXXXXXDYKSNVDCKIDPSAPTEAPRTRATQATRPSDFTPDPNCPYPSDIITYDYVPGNCSEYYECDHGLRYLEKCPANRLWNHIKNYCDFPDEVDCSRAPVATTTPGSSTTPSQVCVGQKDGTLLPDEDDCAKYYECLRGQAIEFTCPDGTLWDQDEQVCDYPSRVDCKVTPKSF

SEQ ID NO: 31630 - protein, 287 aa, Diabrotica virgifera
  misc_feature: Coding regions on vcDNA: vcDNA=SeqID_11327; Strand=+; Position=69-929
  misc_feature (31)..(37): Xaa can be any naturally occurring amino acid
  misc_feature (41)..(205): Xaa can be any naturally occurring amino acid
  misc_feature (208)..(245): Xaa can be any naturally occurring amino acid
  misc_feature (247)..(285): Xaa can be any naturally occurring amino acid
IIMLKTDVLFLTQNNLLSLHLAYQRLFSNNXXXXXXXVTIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRGXXXXXXXXXXXXXXXXXXXXXXXXXXXXXXXXXXXXXXRXXXXXXXXXXXXXXXXXXXXXXXXXXXXXXXXXXXXXXXVI

SEQ ID NO: 31631 - protein, 94 aa, Diabrotica virgifera
  misc_feature: Coding regions on vcDNA: vcDNA=SeqID_11328; Strand=+; Position=118-402
RRTYRTLYIINLGSYNLIPPPELLLLTFSRKCSFPLLPNPTMNASSKTLLLPSPINVIVYLTIPTRLLSLLKIFSRYLHQTHIYPYTSLILVLL

SEQ ID NO: 31632 - protein, 230 aa, Diabrotica virgifera
  misc_feature: Coding regions on vcDNA: vcDNA=SeqID_11329; Strand=+; Position=1-690
  misc_feature (1)..(77): Xaa can be any naturally occurring amino acid
  misc_feature (80)..(111): Xaa can be any naturally occurring amino acid
  misc_feature (115)..(169): Xaa can be any naturally occurring amino acid
  misc_feature (175)..(206): Xaa can be any naturally occurring amino acid
  misc_feature (216)..(227): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXYLXXXXXXXXXXXXXXXXXXXXXXXXXXXXXXXXIKNXXXXXXXXXXXXXXXXXXXXXXXXXXXXXXXXXXXXXXXXXXXXXXXXXXXXXXXRIPQHXXXXXXXXXXXXXXXXXXXXXXXXXXXXXXXXRYRSIIISLXXXXXXXXXXXXILS

SEQ ID NO: 31633 - protein, 185 aa, Diabrotica virgifera
  misc_feature: Coding regions on vcDNA: vcDNA=SeqID_11330; Strand=+; Position=3-560
  misc_feature: Homolog annotation: Hit_ID=CAB39733.1; Match level="QueryCoverage =91%, HitCoverage=14%, E-value=1e-23, Identity=33%"; Hit description =protease, reverse transcriptase, ribonuclease H, integrase [Drosophila buzzatii]
  misc_feature: Pfam annotation: Pfam_ID=rve; Match level="Score=9.0, E-value=0.0019, Copies=1"; Pfam description=Integrase core domain
HASAQVLKAYHDSEEANHPGRDETIRAIKRFYYWPTLSKDVRNYVRPCTTCASIKRAPTQPTAPIVAREPRQPWKRVSFDVLGPYPAARGTRNRYILLATDCLSSWVEFRCVQTAKSRQIISFLQDEICSRWGKPTTIITDNGPQFRTDAWERFLRRNNIQAEFSPIYHQRANTISQRATTSSSA

SEQ ID NO: 31634 - protein, 57 aa, Diabrotica virgifera
  misc_feature: Coding regions on vcDNA: vcDNA=SeqID_11331; Strand=-; Position=1-171
  misc_feature (4)..(57): Xaa can be any naturally occurring amino acid
KNLXXXXXXXXXXXXXXXXXXXXXXXXXXXXXXXXXXXXXXXXXXXXXXXXXXXXXX

SEQ ID NO: 31635 - protein, 47 aa, Diabrotica virgifera
  misc_feature: Coding regions on vcDNA: vcDNA=SeqID_11332; Strand=+; Position=19-162
NKTTFYSNKQRKIISSDTSYILAREYHIFIENNFHLLVPCLSRLINE

SEQ ID NO: 31636 - protein, 254 aa, Diabrotica virgifera
  misc_feature: Coding regions on vcDNA: vcDNA=SeqID_11333; Strand=+; Position=1-762
  misc_feature (5)..(42): Xaa can be any naturally occurring amino acid
  misc_feature (44)..(107): Xaa can be any naturally occurring amino acid
  misc_feature (109)..(151): Xaa can be any naturally occurring amino acid
  misc_feature (154)..(176): Xaa can be any naturally occurring amino acid
  misc_feature (179)..(188): Xaa can be any naturally occurring amino acid
  misc_feature (192)..(198): Xaa can be any naturally occurring amino acid
  misc_feature (200)..(233): Xaa can be any naturally occurring amino acid
  misc_feature (238)..(251): Xaa can be any naturally occurring amino acid
HFIYXXXXXXXXXXXXXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXXXXXXXXXXXXXXISXXXXXXXXXXXXXXXXXXXXXXXLNXXXXXXXXXXLIKXXXXXXXYXXXXXXXXXXXXXXXXXXXXXXXXXXXXXXXXXXLDERXXXXXXXXXXXXXXLHS

SEQ ID NO: 31637 - protein, 120 aa, Diabrotica virgifera
  misc_feature: Coding regions on vcDNA: vcDNA=SeqID_11334; Strand=+; Position=2-364
  misc_feature (17)..(34): Xaa can be any naturally occurring amino acid
  misc_feature (40)..(48): Xaa can be any naturally occurring amino acid
PPPSPPTFLYLKLIQYXXXXXXXXXXXXXXXXXXRAYFIXXXXXXXXXPLSLLHYQLLIIHLLLPNLHHLKTSNSYCTFSIPPNFFAMPCYLVFKSLSFLQTSTQFIHQQYIYTQISFHS

SEQ ID NO: 31638 - protein, 159 aa, Diabrotica virgifera
  misc_feature: Coding regions on vcDNA: vcDNA=SeqID_11335; Strand=+; Position=3-481
  misc_feature: Homolog annotation: Hit_ID=NP_608540.1; Match level="QueryCoverage =100%, HitCoverage=60%, E-value=2e-14, Identity=24%"; Hit description= CG2839-PA [Drosophila melanogaster] gb|AAF51469.2| CG2839-PA [Drosophila melanogaster]
  misc_feature (88)..(88): Xaa can be any naturally occurring amino acid
  misc_feature (155)..(155): Xaa can be any naturally occurring amino acid
RNAQGEEKREEPHRINHTQKHKQQPQRRQSHRREKQDTGRRTPPKQRDKGRRNPRKKRHTEGGQRERKTTEPAKRKKETRSEQKETRXKEEQKRQNSAQAQHEPQPNPKDEQAGTDNNNRKEQSQNREKPTRAASPRRGRQTGKNNREPNKTNDXKTAS

SEQ ID NO: 31639 - protein, 149 aa, Diabrotica virgifera
  misc_feature: Coding regions on vcDNA: vcDNA=SeqID_11336; Strand=+; Position=377-823
NVRYQIFPAVVAFLVNNISGSLASVQNISLPVTLRITRGPDGRDRAVISDTNEDTDSETPEKSVDCLVLFEPEDIDIDVIFLHGLHGAINKTWKQGVWRTSSHKLNKQSPVRRLSTGDMYVPTKDHTLKRTISSIYSKIPNKVARKEYN

SEQ ID NO: 31640 - protein, 213 aa, Diabrotica virgifera
  misc_feature: Coding regions on vcDNA: vcDNA=SeqID_11337; Strand=+; Position=232-870
  misc_feature: Homolog annotation: Hit_ID=XP_311460.1; Match level="QueryCoverage =90%, HitCoverage=80%, E-value=1e-24, Identity=33%"; Hit description =ENSANGP00000022421 [Anopheles gambiae]
  misc_feature: Pfam annotation: Pfam_ID=HTH_psq; Match level="Score=33.7, E-value =5.4e-07, Copies=1"; Pfam description=helix-turn-helix, Psq domain
  misc_feature (110)..(117): Xaa can be any naturally occurring amino acid
MPKTKKIGTRQFFSYSEDDLKKAIEAVTQNGISRKAAARQFNVPRTTLIRKLYSPATTPRKMGPATELSEAEENVFENWVLAMARKGFPIHRQNLMLSVKKFLEETGREXXXXXXXXPGRSWFQGFLKRHPKIKERYPEAVSKARAAVTQDRIEAWFDEIQLFLEEDRYDEILLDPTRVFHADEAGFCLCPKSEKVLGPVGYKEDFYIVSSGK

SEQ ID NO: 31641 - protein, 66 aa, Diabrotica virgifera; identical to SEQ ID NO: 26808
  misc_feature: Coding regions on vcDNA: vcDNA=SeqID_11338; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 31642 - protein, 91 aa, Diabrotica virgifera
  misc_feature: Coding regions on vcDNA: vcDNA=SeqID_11339; Strand=+; Position=37-312
DVESNWERAYKGYLPAILLLLSDYQTLYIINISSYNLSPVTNLLRNNFSPIMLYSPISFQTIIGTWKSIVGFLRSNVYRYLILEQKESIYE

SEQ ID NO: 31643 - protein, 107 aa, Diabrotica virgifera
  misc_feature: Coding regions on vcDNA: vcDNA=SeqID_11340; Strand=+; Position=122-445
  misc_feature (5)..(11): Xaa can be any naturally occurring amino acid
  misc_feature (29)..(48): Xaa can be any naturally occurring amino acid
REILXXXXXXXTVREYSIFIKEIFISSHXXXXXXXXXXXXXXXXXXXXSQNTKIFIEQSIFYIPLLECNVYSLLNISTFLKYTLNSFINCIFILQYSYIINIHDSPG

SEQ ID NO: 31644 - protein, 126 aa, Diabrotica virgifera
  misc_feature: Coding regions on vcDNA: vcDNA=SeqID_11341; Strand=-; Position=370-751
  misc_feature: Homolog annotation: Hit_ID=EAL39448.1; Match level="QueryCoverage =63%, HitCoverage=23%, E-value=4e-13, Identity=47%"; Hit description =ENSANGP00000028866 [Anopheles gambiae str. PEST] ref|XP_554658.1| ENSANGP00000028866 [Anopheles gambiae st
  misc_feature (30)..(30): Xaa can be any naturally occurring amino acid
  misc_feature (59)..(59): Xaa can be any naturally occurring amino acid
SAVKCIIGHSECPYIRAHGFMYIRDSFPTXSLVECSEDHLEHEEELDVTSGGGRNMATXVMVQQSLIKLECFSALLDRIPLPHSSKTSESYRGSFTSTFRPSSFRKSERSPRIRTRQPLSQSISVR

SEQ ID NO: 31645 - protein, 49 aa, Diabrotica virgifera
  misc_feature: Coding regions on vcDNA: vcDNA=SeqID_11342; Strand=+; Position=417-566
TFSYLNKCSYLFMYIVDVNFIYVFYENISLNNFNDDTDDSISINNSQIY

SEQ ID NO: 31646 - protein, 68 aa, Diabrotica virgifera
  misc_feature: Coding regions on vcDNA: vcDNA=SeqID_11343; Strand=-; Position=47-253
ITHCHHPRPPENVVQLRPRLEAYRASTKGRIPPLIYSMINRFRSVVAGRWCVILTIEMSCFSFLRCHF

SEQ ID NO: 31647 - protein, 67 aa, Diabrotica virgifera
  misc_feature: Coding regions on vcDNA: vcDNA=SeqID_11344; Strand=-; Position=457-660
  misc_feature (18)..(23): Xaa can be any naturally occurring amino acid
  misc_feature (36)..(64): Xaa can be any naturally occurring amino acid
YSCYNQLYSYDSNIVGRXXXXXXVIFNNITMLSLRXXXXXXXXXXXXXXXXXXXXXXXXXXXXXSPN

SEQ ID NO: 31648 - protein, 97 aa, Diabrotica virgifera
  misc_feature: Coding regions on vcDNA: vcDNA=SeqID_11345; Strand=-; Position=2-292
  misc_feature (1)..(14): Xaa can be any naturally occurring amino acid
  misc_feature (27)..(39): Xaa can be any naturally occurring amino acid
  misc_feature (41)..(48): Xaa can be any naturally occurring amino acid
  misc_feature (50)..(97): Xaa can be any naturally occurring amino acid
XXXXXXXXXXXXXXLRKFKLSNIIIRXXXXXXXXXXXXXRXXXXXXXXNXXXXXXXXXXXXXXXXXXXXXXXXXXXXXXXXXXXXXXXXXXXXXXXX

SEQ ID NO: 31649 - protein, 80 aa, Diabrotica virgifera
  misc_feature: Coding regions on vcDNA: vcDNA=SeqID_11346; Strand=-; Position=3-242
  misc_feature (16)..(26): Xaa can be any naturally occurring amino acid
  misc_feature (39)..(80): Xaa can be any naturally occurring amino acid
SKKIWIYNNYLIKYYXXXXXXXXXXXITSNKINVIISIXXXXXXXXXXXXXXXXXXXXXXXXXXXXXXXXXXXXXXXXXX

SEQ ID NO: 31650 - protein, 147 aa, Diabrotica virgifera
  misc_feature: Coding regions on vcDNA: vcDNA=SeqID_11347; Strand=-; Position=80-523
  misc_feature: Homolog annotation: Hit_ID=NP_524426.2; Match level="QueryCoverage =85%, HitCoverage=23%, E-value=1e-21, Identity=44%"; Hit description =CG3637-PA [Drosophila melanogaster] gb|AAF55840.1| CG3637-PA [Drosophila melanogaster]
  misc_feature: Gene Ontology Annotation: Molecular function=ATP binding; Cellular component=DNA-directed RNA polymerase II, core complex; Biological process=intracellular signaling cascade
  misc_feature: Pfam annotation: Pfam_ID=SH3_1; Match level="Score=38.0, E-value=2.8e- 08, Copies=1"; Pfam description=SH3 domain
  misc_feature (97)..(103): Xaa can be any naturally occurring amino acid
MKFAQNEETENEKQQSMMQEELELLRQLQQQKPDDSDSDDIYENFDVSTIKRGKPSASTAPAEEMTPTEPEPAATPQETEEEYQEEIVDTGITAVAXXXXXXXAEDEISFDPDDVITHIDKIDAGWWRGLCKNRYGLFPANYVQCDE

SEQ ID NO: 31651 - protein, 117 aa, Diabrotica virgifera
  misc_feature: Coding regions on vcDNA: vcDNA=SeqID_11348; Strand=-; Position=0-350
  misc_feature (1)..(16): Xaa can be any naturally occurring amino acid
  misc_feature (29)..(52): Xaa can be any naturally occurring amino acid
  misc_feature (62)..(71): Xaa can be any naturally occurring amino acid
  misc_feature (81)..(111): Xaa can be any naturally occurring amino acid
XXXXXXXXXXXXXXXXLSNNFIKVYRVLXXXXXXXXXXXXXXXXXXXXXXXXFFIAILTFTXXXXXXXXXXSLARSKYRVXXXXXXXXXXXXXXXXXXXXXXXXXXXXXXXRARGRG

SEQ ID NO: 31652 - protein, 116 aa, Diabrotica virgifera
  misc_feature: Coding regions on vcDNA: vcDNA=SeqID_11349; Strand=+; Position=1-351
DTPGGTAPECPALPTRRFLICYYHRCVPYFRSAIKPSSHNSRKRATYILLAIRLFKKDGRPTRTMIHRLLMMFKITSNETHRYLLPARQNTTYLAVPSLACIPYCSLMQMNPPYTG

SEQ ID NO: 31653 - protein, 294 aa, Diabrotica virgifera
  misc_feature: Coding regions on vcDNA: vcDNA=SeqID_11350; Strand=-; Position=0-881
  misc_feature (3)..(15): Xaa can be any naturally occurring amino acid
  misc_feature (18)..(226): Xaa can be any naturally occurring amino acid
  misc_feature (228)..(278): Xaa can be any naturally occurring amino acid
  misc_feature (280)..(290): Xaa can be any naturally occurring amino acid
FIXXXXXXXXXXXXXACXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXXXXXXXXXXXXXXXXXXXXXXVXXXXXXXXXXXRGKG

SEQ ID NO: 31654 - protein, 87 aa, Diabrotica virgifera
  misc_feature: Coding regions on vcDNA: vcDNA=SeqID_11351; Strand=+; Position=575-835
  misc_feature (70)..(87): Xaa can be any naturally occurring amino acid
YIIEKFLKSYFTFILIYIKFILYLFRKLCFLRYCIQYCHTCHLLCVRLLFLYEKIQQIIKIIEFEVLYLXXXXXXXXXXXXXXXXXX

SEQ ID NO: 31655 - protein, 85 aa, Diabrotica virgifera
  misc_feature: Coding regions on vcDNA: vcDNA=SeqID_11352; Strand=+; Position=354-611
  misc_feature (41)..(47): Xaa can be any naturally occurring amino acid
  misc_feature (76)..(83): Xaa can be any naturally occurring amino acid
GSPSGGFCSYSSASDYHMGRNLVPCKCTSTIYWLLIQGSSXXXXXXXKKSILRKTPNHQIKIRSVKYMQNDCWKWXXXXXXXXHH

SEQ ID NO: 31656 - protein, 73 aa, Diabrotica virgifera
  misc_feature: Coding regions on vcDNA: vcDNA=SeqID_11353; Strand=-; Position=168-389
VRYLDAGISVLKVTRVKRRVRETGGTPCIPFWNTCYITLLHNIVLKGHHLVPIYWITVDEIVVIICSGGAGLP

SEQ ID NO: 31657 - protein, 93 aa, Diabrotica virgifera
  misc_feature: Coding regions on vcDNA: vcDNA=SeqID_11354; Strand=-; Position=193-474
  misc_feature (47)..(53): Xaa can be any naturally occurring amino acid
WSTGVASLMLTIFFQMMSVAQSGISKVFSSVVILEVWCEWSSIVSIXXXXXXXDGAILSRLEQSGAGRRRFRCLFSIKQTSSSSKEVDRRGHG

SEQ ID NO: 31658 - protein, 45 aa, Diabrotica virgifera
  misc_feature: Coding regions on vcDNA: vcDNA=SeqID_11355; Strand=+; Position=1-135
  misc_feature (4)..(39): Xaa can be any naturally occurring amino acid
  misc_feature (41)..(45): Xaa can be any naturally occurring amino acid
MDDXXXXXXXXXXXXXXXXXXXXXXXXXXXXXXXXXXXXAXXXXX

SEQ ID NO: 31659 - protein, 110 aa, Diabrotica virgifera
  misc_feature: Coding regions on vcDNA: vcDNA=SeqID_11356; Strand=-; Position=1-330
  misc_feature (8)..(15): Xaa can be any naturally occurring amino acid
  misc_feature (45)..(105): Xaa can be any naturally occurring amino acid
IHSESNNXXXXXXXXLCLLPNIFSLQINYTKYLFSNKNFNSLTLXXXXXXXXXXXXXXXXXXXXXXXXXXXXXXXXXXXXXXXXXXXXXXXXXXXXXXXXXXXXXGARGE

SEQ ID NO: 31660 - protein, 177 aa, Diabrotica virgifera
  misc_feature: Coding regions on vcDNA: vcDNA=SeqID_11357; Strand=+; Position=123-655
  misc_feature: Homolog annotation: Hit_ID=EAL26086.1; Match level="QueryCoverage =85%, HitCoverage=27%, E-value=3e-32, Identity=48%"; Hit description =GA20931-PA [Drosophila pseudoobscura]
  misc_feature: Gene Ontology Annotation: Molecular function=glucose-6-phosphate isomerase activity; Cellular component=cytosol; Biological process =neurogenesis
  misc_feature (46)..(46): Xaa can be any naturally occurring amino acid
  misc_feature (57)..(57): Xaa can be any naturally occurring amino acid
  misc_feature (91)..(91): Xaa can be any naturally occurring amino acid
  misc_feature (98)..(98): Xaa can be any naturally occurring amino acid
  misc_feature (127)..(127): Xaa can be any naturally occurring amino acid
  misc_feature (148)..(148): Xaa can be any naturally occurring amino acid
IKHQGPLSKVILHPNDGNILIDISKHRIDEKGINLLIELDQSRIVXSALHAMIKGTXINYTENTAVLLNPKRNTTKLPIIVDVKHDTTEVXAVLNHMXSFIEKLLSGAWIGYSAKQITDDDNLAIGXSNEGPLMATESLKSYSKRLYXHICTHLDGTYLADELQKDIPHSDLASICI

SEQ ID NO: 31661 - protein, 53 aa, Diabrotica virgifera
  misc_feature: Coding regions on vcDNA: vcDNA=SeqID_11358; Strand=+; Position=75-236
  misc_feature (4)..(10): Xaa can be any naturally occurring amino acid
  misc_feature (38)..(50): Xaa can be any naturally occurring amino acid
KNNXXXXXXXTEILFDYIYIFILKIQFIYNHYLYTYIXXXXXXXXXXXXXHRT

SEQ ID NO: 31662 - protein, 175 aa, Diabrotica virgifera
  misc_feature: Coding regions on vcDNA: vcDNA=SeqID_11359; Strand=+; Position=105-633
  misc_feature: Homolog annotation: Hit_ID=AAV88596.1; Match level="QueryCoverage =96%, HitCoverage=54%, E-value=3e-70, Identity=69%"; Hit description =Sparc [Schistocerca gregaria]
  misc_feature: Gene Ontology Annotation: Molecular function=calcium ion binding; Cellular component=extracellular matrix; Biological process =ossification
  misc_feature (31)..(31): Xaa can be any naturally occurring amino acid
  misc_feature (38)..(38): Xaa can be any naturally occurring amino acid
  misc_feature (45)..(45): Xaa can be any naturally occurring amino acid
  misc_feature (64)..(64): Xaa can be any naturally occurring amino acid
MREPEESRRKECSIYIESWSSDCAIYQQRCXCAKGDQXCKGPQYXHVHIEYYGQCTEMPHCTQXEMADFPRIMRDCLFNIMRDLTDRQELTPHYMNMEKEAESNMTRRWTNAAVWKFCDLDGNPPDRSVSRHELFPILAPLMSLEHCIIPFLNSCDADNNHRITLHEWVKCLLLV

SEQ ID NO: 31663 - protein, 322 aa, Diabrotica virgifera
  misc_feature: Coding regions on vcDNA: vcDNA=SeqID_11360; Strand=+; Position=1-969
  misc_feature (3)..(10): Xaa can be any naturally occurring amino acid
  misc_feature (23)..(302): Xaa can be any naturally occurring amino acid
  misc_feature (308)..(319): Xaa can be any naturally occurring amino acid
SYXXXXXXXXYRSGHPPVFPRPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLYIMXXXXXXXXXXXXTFI

SEQ ID NO: 31664 - protein, 300 aa, Diabrotica virgifera
  misc_feature: Coding regions on vcDNA: vcDNA=SeqID_11361; Strand=+; Position=3-902
  misc_feature (38)..(57): Xaa can be any naturally occurring amino acid
  misc_feature (65)..(122): Xaa can be any naturally occurring amino acid
  misc_feature (126)..(204): Xaa can be any naturally occurring amino acid
  misc_feature (208)..(231): Xaa can be any naturally occurring amino acid
  misc_feature (238)..(271): Xaa can be any naturally occurring amino acid
  misc_feature (273)..(295): Xaa can be any naturally occurring amino acid
APDFNIIKYSFSLSIEKSHLIDPQFAICDQHIFINYNXXXXXXXXXXXXXXXXXXXXHYFQIQKXXXXXXXXXXXXXXXXXXXXXXXXXXXXXXXXXXXXXXXXXXXXXXXXXXXXXXXXXXDELXXXXXXXXXXXXXXXXXXXXXXXXXXXXXXXXXXXXXXXXXXXXXXXXXXXXXXXXXXXXXXXXXXXXXXXXXXXXXXXLTCXXXXXXXXXXXXXXXXXXXXXXXXHFDRANXXXXXXXXXXXXXXXXXXXXXXXXXXXXXXXXXXTXXXXXXXXXXXXXXXXXXXXXXXSNLFI

SEQ ID NO: 31665 - protein, 223 aa, Diabrotica virgifera
  misc_feature: Coding regions on vcDNA: vcDNA=SeqID_11362; Strand=+; Position=136-804
  misc_feature (2)..(77): Xaa can be any naturally occurring amino acid
  misc_feature (84)..(108): Xaa can be any naturally occurring amino acid
  misc_feature (124)..(136): Xaa can be any naturally occurring amino acid
  misc_feature (147)..(154): Xaa can be any naturally occurring amino acid
  misc_feature (156)..(174): Xaa can be any naturally occurring amino acid
  misc_feature (208)..(221): Xaa can be any naturally occurring amino acid
NXXXXXXXXXXXXXXXXXXXXXXXXXXXXXXXXXXXXXXXXXXXXXXXXXXXXXXXXXXXXXXXXXXXXXXXXXXXXTNNFHIXXXXXXXXXXXXXXXXXXXXXXXXXKLFNFSTDDSISINKXXXXXXXXXXXXXLCNIFFTCLLXXXXXXXXIXXXXXXXXXXXXXXXXXXXVASSLLILLYAGMKGWMQTHCLYFIYKEFYCYVXXXXXXXXXXXXXXFI

SEQ ID NO: 31666 - protein, 70 aa, Diabrotica virgifera
  misc_feature: Coding regions on vcDNA: vcDNA=SeqID_11363; Strand=-; Position=0-209
  misc_feature (3)..(11): Xaa can be any naturally occurring amino acid
  misc_feature (33)..(46): Xaa can be any naturally occurring amino acid
  misc_feature (52)..(65): Xaa can be any naturally occurring amino acid
PFXXXXXXXXXIEIYLTHSGLNSDHVKFYESNXXXXXXXXXXXXXXPTSRSXXXXXXXXXXXXXXVIRKV

SEQ ID NO: 31667 - protein, 46 aa, Diabrotica virgifera
  misc_feature: Coding regions on vcDNA: vcDNA=SeqID_11364; Strand=+; Position=68-208
CNVTSTIKAYINIITNDSVPGFIVLIMYNNTTRVITMVYGQSKLQH

SEQ ID NO: 31668 - protein, 72 aa, Diabrotica virgifera
  misc_feature: Coding regions on vcDNA: vcDNA=SeqID_11365; Strand=+; Position=526-741
NLMRMNKCMLSVYLIKHCTTIYYSSALYITDDMAQDTYVVLTTSINFESRLINNIIDVKNIRVRGSKIDFDR

SEQ ID NO: 31669 - protein, 219 aa, Diabrotica virgifera
  misc_feature: Coding regions on vcDNA: vcDNA=SeqID_11366; Strand=+; Position=25-684
  misc_feature: Homolog annotation: Hit_ID=AAV88596.1; Match level="QueryCoverage =85%, HitCoverage=59%, E-value=1e-81, Identity=68%"; Hit description =Sparc [Schistocerca gregaria]
  misc_feature: Gene Ontology Annotation: Molecular function=calcium ion binding; Cellular component=extracellular matrix; Biological process =ossification
MPHCTQEEMADFPRRMRDWLFNIMREPEPEESESRRKVCSNYNETWSSDCAIYQQRCLCAKGDQECKGPQYKHVHIEYYGQCTEMPHCTQEEMVDFPRRMRDWLFNIMRDLADRQELTPHYMNMEKEAESNMTRRWTNAAVWKFCDLDGNPPDRSVSRHELFPILAPLMSLEHCISPFLNSCDADNNHIITLHEWVKCLRLEEEDIEHQCEEISDISAE

SEQ ID NO: 31670 - protein, 135 aa, Diabrotica virgifera
  misc_feature: Coding regions on vcDNA: vcDNA=SeqID_11367; Strand=-; Position=499-906
  misc_feature (8)..(8): Xaa can be any naturally occurring amino acid
FIIASHVXRSCTATSHRLTPIFSRSPLSTFSMPSYRPSPPGLLFALKGYPSVKVGDSHTCVGISTIKSTAPIVLKICMSIYYSRCASTWKGKRETTLRESRRNIATILNNSYCQIDVYFILSVSEAEKLYIAPQY

SEQ ID NO: 31671 - protein, 164 aa, Diabrotica virgifera
  misc_feature: Coding regions on vcDNA: vcDNA=SeqID_11368; Strand=+; Position=92-587
  misc_feature: Homolog annotation: Hit_ID=AAR30199.1; Match level="QueryCoverage =98%, HitCoverage=34%, E-value=5e-38, Identity=54%"; Hit description =LP10071p [Drosophila melanogaster] ref|NP_725085.1| CG8280-PB, isoform B [Drosophila melanogaster] ref|NP_
  misc_feature: Gene Ontology Annotation: Molecular function=translation factor activity, nucleic acid binding
  misc_feature: Pfam annotation: Pfam_ID=GTP_EFTU; Match level="Score=-55.7, E-value =0.0053, Copies=1"; Pfam description=Elongation factor Tu GTP binding domai
  misc_feature (40)..(40): Xaa can be any naturally occurring amino acid
  misc_feature (68)..(68): Xaa can be any naturally occurring amino acid
  misc_feature (100)..(100): Xaa can be any naturally occurring amino acid
  misc_feature (123)..(123): Xaa can be any naturally occurring amino acid
  misc_feature (132)..(132): Xaa can be any naturally occurring amino acid
MTEEKILINLMVIVPINPVKSTTTAHLINKRGVIYKQTIXHFQKESQELGRSTFKHAWILYKLKDIIXSGITFDIDILKIKTLKYYETIIYEPKHRDSIXNMITVTSQNDRIVHIVATDTDEXETCISNNGXIKEYVLIAYNLTVKHLIISVNNMYSSEPLYIQ

SEQ ID NO: 31672 - protein, 71 aa, Diabrotica virgifera
  misc_feature: Coding regions on vcDNA: vcDNA=SeqID_11369; Strand=-; Position=53-268
MTSGGSVGAVVSIPHGTSVYGAGGEAGSENKGVLSLSLPHISRGSLAILHHHKLCMSSTLTVSKYTISSKV

SEQ ID NO: 31673 - protein, 75 aa, Diabrotica virgifera
  misc_feature: Coding regions on vcDNA: vcDNA=SeqID_11370; Strand=-; Position=746-973
  misc_feature (43)..(43): Xaa can be any naturally occurring amino acid
KINLHGKHFSFLYLVGPVGWYVLNFDFCGLFHTNYYWRLLFYXATNCIIIQKLNIEHAFGIFSVNSLSFPEFTYK

SEQ ID NO: 31674 - protein, 132 aa, Diabrotica virgifera
  misc_feature: Coding regions on vcDNA: vcDNA=SeqID_11371; Strand=-; Position=2-397
  misc_feature (4)..(19): Xaa can be any naturally occurring amino acid
  misc_feature (26)..(40): Xaa can be any naturally occurring amino acid
  misc_feature (49)..(56): Xaa can be any naturally occurring amino acid
  misc_feature (66)..(100): Xaa can be any naturally occurring amino acid
  misc_feature (103)..(132): Xaa can be any naturally occurring amino acid
ITAXXXXXXXXXXXXXXXXGDDFIQXXXXXXXXXXXXXXXRNKTLYKLXXXXXXXXQPFIAAFNRXXXXXXXXXXXXXXXXXXXXXXXXXXXXXXXXXXXNNXXXXXXXXXXXXXXXXXXXXXXXXXXXXXX

SEQ ID NO: 31675 - protein, 85 aa, Diabrotica virgifera
  misc_feature: Coding regions on vcDNA: vcDNA=SeqID_11372; Strand=+; Position=185-442
  misc_feature (8)..(16): Xaa can be any naturally occurring amino acid
  misc_feature (28)..(38): Xaa can be any naturally occurring amino acid
  misc_feature (41)..(48): Xaa can be any naturally occurring amino acid
AHTYNLIXXXXXXXXXDDKFSSSTISIXXXXXXXXXXXLIXXXXXXXXQSFILINDANIIYTTIEYLIYIYYISKIIDFIFFTCS

SEQ ID NO: 31676 - protein, 215 aa, Diabrotica virgifera
  misc_feature: Coding regions on vcDNA: vcDNA=SeqID_11373; Strand=-; Position=3-647
  misc_feature (16)..(64): Xaa can be any naturally occurring amino acid
  misc_feature (68)..(105): Xaa can be any naturally occurring amino acid
  misc_feature (107)..(215): Xaa can be any naturally occurring amino acid
KNVMIMLPSTVKIQRXXXXXXXXXXXXXXXXXXXXXXXXXXXXXXXXXXXXXXXXXXXXXXXXXLIIXXXXXXXXXXXXXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31677 - protein, 122 aa, Diabrotica virgifera
  misc_feature: Coding regions on vcDNA: vcDNA=SeqID_11374; Strand=-; Position=298-666
  misc_feature (16)..(22): Xaa can be any naturally occurring amino acid
  misc_feature (24)..(31): Xaa can be any naturally occurring amino acid
  misc_feature (33)..(58): Xaa can be any naturally occurring amino acid
  misc_feature (71)..(86): Xaa can be any naturally occurring amino acid
  misc_feature (88)..(105): Xaa can be any naturally occurring amino acid
  misc_feature (108)..(117): Xaa can be any naturally occurring amino acid
SGGENDVECNSHLLIXXXXXXXIXXXXXXXXIXXXXXXXXXXXXXXXXXXXXXXXXXXYHIILYEYEIFFXXXXXXXXXXXXXXXXKXXXXXXXXXXXXXXXXXXIMXXXXXXXXXXDIRYI

SEQ ID NO: 31678 - protein, 61 aa, Diabrotica virgifera
  misc_feature: Coding regions on vcDNA: vcDNA=SeqID_11375; Strand=-; Position=2-184
SLYLGQEDSYPINSQTYLSSVKRSFKIMFKSNIDISHYVPIYTVYIAHNRLVLIIWPHNFS

SEQ ID NO: 31679 - protein, 111 aa, Diabrotica virgifera
  misc_feature: Coding regions on vcDNA: vcDNA=SeqID_11376; Strand=+; Position=385-720
  misc_feature (6)..(18): Xaa can be any naturally occurring amino acid
  misc_feature (23)..(31): Xaa can be any naturally occurring amino acid
  misc_feature (57)..(63): Xaa can be any naturally occurring amino acid
  misc_feature (68)..(74): Xaa can be any naturally occurring amino acid
  misc_feature (80)..(95): Xaa can be any naturally occurring amino acid
NPLFHXXXXXXXXXXXXXPSFIXXXXXXXXXINSLLQYKFTLFKFSTADNITITPLXXXXXXXGPTNXXXXXXXSPVYYXXXXXXXXXXXXXXXXTLNGRGILTALRYHNH

SEQ ID NO: 31680 - protein, 53 aa, Diabrotica virgifera
  misc_feature: Coding regions on vcDNA: vcDNA=SeqID_11377; Strand=-; Position=1-159
  misc_feature (2)..(23): Xaa can be any naturally occurring amino acid
  misc_feature (25)..(53): Xaa can be any naturally occurring amino acid
KXXXXXXXXXXXXXXXXXXXXXXAXXXXXXXXXXXXXXXXXXXXXXXXXXXXX

SEQ ID NO: 31681 - protein, 227 aa, Diabrotica virgifera
  misc_feature: Coding regions on vcDNA: vcDNA=SeqID_11378; Strand=+; Position=2-687
  misc_feature: Homolog annotation: Hit_ID=AAL16466.1; Match level="QueryCoverage =96%, HitCoverage=50%, E-value=2e-37, Identity=40%"; Hit description =cytochrome c oxidase subunit I [Hypseleotris compressa]
  misc_feature: Pfam annotation: Pfam_ID=COX1; Match level="Score=-261.4, E-value =0.023, Copies=1"; Pfam description=Cytochrome C and Quinol oxidase polype
  misc_feature (11)..(11): Xaa can be any naturally occurring amino acid
  misc_feature (21)..(29): Xaa can be any naturally occurring amino acid
  misc_feature (77)..(77): Xaa can be any naturally occurring amino acid
  misc_feature (106)..(106): Xaa can be any naturally occurring amino acid
  misc_feature (115)..(115): Xaa can be any naturally occurring amino acid
  misc_feature (148)..(148): Xaa can be any naturally occurring amino acid
  misc_feature (176)..(176): Xaa can be any naturally occurring amino acid
  misc_feature (186)..(186): Xaa can be any naturally occurring amino acid
REIYETLYLIXGIRAGMVGTXXXXXXXXXLGRPGSLIGNDQIYNDIGTAHGLIIIYNIVLPIISGGNGNRRGPIIYXAPDITFPLIHNIRFRLLPPTLVIITIFNXINWSNNKIXTERNLNTSIYDPNEEGDPILYHKGSRFYGHPEXYIIILPRLGSISHTVREERRKTRPLETXRITYDTISEXLTRSTAGAQHIRTAAMDVDTRGYITSATRIIAGPTAIRASR

SEQ ID NO: 31682 - protein, 89 aa, Diabrotica virgifera
  misc_feature: Coding regions on vcDNA: vcDNA=SeqID_11379; Strand=-; Position=127-396
LGDSWNYCNINEYPRLFFSVTIDSNLRGEIAKSCPYICYSCMHFSQFNSVEYMYHHYFVSSLLMLQSHLYSFRTQLFAGDQTFRARLML

SEQ ID NO: 31683 - protein, 117 aa, Diabrotica virgifera
  misc_feature: Coding regions on vcDNA: vcDNA=SeqID_11380; Strand=+; Position=243-596
  misc_feature: Homolog annotation: Hit_ID=AAC64004.1; Match level="QueryCoverage =95%, HitCoverage=25%, E-value=5e-12, Identity=41%"; Hit description =prophenol oxidase activating enzyme precursor [Manduca sexta]
  misc_feature (73)..(73): Xaa can be any naturally occurring amino acid
FSTTRNPPSNPVGNSNPQRRVLPAYFTTNLALPDTSTCGFQKSDENYNSKGLIYGREKTELKYFPWMALLSYXTRYETTKCACVGTLISHIYILTAAHCDTGEDSTAVGLLTIRLIG

SEQ ID NO: 31684 - protein, 75 aa, Diabrotica virgifera
  misc_feature: Coding regions on vcDNA: vcDNA=SeqID_11381; Strand=+; Position=3-227
  misc_feature (11)..(24): Xaa can be any naturally occurring amino acid
  misc_feature (31)..(43): Xaa can be any naturally occurring amino acid
  misc_feature (46)..(53): Xaa can be any naturally occurring amino acid
  misc_feature (63)..(74): Xaa can be any naturally occurring amino acid
PSRVRYLRDNXXXXXXXXXXXXXXATSMLDXXXXXXXXXXXXXCSXXXXXXXXSLNRCEPGWXXXXXXXXXXXXK

SEQ ID NO: 31685 - protein, 60 aa, Diabrotica virgifera
  misc_feature: Coding regions on vcDNA: vcDNA=SeqID_11382; Strand=+; Position=161-343
HTLFHTSHSYYRHRHMLPAKAIDMVNISYLLSSGGYSKRTPITQTICRAPERYLHKVDIH

SEQ ID NO: 31686 - protein, 50 aa, Diabrotica virgifera
  misc_feature: Coding regions on vcDNA: vcDNA=SeqID_11383; Strand=+; Position=265-417
  misc_feature (34)..(34): Xaa can be any naturally occurring amino acid
CISEFAIRILCIPTCLAFMSSQNTTDKLSKIRPXHNSSQRIKYHAHLKYV

SEQ ID NO: 31687 - protein, 266 aa, Diabrotica virgifera
  misc_feature: Coding regions on vcDNA: vcDNA=SeqID_11384; Strand=-; Position=1-798
  misc_feature (1)..(266): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31688 - protein, 75 aa, Diabrotica virgifera
  misc_feature: Coding regions on vcDNA: vcDNA=SeqID_11385; Strand=-; Position=0-224
  misc_feature (1)..(8): Xaa can be any naturally occurring amino acid
  misc_feature (18)..(25): Xaa can be any naturally occurring amino acid
  misc_feature (61)..(68): Xaa can be any naturally occurring amino acid
XXXXXXXXKLASHQYITXXXXXXXXKVQKIHGSFIEIKCSVAIPKYPSLNTIFPTAPNKWXXXXXXXXVGRVRRG

SEQ ID NO: 31689 - protein, 210 aa, Diabrotica virgifera
  misc_feature: Coding regions on vcDNA: vcDNA=SeqID_11386; Strand=+; Position=1-630
  misc_feature: Homolog annotation: Hit_ID=EAL32943.1; Match level="QueryCoverage =100%, HitCoverage=39%, E-value=1e-40, Identity=45%"; Hit description= GA18950-PA [Drosophila pseudoobscura]
  misc_feature: Gene Ontology Annotation: Molecular function=chaperone activity; Cellular component=actin filament; Biological process=cell organization and biogenesis
  misc_feature (17)..(17): Xaa can be any naturally occurring amino acid
  misc_feature (80)..(80): Xaa can be any naturally occurring amino acid
  misc_feature (85)..(85): Xaa can be any naturally occurring amino acid
  misc_feature (105)..(105): Xaa can be any naturally occurring amino acid
  misc_feature (138)..(138): Xaa can be any naturally occurring amino acid
  misc_feature (149)..(149): Xaa can be any naturally occurring amino acid
LKRVYLIHPAGKMTKEXSRDHDVEALDVTTAAGMSAGAFFEDDETRLQIPTLPTPISESFDMAAQVPKDILSDIATPIEXTIHTXITTMASTSLPSEMVSQHSGXFAPLAVHAILKIVQPATQLTSNLSDIKIIKMLXATVEHTELPQXMYFPQTSSHVSLPTKIGNSIVLFIRCYISPPKTHMDHSVIVTDYADMDRVLLNDKLYIMNI

SEQ ID NO: 31690 - protein, 262 aa, Diabrotica virgifera
  misc_feature: Coding regions on vcDNA: vcDNA=SeqID_11387; Strand=+; Position=32-817
  misc_feature: Homolog annotation: Hit_ID=XP_392246.1; Match level="QueryCoverage =82%, HitCoverage=65%, E-value=8e-77, Identity=66%"; Hit description =similar to ENSANGP00000014902 [Apis mellifera]
  misc_feature: Gene Ontology Annotation: Molecular function=RNA binding; Cellular component=nucleus; Biological process=spermatogenesis
  misc_feature: Pfam annotation: Pfam_ID=KH_1; Match level="Score=10.0, E-value =0.064, Copies=1"; Pfam description=KH domain
LFPPRPVLSIIWCCYYNSNGEDYYGDKRKGGEESIKRDSEAAGDNEENTSSQRASEYVKELLAEKLSIDQHKLPNAVRLLQQEVTKTQSIGRAPVRDIKYVDIYREKPIKVTVKVLVPVREYPKFNFVGKLLGPKGNSMKRLQEETMCKMAVLGRGSMKDRAKEDELRNSLDPKYSHLMDDLHVEISPLGPPAEAHARVAFALAEVTKYLIPHSNDNIRQEQLREMQLFSDREMIPEPRRPPPPHHIRPSNPISRGLPPPHA

SEQ ID NO: 31691 - protein, 148 aa, Diabrotica virgifera
  misc_feature: Coding regions on vcDNA: vcDNA=SeqID_11388; Strand=+; Position=171-617
  misc_feature: Homolog annotation: Hit_ID=YP_133762.1; Match level="QueryCoverage =99%, HitCoverage=65%, E-value=2e-27, Identity=44%"; Hit description =ATP synthase F0 subunit 6 [Dermatobia hominis] gb|AAR16447.1| ATP synthase F0 subunit 6
  misc_feature: Pfam annotation: Pfam_ID=ATP-synt_A; Match level="Score=-21.6, E -value=0.00046, Copies=1"; Pfam description=ATP synthase A chain
  misc_feature (67)..(67): Xaa can be any naturally occurring amino acid
  misc_feature (82)..(82): Xaa can be any naturally occurring amino acid
  misc_feature (93)..(93): Xaa can be any naturally occurring amino acid
  misc_feature (105)..(105): Xaa can be any naturally occurring amino acid
  misc_feature (128)..(128): Xaa can be any naturally occurring amino acid
LVPSGWNDLWIKNIITLDKELVVLTVDYISQGRALPFISLIILFSFINSSWIIPVIITATRHITLTXSILIPLWMRLIINGXISETIPLLAQXVPQGTPPLFPPXLVGNETIGNAIRAGPLALRMTAXIIARDVALTLLGHTGPIASL

SEQ ID NO: 31692 - protein, 113 aa, Diabrotica virgifera
  misc_feature: Coding regions on vcDNA: vcDNA=SeqID_11389; Strand=+; Position=507-845
TLTPQTPYHLPYSILYPLNKLPHLDFSYNYLYKFLTLSNKKITDNVGDTSNLTHLRLCGLDLRELPARYIDCLTALKGLSLADNEFELIPTDPYTVEHLYLSDNQFTFISPIY

SEQ ID NO: 31693 - protein, 61 aa, Diabrotica virgifera
  misc_feature: Coding regions on vcDNA: vcDNA=SeqID_11390; Strand=-; Position=488-673
NFYQVVNQITAVSRSIGAWSGEESDLQSTATVWLSPYRETKTTTVVSSRRVQRDYSWDGSI

SEQ ID NO: 31694 - protein, 120 aa, Diabrotica virgifera
  misc_feature: Coding regions on vcDNA: vcDNA=SeqID_11391; Strand=+; Position=440-799
  misc_feature: Homolog annotation: Hit_ID=XP_308212.1; Match level="QueryCoverage =45%, HitCoverage=23%, E-value=2e-11, Identity=61%"; Hit description =ENSANGP00000021558 [Anopheles gambiae]
MTEAQLYPAPSHVPAPTAPPETILSNGNHLSAPPEVTTTTISRLYPSSRRTYSKSAPIMGTSESKPSETKLINLFEQYKDNCDDSILAEGIEQFCQDLQISPDDFKILVLAWKLNAEQMC

SEQ ID NO: 31695 - protein, 75 aa, Diabrotica virgifera
  misc_feature: Coding regions on vcDNA: vcDNA=SeqID_11392; Strand=-; Position=157-384
  misc_feature (7)..(15): Xaa can be any naturally occurring amino acid
  misc_feature (24)..(31): Xaa can be any naturally occurring amino acid
RVCLYRXXXXXXXXXIDWGLSSDXXXXXXXXVFCEISCTFKIYVIILSYSVSSATGIAFAFKARKIHRYKFRILT

SEQ ID NO: 31696 - protein, 244 aa, Diabrotica virgifera
  misc_feature: Coding regions on vcDNA: vcDNA=SeqID_11393; Strand=-; Position=3-737
  misc_feature (4)..(15): Xaa can be any naturally occurring amino acid
  misc_feature (43)..(53): Xaa can be any naturally occurring amino acid
  misc_feature (61)..(68): Xaa can be any naturally occurring amino acid
  misc_feature (73)..(144): Xaa can be any naturally occurring amino acid
  misc_feature (147)..(240): Xaa can be any naturally occurring amino acid
NKIXXXXXXXXXXXXQPCNPASNKKANDYATTARSKYRAHPNXXXXXXXXXXXTNRHVSNXXXXXXXXNSLIXXXXXXXXXXXXXXXXXXXXXXXXXXXXXXXXXXXXXXXXXXXXXXXXXXXXXXXXXXXXXXXXXXXXXXXXLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTIPN

SEQ ID NO: 31697 - protein, 69 aa, Diabrotica virgifera
  misc_feature: Coding regions on vcDNA: vcDNA=SeqID_11394; Strand=+; Position=391-600
TIISNPSKRNRIMFFFSLLIHKNRCYCVCKYKSTRLTTDHLERTRLYAPRPCNTHPEPLLFTSLVKAFL

SEQ ID NO: 31698 - protein, 50 aa, Diabrotica virgifera
  misc_feature: Coding regions on vcDNA: vcDNA=SeqID_11395; Strand=+; Position=95-247
KLNRYIKDTIGNLNSFFVHFCTILNFYIYTYIFMCFNFVQMYCSNTFVEC

SEQ ID NO: 31699 - protein, 198 aa, Diabrotica virgifera
  misc_feature: Coding regions on vcDNA: vcDNA=SeqID_11396; Strand=-; Position=1-594
  misc_feature (11)..(50): Xaa can be any naturally occurring amino acid
  misc_feature (53)..(197): Xaa can be any naturally occurring amino acid
DSFYFIQPFIXXXXXXXXXXXXXXXXXXXXXXXXXXXXXXXXXXXXXXXXNKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXI

SEQ ID NO: 31700 - protein, 249 aa, Diabrotica virgifera
  misc_feature: Coding regions on vcDNA: vcDNA=SeqID_11397; Strand=+; Position=1-747
  misc_feature: Homolog annotation: Hit_ID=AAF87760.1; Match level="QueryCoverage =100%, HitCoverage=56%, E-value=4e-96, Identity=74%"; Hit description= cytochrome oxidase subunit I [Diabrotica virgifera zeae]
  misc_feature: Pfam annotation: Pfam_ID=COX1; Match level="Score=-119.4, E-value =3.5e-07, Copies=1"; Pfam description=Cytochrome C and Quinol oxidase polyp
  misc_feature (25)..(25): Xaa can be any naturally occurring amino acid
  misc_feature (60)..(60): Xaa can be any naturally occurring amino acid
  misc_feature (77)..(77): Xaa can be any naturally occurring amino acid
  misc_feature (80)..(86): Xaa can be any naturally occurring amino acid
  misc_feature (113)..(119): Xaa can be any naturally occurring amino acid
  misc_feature (133)..(133): Xaa can be any naturally occurring amino acid
  misc_feature (141)..(157): Xaa can be any naturally occurring amino acid
  misc_feature (187)..(187): Xaa can be any naturally occurring amino acid
  misc_feature (203)..(210): Xaa can be any naturally occurring amino acid
  misc_feature (231)..(231): Xaa can be any naturally occurring amino acid
KKEAFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFSFQRKRLRPLRITSSIEXLQFNPPAEHRYSELPILS

SEQ ID NO: 31701 - protein, 59 aa, Diabrotica virgifera
  misc_feature: Coding regions on vcDNA: vcDNA=SeqID_11398; Strand=-; Position=470-649
IKIVVERIKAVLPIRRRLLAIRTIMDKDELYNRCGQKDASIPCDQASDVSVIFHALTKV

SEQ ID NO: 31702 - protein, 185 aa, Diabrotica virgifera
  misc_feature: Coding regions on vcDNA: vcDNA=SeqID_11399; Strand=-; Position=248-805
  misc_feature (4)..(13): Xaa can be any naturally occurring amino acid
  misc_feature (18)..(62): Xaa can be any naturally occurring amino acid
  misc_feature (65)..(76): Xaa can be any naturally occurring amino acid
  misc_feature (82)..(135): Xaa can be any naturally occurring amino acid
  misc_feature (139)..(159): Xaa can be any naturally occurring amino acid
  misc_feature (171)..(177): Xaa can be any naturally occurring amino acid
IPAXXXXXXXXXXLARSXXXXXXXXXXXXXXXXXXXXXXXXXXXXXXXXXXXXXXXXXXXXXGNXXXXXXXXXXXXDDINLXXXXXXXXXXXXXXXXXXXXXXXXXXXXXXXXXXXXXXXXXXXXXXXXXXXXXXDIKXXXXXXXXXXXXXXXXXXXXXDLKMNNDFDYKXXXXXXXFTIKILGF

SEQ ID NO: 31703 - protein, 284 aa, Diabrotica virgifera
  misc_feature: Coding regions on vcDNA: vcDNA=SeqID_11400; Strand=+; Position=3-854
  misc_feature: Homolog annotation: Hit_ID=XP_395737.1; Match level="QueryCoverage =87%, HitCoverage=84%, E-value=1e-60, Identity=52%"; Hit description =similar to ENSANGP00000001519 [Apis mellifera]
  misc_feature (79)..(79): Xaa can be any naturally occurring amino acid
  misc_feature (106)..(106): Xaa can be any naturally occurring amino acid
  misc_feature (152)..(152): Xaa can be any naturally occurring amino acid
  misc_feature (178)..(185): Xaa can be any naturally occurring amino acid
  misc_feature (261)..(261): Xaa can be any naturally occurring amino acid
PPAQYQVHNFFHAYISIREDIFVVKIVFLLLNILVGGGTVFICKSLCNLLKQKGYGVPVISRMPCIHRISCERITTNLXLPKDTKAFVNLSGQNVMDISRIWTCRXFKQNVFHSRVNTTKTLSSLIHKTHEKPNVFVTISGVGAYKPSTTSXYTEDSVVQPFDFFSGLCRDWENAAQXXXXXXXXRLSTIRSGVYLGRDGGMIKQLYLPFFLGLGGPVGSGSQFMPWIHIDDLTHLILFAIENPIVDVILNGVAAKPCTNXKFSKAFAKALKRPAIFPVQTFVL

SEQ ID NO: 31704 - protein, 72 aa, Diabrotica virgifera
  misc_feature: Coding regions on vcDNA: vcDNA=SeqID_11401; Strand=-; Position=2-217
  misc_feature (51)..(56): Xaa can be any naturally occurring amino acid
YLFLHLKREKFEIQSPPQGDGPEKKITRLAIGVEGGFDPESSKQKFEYKDXXXXXXLPSFTTFEWPDDNLPE

SEQ ID NO: 31705 - protein, 94 aa, Diabrotica virgifera
  misc_feature: Coding regions on vcDNA: vcDNA=SeqID_11402; Strand=+; Position=2-285
  misc_feature: Homolog annotation: Hit_ID=XP_317673.1; Match level="QueryCoverage =92%, HitCoverage=18%, E-value=3e-09, Identity=41%"; Hit description =ENSANGP00000023637 [Anopheles gambiae]
  misc_feature (48)..(48): Xaa can be any naturally occurring amino acid
  misc_feature (75)..(75): Xaa can be any naturally occurring amino acid
GFNIHEISLTRCSQRPMINILTQQIFNSRGTPTVEDELDNDLQIDLSXAVPAESSTANHKALKRPDYVPEKYHYXGVISANNNINSLISPEQHK

SEQ ID NO: 31706 - protein, 22 aa, Diabrotica virgifera
  misc_feature: Coding regions on vcDNA: vcDNA=SeqID_11403; Strand=-; Position=1-66
  misc_feature (1)..(21): Xaa can be any naturally occurring amino acid
XXXXXXXXXXXXXXXXXXXXXM

SEQ ID NO: 31707 - protein, 130 aa, Diabrotica virgifera
  misc_feature: Coding regions on vcDNA: vcDNA=SeqID_11404; Strand=+; Position=415-804
  misc_feature (8)..(15): Xaa can be any naturally occurring amino acid
  misc_feature (31)..(41): Xaa can be any naturally occurring amino acid
  misc_feature (48)..(58): Xaa can be any naturally occurring amino acid
  misc_feature (60)..(72): Xaa can be any naturally occurring amino acid
  misc_feature (79)..(89): Xaa can be any naturally occurring amino acid
  misc_feature (99)..(128): Xaa can be any naturally occurring amino acid
HIFTDDFXXXXXXXXNFSIKITIKTSHISSXXXXXXXXXXXLFLIPFXXXXXXXXXXXTXXXXXXXXXXXXXQKYIRLXXXXXXXXXXXLLNTCLLALXXXXXXXXXXXXXXXXXXXXXXXXXXXXXXKA

SEQ ID NO: 31708 - protein, 178 aa, Diabrotica virgifera
  misc_feature: Coding regions on vcDNA: vcDNA=SeqID_11405; Strand=-; Position=58-594
  misc_feature (2)..(12): Xaa can be any naturally occurring amino acid
  misc_feature (18)..(35): Xaa can be any naturally occurring amino acid
  misc_feature (54)..(72): Xaa can be any naturally occurring amino acid
  misc_feature (78)..(97): Xaa can be any naturally occurring amino acid
  misc_feature (100)..(136): Xaa can be any naturally occurring amino acid
  misc_feature (140)..(155): Xaa can be any naturally occurring amino acid
  misc_feature (162)..(175): Xaa can be any naturally occurring amino acid
HXXXXXXXXXXXCRDHSXXXXXXXXXXXXXXXXXXNNQVKIMSSNSCINHIYLXXXXXXXXXXXXXXXXXXXVNLYVXXXXXXXXXXXXXXXXXXXXNIXXXXXXXXXXXXXXXXXXXXXXXXXXXXXXXXXXXXXKHIXXXXXXXXXXXXXXXXDRISFQXXXXXXXXXXXXXXLIS

SEQ ID NO: 31709 - protein, 87 aa, Diabrotica virgifera
  misc_feature: Coding regions on vcDNA: vcDNA=SeqID_11406; Strand=-; Position=277-540
  misc_feature (7)..(12): Xaa can be any naturally occurring amino acid
GYGDYGXXXXXXIVDDFDNITCTLNHRNAYGQYMKGYEKYTRLTVHSLCAMTQAGTRGVLLGSANIPSSSYCRIMKENAAGVRIKNT

SEQ ID NO: 31710 - protein, 109 aa, Diabrotica virgifera
  misc_feature: Coding regions on vcDNA: vcDNA=SeqID_11407; Strand=+; Position=19-348
  misc_feature (13)..(13): Xaa can be any naturally occurring amino acid
  misc_feature (29)..(29): Xaa can be any naturally occurring amino acid
KRNISPKAWMKIXLKGVYAPRPSTVSFLXKKTLFLVPCVSNKQKYALTYLEFSNLEKLKINNFYGKIKTYNNYSAREMGCYYYMNILFDIHTNLSILINDNLTFTYLSA

SEQ ID NO: 31711 - protein, 79 aa, Diabrotica virgifera
  misc_feature: Coding regions on vcDNA: vcDNA=SeqID_11408; Strand=+; Position=520-756
CSIIILTKECHRLLSSQLSAYFIDSHREATEYDMTIAALHVLRIIIDLAAAVIHYDLHYNGHCVRNIHIIYLICCYYLM

SEQ ID NO: 31712 - protein, 43 aa, Diabrotica virgifera
  misc_feature: Coding regions on vcDNA: vcDNA=SeqID_11409; Strand=+; Position=1-129
  misc_feature (2)..(18): Xaa can be any naturally occurring amino acid
  misc_feature (35)..(41): Xaa can be any naturally occurring amino acid
DXXXXXXXXXXXXXXXXXRCFSIKFIYIINSFSLXXXXXXXLF

SEQ ID NO: 31713 - protein, 191 aa, Diabrotica virgifera
  misc_feature: Coding regions on vcDNA: vcDNA=SeqID_11410; Strand=+; Position=3-576
  misc_feature: Homolog annotation: Hit_ID=XP_393821.1; Match level="QueryCoverage =97%, HitCoverage=49%, E-value=7e-37, Identity=41%"; Hit description =similar to ENSANGP00000013203 [Apis mellifera]
  misc_feature: Pfam annotation: Pfam_ID=WD40; Match level="Score=43.6, E-value=5.9e -10, Copies=2"; Pfam description=WD domain, G-beta repeat
  misc_feature (57)..(57): Xaa can be any naturally occurring amino acid
SIPPRFAAKEVTRHETGGNVVMSCSVYSDRKYSLLVAGQKSECQLYKLNPRLLEEVXKISGNNTHLRQRNTKNKEVTDDNKNVTKELYFDVNAIKNVQTDFNGSEPLSRMVKINHDGTLLATGDTNGDVQIWKFPSMQPLFILKAHTKEIDDIDFSMFDNYVITIAKDGLAILWDCMLTWNQPGSKYLYKR

SEQ ID NO: 31714 - protein, 73 aa, Diabrotica virgifera
  misc_feature: Coding regions on vcDNA: vcDNA=SeqID_11411; Strand=+; Position=605-823
  misc_feature (31)..(38): Xaa can be any naturally occurring amino acid
TYPNLDSAIRPVPHQLEQIPISIFSSLPMLXXXXXXXXFDELQTNRFEQDDSDFEGDSTRPERFTQEELSDLI

SEQ ID NO: 31715 - protein, 49 aa, Diabrotica virgifera
  misc_feature: Coding regions on vcDNA: vcDNA=SeqID_11412; Strand=-; Position=309-458
  misc_feature (13)..(19): Xaa can be any naturally occurring amino acid
IESFLCDKSKFVXXXXXXXYNQILSSSIRWEFWIIYFLLTISDNSASTI

SEQ ID NO: 31716 - protein, 180 aa, Diabrotica virgifera
  misc_feature: Coding regions on vcDNA: vcDNA=SeqID_11413; Strand=+; Position=1-540
  misc_feature (1)..(130): Xaa can be any naturally occurring amino acid
  misc_feature (132)..(148): Xaa can be any naturally occurring amino acid
  misc_feature (152)..(167): Xaa can be any naturally occurring amino acid
  misc_feature (170)..(176): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXNYYXXXXXXXXXXXXXXXXWRXXXXXXXLFFI

SEQ ID NO: 31717 - protein, 42 aa, Diabrotica virgifera
  misc_feature: Coding regions on vcDNA: vcDNA=SeqID_11414; Strand=-; Position=1-126
  misc_feature (1)..(21): Xaa can be any naturally occurring amino acid
  misc_feature (24)..(42): Xaa can be any naturally occurring amino acid
XXXXXXXXXXXXXXXXXXXXXTPXXXXXXXXXXXXXXXXXXX

SEQ ID NO: 31718 - protein, 32 aa, Diabrotica virgifera
  misc_feature: Coding regions on vcDNA: vcDNA=SeqID_11415; Strand=-; Position=0-95
  misc_feature (1)..(27): Xaa can be any naturally occurring amino acid
XXXXXXXXXXXXXXXXXXXXXXXXXXXKKCKL

SEQ ID NO: 31719 - protein, 286 aa, Diabrotica virgifera
  misc_feature: Coding regions on vcDNA: vcDNA=SeqID_11416; Strand=-; Position=1-858
  misc_feature (4)..(211): Xaa can be any naturally occurring amino acid
  misc_feature (214)..(252): Xaa can be any naturally occurring amino acid
  misc_feature (254)..(274): Xaa can be any naturally occurring amino acid
  misc_feature (277)..(286): Xaa can be any naturally occurring amino acid
TKKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDFXXXXXXXXXXXXXXXXXXXXXXXXXXXXXXXXXXXXXXXGXXXXXXXXXXXXXXXXXXXXXVKXXXXXXXXXX

SEQ ID NO: 31720 - protein, 71 aa, Diabrotica virgifera
  misc_feature: Coding regions on vcDNA: vcDNA=SeqID_11417; Strand=-; Position=56-271
VVLIPIIRGRYSYGQCRSYCAGHLLGMYVDYKRIYYDMLSCRIIAQKFHAKGLKCSTSTFIISELTIVKSG

SEQ ID NO: 31721 - protein, 21 aa, Diabrotica virgifera
  misc_feature: Coding regions on vcDNA: vcDNA=SeqID_11418; Strand=-; Position=0-62
  misc_feature (1)..(18): Xaa can be any naturally occurring amino acid
  misc_feature (20)..(20): Xaa can be any naturally occurring amino acid
XXXXXXXXXXXXXXXXXXFXL

SEQ ID NO: 31722 - protein, 190 aa, Diabrotica virgifera
  misc_feature: Coding regions on vcDNA: vcDNA=SeqID_11419; Strand=+; Position=113-679
  misc_feature: Homolog annotation: Hit_ID=AAO62194.1; Match level="QueryCoverage =98%, HitCoverage=89%, E-value=7e-42, Identity=50%"; Hit description =cytochrome c oxidase subunit I [Pyractomena sp. SLB-2003]
  misc_feature (39)..(39): Xaa can be any naturally occurring amino acid
  misc_feature (79)..(79): Xaa can be any naturally occurring amino acid
  misc_feature (94)..(94): Xaa can be any naturally occurring amino acid
  misc_feature (150)..(150): Xaa can be any naturally occurring amino acid
  misc_feature (164)..(164): Xaa can be any naturally occurring amino acid
  misc_feature (176)..(176): Xaa can be any naturally occurring amino acid
TSGYLIGNDRIRIVCVTTHEFIIIFFIVIPSIIGGFANXIVHLILGAPYMLFPHINNISFWLLSPTLLSLVILNDRKQXGSGTGRPIYPSLYSXISRDGPSLYLSIFTVSLDGMSSILGDFNCITSIMTMLPLVIVFAQVLLFGCAAAIXTTFLLLLSLPIYIXAIPVYFSDAYVXPSFFDPPSEGDTVL

SEQ ID NO: 31723 - protein, 18 aa, Diabrotica virgifera
  misc_feature: Coding regions on vcDNA: vcDNA=SeqID_11420; Strand=-; Position=2-55
  misc_feature (9)..(18): Xaa can be any naturally occurring amino acid
YAVIPKVIXXXXXXXXXX

SEQ ID NO: 31724 - protein, 309 aa, Diabrotica virgifera
  misc_feature: Coding regions on vcDNA: vcDNA=SeqID_11421; Strand=+; Position=3-929
  misc_feature (1)..(250): Xaa can be any naturally occurring amino acid
  misc_feature (255)..(262): Xaa can be any naturally occurring amino acid
  misc_feature (266)..(297): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEGLDXXXXXXXXFIKXXXXXXXXXXXXXXXXXXXXXXXXXXXXXXXXIYSYDKFIVLGV

SEQ ID NO: 31725 - protein, 271 aa, Diabrotica virgifera
  misc_feature: Coding regions on vcDNA: vcDNA=SeqID_11422; Strand=-; Position=2-814
  misc_feature (3)..(12): Xaa can be any naturally occurring amino acid
  misc_feature (14)..(213): Xaa can be any naturally occurring amino acid
  misc_feature (217)..(254): Xaa can be any naturally occurring amino acid
  misc_feature (257)..(268): Xaa can be any naturally occurring amino acid
INXXXXXXXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFRXXXXXXXXXXXXXXXXXXXXXXXXXXXXXXXXXXXXXXEVXXXXXXXXXXXXFSH

SEQ ID NO: 31726 - protein, 146 aa, Diabrotica virgifera
  misc_feature: Coding regions on vcDNA: vcDNA=SeqID_11423; Strand=+; Position=181-618
  misc_feature: Homolog annotation: Hit_ID=AAH79948.1; Match level="QueryCoverage =80%, HitCoverage=18%, E-value=3e-24, Identity=54%"; Hit description =MGC79685 protein [Xenopus tropicalis] ref|NP_001007512.1| MGC79685 protein [Xenopus tropicalis]
  misc_feature: Gene Ontology Annotation: Molecular function=hydrogen-transporting ATPase activity, rotational mechanism; Cellular component=integral to plasma membrane; Biological process=transport
  misc_feature (24)..(24): Xaa can be any naturally occurring amino acid
  misc_feature (48)..(48): Xaa can be any naturally occurring amino acid
  misc_feature (81)..(81): Xaa can be any naturally occurring amino acid
MILPPKEAQLLNKYLNNHPLLTGXRELHAMYTCELCVTTDIPTLFSTXEKNAFSPSPCKYTNSDGIINSRCEQRGHDTTEXLRDLPELTEGNNGHTESITKHTLSGDNTSNMPVPDLESTIYTGITLPEYFRDIEPQRNHNDCLDI

SEQ ID NO: 31727 - protein, 267 aa, Diabrotica virgifera
  misc_feature: Coding regions on vcDNA: vcDNA=SeqID_11424; Strand=+; Position=141-941
  misc_feature (32)..(84): Xaa can be any naturally occurring amino acid
  misc_feature (86)..(140): Xaa can be any naturally occurring amino acid
  misc_feature (143)..(172): Xaa can be any naturally occurring amino acid
  misc_feature (176)..(183): Xaa can be any naturally occurring amino acid
  misc_feature (186)..(192): Xaa can be any naturally occurring amino acid
  misc_feature (201)..(237): Xaa can be any naturally occurring amino acid
  misc_feature (243)..(250): Xaa can be any naturally occurring amino acid
NDAIQQFKICLFGNNQNIFTIMFYSYMKSLLXXXXXXXXXXXXXXXXXXXXXXXXXXXXXXXXXXXXXXXXXXXXXXXXXXXXXEXXXXXXXXXXXXXXXXXXXXXXXXXXXXXXXXXXXXXXXXXXXXXXXXXXXXXXXNKXXXXXXXXXXXXXXXXXXXXXXXXXXXXXXMSAXXXXXXXXIIXXXXXXXWNERLDETXXXXXXXXXXXXXXXXXXXXXXXXXXXXXXXXXXXXXFIVLNXXXXXXXXLDAIKNKCIFCYLIILI

SEQ ID NO: 31728 - protein, 252 aa, Diabrotica virgifera
  misc_feature: Coding regions on vcDNA: vcDNA=SeqID_11425; Strand=-; Position=1-756
  misc_feature (13)..(23): Xaa can be any naturally occurring amino acid
  misc_feature (31)..(37): Xaa can be any naturally occurring amino acid
  misc_feature (39)..(55): Xaa can be any naturally occurring amino acid
  misc_feature (62)..(239): Xaa can be any naturally occurring amino acid
  misc_feature (242)..(249): Xaa can be any naturally occurring amino acid
LSSNHSFQLSIYXXXXXXXXXXXHPADIQIXXXXXXXHXXXXXXXXXXXXXXXXXRIPLLNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYFXXXXXXXXKIN

SEQ ID NO: 31729 - protein, 74 aa, Diabrotica virgifera
  misc_feature: Coding regions on vcDNA: vcDNA=SeqID_11426; Strand=-; Position=224-448
DVSEDFKTSHSRVIYIESLRQDDQLFSRRFLSVSVAGLRTLSYVLRQYVQSQSNTPPDSVLYLYLHGANISLEV

SEQ ID NO: 31730 - protein, 259 aa, Diabrotica virgifera
  misc_feature: Coding regions on vcDNA: vcDNA=SeqID_11427; Strand=+; Position=109-885
  misc_feature: Homolog annotation: Hit_ID=NP_725856.1; Match level="QueryCoverage =96%, HitCoverage=71%, E-value=2e-29, Identity=31%"; Hit description =CG15111-PB, isoform B [Drosophila melanogaster] gb|AAM68437.1| CG15111-PB, isoform B [Drosophila
  misc_feature (145)..(145): Xaa can be any naturally occurring amino acid
  misc_feature (201)..(201): Xaa can be any naturally occurring amino acid
MNKKQFFKSWKLGQKIAFISGVALFIILLLIFLAIWVIFPLVFMNSISVQRFFIFFNFRDPKNPEFNNPQKYGMTGVVNFYITTKDLIDGSLVSIGAWLLVQENQIQSTKIAGQDDKTASEIIRNTKSPIAIYLHGVECNRIKPXETYEVLRKHFLVISLHHRGYGDSGPDKPPTELRIVGDTSQVFQWIRALTDNDIYVXGHSLGTALSTHSVKRLEGQSIVPSGLILESPFTTIEEEMPSTALGKIFSWMPWFAATV

SEQ ID NO: 31731 - protein, 46 aa, Diabrotica virgifera
  misc_feature: Coding regions on vcDNA: vcDNA=SeqID_11428; Strand=+; Position=3-143
  misc_feature (1)..(14): Xaa can be any naturally occurring amino acid
  misc_feature (16)..(23): Xaa can be any naturally occurring amino acid
XXXXXXXXXXXXXXRXXXXXXXXDRNQPGSHRFKLRSCKILKVEQT

SEQ ID NO: 31732 - protein, 65 aa, Diabrotica virgifera
  misc_feature: Coding regions on vcDNA: vcDNA=SeqID_11429; Strand=+; Position=209-406
YLQILIAKKLLHMVLTVVQCYSHLSISTFLLIAIKSIDDPCISDYFPFLLLLVNICWFELKNLKL

SEQ ID NO: 31733 - protein, 89 aa, Diabrotica virgifera
  misc_feature: Coding regions on vcDNA: vcDNA=SeqID_11430; Strand=-; Position=76-345
  misc_feature (34)..(40): Xaa can be any naturally occurring amino acid
  misc_feature (68)..(77): Xaa can be any naturally occurring amino acid
LSSGLMRNYISFSLNMLSIHTETTCYSISLEYLXXXXXXXQFHNITIGIKFFPIYTSHLYFAFIRHLXXXXXXXXXXPSSPGIHKLLII

SEQ ID NO: 31734 - protein, 231 aa, Diabrotica virgifera
  misc_feature: Coding regions on vcDNA: vcDNA=SeqID_11431; Strand=-; Position=1-693
  misc_feature (7)..(16): Xaa can be any naturally occurring amino acid
  misc_feature (21)..(31): Xaa can be any naturally occurring amino acid
  misc_feature (41)..(49): Xaa can be any naturally occurring amino acid
  misc_feature (51)..(64): Xaa can be any naturally occurring amino acid
  misc_feature (71)..(83): Xaa can be any naturally occurring amino acid
  misc_feature (85)..(231): Xaa can be any naturally occurring amino acid
FYLFFDXXXXXXXXXXIWSFXXXXXXXXXXXNQPGSHRFIXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31735 - protein, 69 aa, Diabrotica virgifera
  misc_feature: Coding regions on vcDNA: vcDNA=SeqID_11432; Strand=-; Position=0-206
VRCSHQFFATLLTTHFRMSSQERNVTRQQYSLAPLFTSRFACPRGLSVNADRVERAGRQGRPRYGARRG

SEQ ID NO: 31736 - protein, 52 aa, Diabrotica virgifera
  misc_feature: Coding regions on vcDNA: vcDNA=SeqID_11433; Strand=+; Position=103-261
SKKTQKFILTLIYFTSTFGFTSVSYSFVYSIFDLFQLLKTGPVTLIVEGKNI

SEQ ID NO: 31737 - protein, 88 aa, Diabrotica virgifera
  misc_feature: Coding regions on vcDNA: vcDNA=SeqID_11434; Strand=+; Position=54-320
MNEWIINNISLLRRHGLVDPRLIRARYNEQLLGQYWNISHSITEKTDPSPGTQPRLTFIVFTTTQSIDKDLYARDHDIKVISSAPSTD

SEQ ID NO: 31738 - protein, 64 aa, Diabrotica virgifera
  misc_feature: Coding regions on vcDNA: vcDNA=SeqID_11435; Strand=-; Position=141-335
FPINAMIIHSDVFLRHAFHRVWVVYCNGPILYGRLSFDQTILASNRPLHGRWCFLQYRLLLRSL

SEQ ID NO: 31739 - protein, 150 aa, Diabrotica virgifera
  misc_feature: Coding regions on vcDNA: vcDNA=SeqID_11436; Strand=+; Position=3-452
  misc_feature: Homolog annotation: Hit_ID=CAG01509.1; Match level="QueryCoverage =67%, HitCoverage=14%, E-value=5e-09, Identity=35%"; Hit description =unnamed protein product [Tetraodon nigroviridis]
  misc_feature: Pfam annotation: Pfam_ID=LRR_1; Match level="Score=26.1, E-value =0.00011, Copies=3"; Pfam description=Leucine Rich Repeat
RNSIRSLPGHAFKNLQNKKLIIYLSRNLITTLSPNIFADLKQCSQIWLDRNEIRDIHPNTFSQIEFLEVLFLSGNFLSSVPKDLLKNLKNDLVTLDLAHNINLTCLDYEIVKRVKLTNLVKINKLNCDCIKTLKHKLVSANKSYEINSDC

SEQ ID NO: 31740 - protein, 56 aa, Diabrotica virgifera
  misc_feature: Coding regions on vcDNA: vcDNA=SeqID_11437; Strand=-; Position=2-169
  misc_feature (14)..(21): Xaa can be any naturally occurring amino acid
  misc_feature (23)..(31): Xaa can be any naturally occurring amino acid
  misc_feature (42)..(55): Xaa can be any naturally occurring amino acid
LKIETNLAHTGLTXXXXXXXXEXXXXXXXXXNINFNPTSRSXXXXXXXXXXXXXXV

SEQ ID NO: 31741 - protein, 171 aa, Diabrotica virgifera
  misc_feature: Coding regions on vcDNA: vcDNA=SeqID_11438; Strand=+; Position=1-516
  misc_feature (1)..(22): Xaa can be any naturally occurring amino acid
  misc_feature (24)..(98): Xaa can be any naturally occurring amino acid
  misc_feature (102)..(113): Xaa can be any naturally occurring amino acid
  misc_feature (116)..(123): Xaa can be any naturally occurring amino acid
  misc_feature (126)..(162): Xaa can be any naturally occurring amino acid
XXXXXXXXXXXXXXXXXXXXXXIXXXXXXXXXXXXXXXXXXXXXXXXXXXXXXXXXXXXXXXXXXXXXXXXXXXXXXXXXXXXXXXXXXXXXXXXXXXMSLXXXXXXXXXXXXELXXXXXXXXNMXXXXXXXXXXXXXXXXXXXXXXXXXXXXXXXXXXXXXCISIKNIYV

SEQ ID NO: 31742 - protein, 286 aa, Diabrotica virgifera
  misc_feature: Coding regions on vcDNA: vcDNA=SeqID_11439; Strand=-; Position=1-858
  misc_feature (10)..(19): Xaa can be any naturally occurring amino acid
  misc_feature (23)..(59): Xaa can be any naturally occurring amino acid
  misc_feature (66)..(286): Xaa can be any naturally occurring amino acid
EFYSLITAKXXXXXXXXXXILKXXXXXXXXXXXXXXXXXXXXXXXXXXXXXXXXXXXXXFYHPTLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31743 - protein, 185 aa, Diabrotica virgifera
  misc_feature: Coding regions on vcDNA: vcDNA=SeqID_11440; Strand=+; Position=246-800
  misc_feature (20)..(27): Xaa can be any naturally occurring amino acid
  misc_feature (34)..(51): Xaa can be any naturally occurring amino acid
  misc_feature (53)..(66): Xaa can be any naturally occurring amino acid
  misc_feature (72)..(82): Xaa can be any naturally occurring amino acid
  misc_feature (87)..(105): Xaa can be any naturally occurring amino acid
  misc_feature (111)..(121): Xaa can be any naturally occurring amino acid
  misc_feature (134)..(140): Xaa can be any naturally occurring amino acid
  misc_feature (148)..(165): Xaa can be any naturally occurring amino acid
HLFVIYLLLISICLRRFLSXXXXXXXXRNDMLFXXXXXXXXXXXXXXXXXXHXXXXXXXXXXXXXXLGMILXXXXXXXXXXXIHITXXXXXXXXXXXXXXXXXXXLLFINXXXXXXXXXXXFINDDYISIIKLXXXXXXXALINEFCXXXXXXXXXXXXXXXXXXPRLPTDSFICPRYYDRANVA

SEQ ID NO: 31744 - protein, 290 aa, Diabrotica virgifera
  misc_feature: Coding regions on vcDNA: vcDNA=SeqID_11441; Strand=-; Position=3-872
  misc_feature (2)..(16): Xaa can be any naturally occurring amino acid
  misc_feature (18)..(28): Xaa can be any naturally occurring amino acid
  misc_feature (38)..(46): Xaa can be any naturally occurring amino acid
  misc_feature (48)..(61): Xaa can be any naturally occurring amino acid
  misc_feature (68)..(80): Xaa can be any naturally occurring amino acid
  misc_feature (82)..(253): Xaa can be any naturally occurring amino acid
  misc_feature (255)..(288): Xaa can be any naturally occurring amino acid
KXXXXXXXXXXXXXXXFXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXXXXXXXXXXXXXXXXXXYY

SEQ ID NO: 31745 - protein, 21 aa, Diabrotica virgifera
  misc_feature: Coding regions on vcDNA: vcDNA=SeqID_11442; Strand=-; Position=0-62
  misc_feature (1)..(20): Xaa can be any naturally occurring amino acid
XXXXXXXXXXXXXXXXXXXXP

SEQ ID NO: 31746 - protein, 152 aa, Diabrotica virgifera
  misc_feature: Coding regions on vcDNA: vcDNA=SeqID_11443; Strand=+; Position=265-720
  misc_feature: Homolog annotation: Hit_ID=NP_722628.1; Match level="QueryCoverage =91%, HitCoverage=28%, E-value=7e-14, Identity=36%"; Hit description =CG11907-PA, isoform A [Drosophila melanogaster] ref|NP_608519.2| CG11907-PB, isoform B [Drosophila
  misc_feature (108)..(108): Xaa can be any naturally occurring amino acid
YALHPKNRPLFKAEPIHKFYATYILFYILRIIHLLPCNFFITPDDYGMCNFRNVMRFTNIRDAPPRRSPLQAEFTSYLTLTSCYSHLWCLILNTGSSQRVSLCNRVLXSLSCMMPLMMIPLIFVNINTDSGQRWVLVITLMTNYMLNVFGPI

SEQ ID NO: 31747 - protein, 157 aa, Diabrotica virgifera
  misc_feature: Coding regions on vcDNA: vcDNA=SeqID_11444; Strand=+; Position=9-482
  misc_feature (16)..(45): Xaa can be any naturally occurring amino acid
  misc_feature (47)..(67): Xaa can be any naturally occurring amino acid
  misc_feature (84)..(91): Xaa can be any naturally occurring amino acid
  misc_feature (100)..(131): Xaa can be any naturally occurring amino acid
  misc_feature (134)..(144): Xaa can be any naturally occurring amino acid
GSCPPARTAAVPSRAXXXXXXXXXXXXXXXXXXXXXXXXXXXXXXAXXXXXXXXXXXXXXXXXXXXXSFIPISLLFSHLTELKXXXXXXXXHLFNNFFPXXXXXXXXXXXXXXXXXXXXXXXXXXXXXXXXITXXXXXXXXXXXPFITLSFLHKHYD

SEQ ID NO: 31748 - protein, 66 aa, Diabrotica virgifera
  misc_feature: Coding regions on vcDNA: vcDNA=SeqID_11445; Strand=-; Position=1-198
  misc_feature (3)..(9): Xaa can be any naturally occurring amino acid
  misc_feature (11)..(11): Xaa can be any naturally occurring amino acid
  misc_feature (22)..(30): Xaa can be any naturally occurring amino acid
  misc_feature (33)..(40): Xaa can be any naturally occurring amino acid
  misc_feature (48)..(48): Xaa can be any naturally occurring amino acid
  misc_feature (52)..(64): Xaa can be any naturally occurring amino acid
PFXXXXXXXLXIETNWAHTGLXXXXXXXXXSNXXXXXXXXPIINLIHXRGRXXXXXXXXXXXXXLL

SEQ ID NO: 31749 - protein, 199 aa, Diabrotica virgifera
  misc_feature: Coding regions on vcDNA: vcDNA=SeqID_11446; Strand=+; Position=246-842
  misc_feature (10)..(20): Xaa can be any naturally occurring amino acid
  misc_feature (22)..(51): Xaa can be any naturally occurring amino acid
  misc_feature (65)..(72): Xaa can be any naturally occurring amino acid
  misc_feature (81)..(108): Xaa can be any naturally occurring amino acid
  misc_feature (111)..(128): Xaa can be any naturally occurring amino acid
  misc_feature (153)..(160): Xaa can be any naturally occurring amino acid
  misc_feature (163)..(173): Xaa can be any naturally occurring amino acid
  misc_feature (177)..(185): Xaa can be any naturally occurring amino acid
  misc_feature (187)..(198): Xaa can be any naturally occurring amino acid
KLKIYIAKYXXXXXXXXXXXIXXXXXXXXXXXXXXXXXXXXXXXXXXXXXXLNIPRHELQNTISXXXXXXXXIRINNFHIXXXXXXXXXXXXXXXXXXXXXXXXXXXXKFXXXXXXXXXXXXXXXXXXGFITEFPHIFFTCLSKSCLFVSSIXXXXXXXXFEXXXXXXXXXXXISLXXXXXXXXXVXXXXXXXXXXXXQ

SEQ ID NO: 31750 - protein, 72 aa, Diabrotica virgifera
  misc_feature: Coding regions on vcDNA: vcDNA=SeqID_11447; Strand=+; Position=180-398
PPKSTYANPFFWSLPCPMTLEEHPPHAHSNKNLKLYVPLHTTALFPTNLLIVLTILTPNHNYRNTLIKILLR

SEQ ID NO: 31751 - protein, 294 aa, Diabrotica virgifera
  misc_feature: Coding regions on vcDNA: vcDNA=SeqID_11448; Strand=-; Position=3-883
  misc_feature: Homolog annotation: Hit_ID=AAF87760.1; Match level="QueryCoverage =99%, HitCoverage=66%, E-value=1e-123, Identity=78%"; Hit description= cytochrome oxidase subunit I [Diabrotica virgifera zeae]
  misc_feature: Pfam annotation: Pfam_ID=COX1; Match level="Score=93.5, E-value=5.3e -25, Copies=1"; Pfam description=Cytochrome C and Quinol oxidase polyp
  misc_feature (19)..(19): Xaa can be any naturally occurring amino acid
  misc_feature (32)..(32): Xaa can be any naturally occurring amino acid
  misc_feature (71)..(71): Xaa can be any naturally occurring amino acid
  misc_feature (106)..(106): Xaa can be any naturally occurring amino acid
  misc_feature (123)..(123): Xaa can be any naturally occurring amino acid
  misc_feature (126)..(132): Xaa can be any naturally occurring amino acid
  misc_feature (179)..(179): Xaa can be any naturally occurring amino acid
  misc_feature (186)..(202): Xaa can be any naturally occurring amino acid
  misc_feature (232)..(232): Xaa can be any naturally occurring amino acid
  misc_feature (248)..(255): Xaa can be any naturally occurring amino acid
  misc_feature (276)..(276): Xaa can be any naturally occurring amino acid
IIFDPAGGGDPILYQHLFXFFGHPEVYILILXGFGLISHIVRQERRKKEAFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAHFHYVLSIGAVFAIIAGFIQXFPLFTGXXXXXXXXXXXXXXXXXGVNLTFFPQHFLGLIGIPRRYSDYPDVYYXNIVSSIGSLISLIGVXXXXXXXXEAFSFQRKRLRPLRITSSIEXLQFNPPAEHRYSELPILS

SEQ ID NO: 31752 - protein, 129 aa, Diabrotica virgifera
  misc_feature: Coding regions on vcDNA: vcDNA=SeqID_11449; Strand=-; Position=291-680
IRRSVVIGLIQYIRKCSYFLQGRTHILAICILRIYLTHYMDIIARLTSNSVWDRSYYLWRMSGNNGRYYIIICYGCLDGHLLSNTSVTSYPQISVGYMSFFMLCEALRQLLRYFNTPIYLCSDKHSSYT

SEQ ID NO: 31753 - protein, 141 aa, Diabrotica virgifera
  misc_feature: Coding regions on vcDNA: vcDNA=SeqID_11450; Strand=-; Position=53-478
  misc_feature (83)..(96): Xaa can be any naturally occurring amino acid
  misc_feature (104)..(110): Xaa can be any naturally occurring amino acid
  misc_feature (124)..(133): Xaa can be any naturally occurring amino acid
LCGYSGGGAAPLSPPAVPMGRGWFFPISPFFFAPSCFFFVVFLLARRIFDSLGWVSRDDGSGFFSGVFLCSPLNRSPPHQFVXXXXXXXXXXXXXXCFWSGANXXXXXXXRDKQGNEKESVIEXXXXXXXXXXERQLDIMR

SEQ ID NO: 31754 - protein, 159 aa, Diabrotica virgifera
  misc_feature: Coding regions on vcDNA: vcDNA=SeqID_11451; Strand=+; Position=432-908
  misc_feature: Homolog annotation: Hit_ID=XP_309701.1; Match level="QueryCoverage =94%, HitCoverage=31%, E-value=2e-36, Identity=46%"; Hit description =ENSANGP00000012751 [Anopheles gambiae]
  misc_feature (131)..(131): Xaa can be any naturally occurring amino acid
MRKIFGIQIWFFLLNLLLYLFQYAKGAVMPPPWANPKLNPCASHPLGWQLLFWPPDGKCYKIFQVGHPCPSGMELTPSLSKSGKNLSAECKCVPQTAQSATNGVCYPLFSAGPCNEGFYFGPDTKYKSENXKRQWGTCKQIKSWSKENEIYWAQDGKCY

SEQ ID NO: 31755 - protein, 50 aa, Diabrotica virgifera
  misc_feature: Coding regions on vcDNA: vcDNA=SeqID_11452; Strand=-; Position=1-150
  misc_feature (2)..(50): Xaa can be any naturally occurring amino acid
PXXXXXXXXXXXXXXXXXXXXXXXXXXXXXXXXXXXXXXXXXXXXXXXXX

SEQ ID NO: 31756 - protein, 181 aa, Diabrotica virgifera
  misc_feature: Coding regions on vcDNA: vcDNA=SeqID_11453; Strand=+; Position=58-603
  misc_feature: Homolog annotation: Hit_ID=XP_396084.1; Match level="QueryCoverage =86%, HitCoverage=26%, E-value=2e-24, Identity=44%"; Hit description =similar to Chromosome 18 open reading frame 8 [Apis mellifera]
  misc_feature: Pfam annotation: Pfam_ID=Mic1; Match level="Score=116.8, E-value=5.4e- 32, Copies=1"; Pfam description=Colon cancer-associated protein Mic1-l
  misc_feature (146)..(152): Xaa can be any naturally occurring amino acid
MMNEIFQKLDTEKDVAKIEWLLVSYLTSLSECSILTQYNLNELLVTCLARQKKFTVLQQMLQYGVISDSKSLACLLLSLGNMHPGTSQMALDMLTRLDAKEEIQEVLLSEGQILTALKLADNAANPRKFLTAAEQDGDVTLQHSVXXXXXXXPEFEAVFQKDERLSNFIQQYNSIFDRSSN

SEQ ID NO: 31757 - protein, 239 aa, Diabrotica virgifera
  misc_feature: Coding regions on vcDNA: vcDNA=SeqID_11454; Strand=-; Position=2-718
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(233): Xaa can be any naturally occurring amino acid
  misc_feature (235)..(239): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXX

SEQ ID NO: 31758 - protein, 90 aa, Diabrotica virgifera
  misc_feature: Coding regions on vcDNA: vcDNA=SeqID_11455; Strand=-; Position=134-406
  misc_feature (79)..(87): Xaa can be any naturally occurring amino acid
MKMHDHRPSLILSVYGQLHPSKGFKYSCLYRIVCLMRAISPSLFRGFIQTAKIYDTKSSCIDCLIGTGHVSTHTSNICXXXXXXXXXKNN

SEQ ID NO: 31759 - protein, 122 aa, Diabrotica virgifera
  misc_feature: Coding regions on vcDNA: vcDNA=SeqID_11456; Strand=+; Position=168-532
  misc_feature: Homolog annotation: Hit_ID=XP_314288.1; Match level="QueryCoverage =96%, HitCoverage=25%, E-value=3e-14, Identity=38%"; Hit description =ENSANGP00000013157 [Anopheles gambiae]
  misc_feature: Gene Ontology Annotation: Molecular function=ribose-phosphate pyrophosphokinase activity; Cellular component=cellular_component unknown; Biological process=ribonucleoside monophosphate biosynthesis
  misc_feature (78)..(78): Xaa can be any naturally occurring amino acid
  misc_feature (95)..(95): Xaa can be any naturally occurring amino acid
FEHHICGRLGHEVGTYLTMNFPNLYTCVNSRQPVGHNCFEIEPAPRGLVKDILKALSIMINACKLDAVSEATVVVPCXFPYAHHDEKDTNLSTEXSSLLTMMNPFRWRLRTRSPLPPQLPPN

SEQ ID NO: 31760 - protein, 93 aa, Diabrotica virgifera
  misc_feature: Coding regions on vcDNA: vcDNA=SeqID_11457; Strand=+; Position=219-500
SMLSNHLELERQSTVLISKFQITKTITIYDNHTRYFPYIMYDLLTTSYTTAFLTKSNCNLILNSLMKPYTISSETMILYTVYYELLTLSPPKD

SEQ ID NO: 31761 - protein, 66 aa, Diabrotica virgifera; identical to SEQ ID NO: 26808
  misc_feature: Coding regions on vcDNA: vcDNA=SeqID_11458; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 31762 - protein, 176 aa, Diabrotica virgifera
  misc_feature: Coding regions on vcDNA: vcDNA=SeqID_11459; Strand=+; Position=271-801
  misc_feature (11)..(20): Xaa can be any naturally occurring amino acid
  misc_feature (27)..(43): Xaa can be any naturally occurring amino acid
  misc_feature (58)..(63): Xaa can be any naturally occurring amino acid
  misc_feature (72)..(81): Xaa can be any naturally occurring amino acid
  misc_feature (95)..(104): Xaa can be any naturally occurring amino acid
  misc_feature (110)..(116): Xaa can be any naturally occurring amino acid
  misc_feature (130)..(138): Xaa can be any naturally occurring amino acid
  misc_feature (140)..(164): Xaa can be any naturally occurring amino acid
FLCNAMLFVFXXXXXXXXXXQLYLLPXXXXXXXXXXXXXXXXXHDLPNKTLLKSNFYXXXXXXKSSYSKICXXXXXXXXXXILHNLYIHLYIYIXXXXXXXXXXYSHIAXXXXXXXANKGTLPHFFHLPXXXXXXXXXHXXXXXXXXXXXXXXXXXXXXXXXXXPFIDRCNERFDE

SEQ ID NO: 31763 - protein, 66 aa, Diabrotica virgifera; identical to SEQ ID NO: 27685
  misc_feature: Coding regions on vcDNA: vcDNA=SeqID_11460; Strand=-; Position=2-199
  misc_feature (3)..(9): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 31764 - protein, 77 aa, Diabrotica virgifera
  misc_feature: Coding regions on vcDNA: vcDNA=SeqID_11461; Strand=+; Position=1-234
  misc_feature: Homolog annotation: Hit_ID=XP_393156.1; Match level="QueryCoverage =97%, HitCoverage=8%, E-value=1e-19, Identity=62%"; Hit description =similar to ENSANGP00000018167 [Apis mellifera]
  misc_feature: Pfam annotation: Pfam_ID=UBX; Match level="Score=79.9, E-value=7e-21, Copies=1"; Pfam description=UBX domain
VKLQIRLPDGSSLTQTFGAKEPLSAVRVFVEMKRNSPDDQFHLMTSFPKKVFDNEDYDKPLDSLGLAPSAVLIVKKN

SEQ ID NO: 31765 - protein, 44 aa, Diabrotica virgifera
  misc_feature: Coding regions on vcDNA: vcDNA=SeqID_11462; Strand=-; Position=2-133
  misc_feature (5)..(44): Xaa can be any naturally occurring amino acid
NVSFXXXXXXXXXXXXXXXXXXXXXXXXXXXXXXXXXXXXXXXX

SEQ ID NO: 31766 - protein, 268 aa, Diabrotica virgifera
  misc_feature: Coding regions on vcDNA: vcDNA=SeqID_11463; Strand=+; Position=1-808
  misc_feature: Homolog annotation: Hit_ID=XP_392397.1; Match level="QueryCoverage =95%, HitCoverage=36%, E-value=1e-75, Identity=52%"; Hit description =similar to ENSANGP00000021902 [Apis mellifera]
  misc_feature: Gene Ontology Annotation: Molecular function=trehalose phosphatase activity; Cellular component=alpha, alpha-trehalose-phosphate synthase complex (UDP-forming); Biological process=carbohydrate metabolism
  misc_feature: Pfam annotation: Pfam_ID=Trehalose_PPase; Match level="Score=136.1, E- value=8.2e-38, Copies=1"; Pfam description=Trehalose-phosphatase
  misc_feature (118)..(118): Xaa can be any naturally occurring amino acid
WRFTMSQVTADFEQYLERYLQGSSKLAILLDYDGTLTPIVAHPDLAVIPPEAKNVLEMLSQIPEIFVAIISGRGVTNVKKLVGIDSITYAGNHGLEVIYPDGSKYDHQLPSNFEDQVXELIAKLQEKLGREGAWIENKGASLTFHFREAPAHLREEMEREATKIIEAANFKSSKAHMAVEARPKVDWNKGSVALLLLEQKYRKNWNKEAKVIFVGDDTTDEDAMKALKGNAALFRIAKPCADTNADKIISSTEDTLKILKIALMYTYM

SEQ ID NO: 31767 - protein, 239 aa, Diabrotica virgifera
  misc_feature: Coding regions on vcDNA: vcDNA=SeqID_11464; Strand=-; Position=1-717
  misc_feature (1)..(239): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31768 - protein, 219 aa, Diabrotica virgifera
  misc_feature: Coding regions on vcDNA: vcDNA=SeqID_11465; Strand=+; Position=2-656
  misc_feature: Homolog annotation: Hit_ID=XP_314288.1; Match level="QueryCoverage =83%, HitCoverage=39%, E-value=2e-47, Identity=59%"; Hit description =ENSANGP00000013157 [Anopheles gambiae]
  misc_feature: Gene Ontology Annotation: Molecular function=ribose-phosphate pyrophosphokinase activity; Cellular component=cellular_component unknown; Biological process=nucleobase, nucleoside, nucleotide and nucleic acid metabolism
  misc_feature (60)..(60): Xaa can be any naturally occurring amino acid
  misc_feature (81)..(81): Xaa can be any naturally occurring amino acid
  misc_feature (95)..(95): Xaa can be any naturally occurring amino acid
  misc_feature (112)..(112): Xaa can be any naturally occurring amino acid
PFSRPPVLSLQDPPLLEVRDGELVDNNVVWEENNEIPLLKNIMPNIMGIRGSSHLNLALXFVDRLGIDLGKFLTKNFSHMXTCVEIGQSVRRVDXYIDQSRRAVVKDNLMEXLLIMINACKIYSASQGTEVKPCFPYARQDKKDINISRENQLHVDNWKSIVWNLTRRAPFSAKLVSIMLAGVGAYHILTMDLHSSQIHGFFATPVYNSNAEPAVMKCI

SEQ ID NO: 31769 - protein, 108 aa, Diabrotica virgifera
  misc_feature: Coding regions on vcDNA: vcDNA=SeqID_11466; Strand=-; Position=531-857
  misc_feature (86)..(94): Xaa can be any naturally occurring amino acid
KIEIGPSKQPRQCSKVINNPPAHKQISAVARRGCYGLLYLDGLTQVFLCILTRRTRIFWLTVDPDVDKIVINKELEELHNIDFSQXXXXXXXXXWVILSKQCSYKFFS

SEQ ID NO: 31770 - protein, 133 aa, Diabrotica virgifera
  misc_feature: Coding regions on vcDNA: vcDNA=SeqID_11467; Strand=+; Position=262-663
  misc_feature: Homolog annotation: Hit_ID=XP_393173.1; Match level="QueryCoverage =75%, HitCoverage=2%, E-value=1e-10, Identity=40%"; Hit description =similar to Hypothetical protein CBG09037 [Apis mellifera]
  misc_feature (103)..(103): Xaa can be any naturally occurring amino acid
  misc_feature (106)..(106): Xaa can be any naturally occurring amino acid
MLLKEPLQLPPMSMDMDQTTAKPASYATTYTHRTTSHYAQQAIKFQSAADTAAVVDKHSAQNTATYQPTATTYQTTYPQPAAAQTTIAAQPTTQAKQTNSTTXNHXYDAALYSAATMYVAQQPGTAQHKAVGC

SEQ ID NO: 31771 - protein, 98 aa, Diabrotica virgifera
  misc_feature: Coding regions on vcDNA: vcDNA=SeqID_11468; Strand=-; Position=112-408
  misc_feature (16)..(36): Xaa can be any naturally occurring amino acid
  misc_feature (61)..(71): Xaa can be any naturally occurring amino acid
  misc_feature (73)..(86): Xaa can be any naturally occurring amino acid
  misc_feature (90)..(96): Xaa can be any naturally occurring amino acid
HKTMIFNLLLPQNLYXXXXXXXXXXXXXXXXXXXXXQIFPKYIIHKIIPLQQSNKNHLLFXXXXXXXXXXXIXXXXXXXXXXXXXXTLLXXXXXXXGL

SEQ ID NO: 31772 - protein, 285 aa, Diabrotica virgifera
  misc_feature: Coding regions on vcDNA: vcDNA=SeqID_11469; Strand=+; Position=3-856
  misc_feature: Homolog annotation: Hit_ID=AAS00390.1; Match level="QueryCoverage =99%, HitCoverage=32%, E-value=3e-80, Identity=50%"; Hit description =unknown [Homo sapiens]
  misc_feature: Gene Ontology Annotation: Molecular function=DNA binding; Cellular component=nucleus; Biological process=mismatch repair
  misc_feature: Pfam annotation: Pfam_ID=DNA_mis_repair; Match level="Score=-10.6, E -value=0.021, Copies=1"; Pfam description=DNA mismatch repair protein, C-termina
  misc_feature (236)..(242): Xaa can be any naturally occurring amino acid
  misc_feature (270)..(270): Xaa can be any naturally occurring amino acid
IIDINLREYGSELLEVIDNASGVKPENFESLTLKHYTSKIREFDDLQSLGTLGFRGEALSSLCALSDLVVITRHELSECGTKIIYDRNGKIVEQTPLARGKGTTVTLTKLFSTLPVRRKELMKNLKKEFNKMCQMLYAYCLVSKSVKFTCTNTLSSGSKNTVVATDGKDTIRDNIINVFGSKQISSLIDVTLVPPTEEILTEFGIKQFLDEPLPFDLEFLISSVIHGSGRSANDRXXXXXXXRPCEPSKIMKLVNEVYKSYNSHQYPFVXFNISTKSIFVDVNIT

SEQ ID NO: 31773 - protein, 80 aa, Diabrotica virgifera
  misc_feature: Coding regions on vcDNA: vcDNA=SeqID_11470; Strand=-; Position=531-773
  misc_feature (42)..(48): Xaa can be any naturally occurring amino acid
  misc_feature (51)..(57): Xaa can be any naturally occurring amino acid
ISYIPACFITSHARKNINVSSRIVAASSFIVLGTCNTDQQLXXXXXXXTFXXXXXXXIYSFITRLDKVRENSCKYAISTK

SEQ ID NO: 31774 - protein, 67 aa, Diabrotica virgifera
  misc_feature: Coding regions on vcDNA: vcDNA=SeqID_11471; Strand=-; Position=2-202
NGRIFFICYRCGIVEISYPSESNKEVHYIRTMNLYIHTPFLTFGRVNREGVFAHGVRARRAHLSYIE

SEQ ID NO: 31775 - protein, 300 aa, Diabrotica virgifera
  misc_feature: Coding regions on vcDNA: vcDNA=SeqID_11472; Strand=-; Position=0-899
  misc_feature (2)..(299): Xaa can be any naturally occurring amino acid
IXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXR

SEQ ID NO: 31776 - protein, 275 aa, Diabrotica virgifera
  misc_feature: Coding regions on vcDNA: vcDNA=SeqID_11473; Strand=-; Position=0-824
  misc_feature (3)..(274): Xaa can be any naturally occurring amino acid
FLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 31777 - protein, 98 aa, Diabrotica virgifera
  misc_feature: Coding regions on vcDNA: vcDNA=SeqID_11474; Strand=-; Position=182-478
FVIRCFHCKMSCLANKELFQILSLCPFILFSLYQIDLSYLTVYFFPHSAHWPWLIMSESGIFDIVFRNTGFPRLQDWRWVNSGAHYTCSNSFVIPFFV

SEQ ID NO: 31778 - protein, 67 aa, Diabrotica virgifera
  misc_feature: Coding regions on vcDNA: vcDNA=SeqID_11475; Strand=-; Position=2-202
  misc_feature (4)..(14): Xaa can be any naturally occurring amino acid
  misc_feature (24)..(31): Xaa can be any naturally occurring amino acid
  misc_feature (34)..(47): Xaa can be any naturally occurring amino acid
  misc_feature (53)..(66): Xaa can be any naturally occurring amino acid
VLFXXXXXXXXXXXTNLAHTGLNXXXXXXXXSNXXXXXXXXXXXXXXPTSRSXXXXXXXXXXXXXXV

SEQ ID NO: 31779 - protein, 271 aa, Diabrotica virgifera
  misc_feature: Coding regions on vcDNA: vcDNA=SeqID_11476; Strand=+; Position=45-860
  misc_feature: Homolog annotation: Hit_ID=NP_725952.1; Match level="QueryCoverage =92%, HitCoverage=70%, E-value=4e-62, Identity=47%"; Hit description =CG11200-PA, isoform A [Drosophila melanogaster] ref|NP_611471.1| CG11200-PB, isoform B [Drosophila
  misc_feature: Gene Ontology Annotation: Molecular function=electron transporter activity; Cellular component=mitochondrion; Biological process =induction of apoptosis
  misc_feature: Pfam annotation: Pfam_ID=adh_short; Match level="Score=81.6, E-value =2.1e-21, Copies=1"; Pfam description=short chain dehydrogenase
EIFLNYLNILPIETGRNAVITGGTRGIGVEVIKMLLKCDINVIMGCRNIKQGELLLQNFRDEGIKTGNIDIINLDISVMDSVRNFAKSVKEKYSVIHYLINNAGIMFGPYIETRDGYESQFSTNYLGHFLLTHLLLPLLKAGGTKEKKARIVNVSSCAHFVFGDINFEDINNRHHYISGVAYAQSKMAQILFTKYLDAILEKQKINVQVHAVHPGLCHTDLFNGTNLKKCAPLIPAFSVQSPEKGATPHLYACVSPYIEEKGGTYISKLQK

SEQ ID NO: 31780 - protein, 24 aa, Diabrotica virgifera
  misc_feature: Coding regions on vcDNA: vcDNA=SeqID_11477; Strand=-; Position=2-73
  misc_feature (10)..(23): Xaa can be any naturally occurring amino acid
INFNPTSRSXXXXXXXXXXXXXXV

SEQ ID NO: 31781 - protein, 62 aa, Diabrotica virgifera
  misc_feature: Coding regions on vcDNA: vcDNA=SeqID_11478; Strand=-; Position=266-454
  misc_feature (53)..(61): Xaa can be any naturally occurring amino acid
LTITKHQCTTITTHIRSYHVVRFSFQLRIIILSISVPSYADPNPYILLVMPEXXXXXXXXXM

SEQ ID NO: 31782 - protein, 279 aa, Diabrotica virgifera
  misc_feature: Coding regions on vcDNA: vcDNA=SeqID_11479; Strand=-; Position=0-836
  misc_feature (1)..(35): Xaa can be any naturally occurring amino acid
  misc_feature (37)..(278): Xaa can be any naturally occurring amino acid
XXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXL

SEQ ID NO: 31783 - protein, 103 aa, Diabrotica virgifera
  misc_feature: Coding regions on vcDNA: vcDNA=SeqID_11480; Strand=+; Position=187-498
  misc_feature (54)..(63): Xaa can be any naturally occurring amino acid
  misc_feature (78)..(95): Xaa can be any naturally occurring amino acid
TIKISLVTSNLLHNFFVTNCYSFFNISPFLRNKLNLFTHPIFILHYFHIINIPXXXXXXXXXXFIKIHFLTKHSDHNXXXXXXXXXXXXXXXXXXFYKFLITI

SEQ ID NO: 31784 - protein, 233 aa, Diabrotica virgifera
  misc_feature: Coding regions on vcDNA: vcDNA=SeqID_11481; Strand=+; Position=66-763
  misc_feature: Homolog annotation: Hit_ID=AAL61973.1; Match level="QueryCoverage =100%, HitCoverage=45%, E-value=5e-39, Identity=42%"; Hit description= cytochrome c oxidase subunit I [Aedes albopictus]
  misc_feature (25)..(25): Xaa can be any naturally occurring amino acid
  misc_feature (86)..(86): Xaa can be any naturally occurring amino acid
  misc_feature (95)..(95): Xaa can be any naturally occurring amino acid
  misc_feature (107)..(107): Xaa can be any naturally occurring amino acid
  misc_feature (133)..(133): Xaa can be any naturally occurring amino acid
  misc_feature (144)..(144): Xaa can be any naturally occurring amino acid
  misc_feature (162)..(162): Xaa can be any naturally occurring amino acid
  misc_feature (182)..(182): Xaa can be any naturally occurring amino acid
  misc_feature (219)..(219): Xaa can be any naturally occurring amino acid
GMVGTFFRILVRPELRYGRYLSSYXTLYIVIRYSCLIFMTFIAIVIPIILVGLATCPVALIFVAPHIDFPQINNMPLCLLAATHLXLIIFLHLNXGGLSPPEFITPXLYSNTAHVRLSVSLSIFLSPLAGMSXILLDIYFITTXLHLRPIRIILDRSPLFVXPVSITVPLLLLSLPAIAGSXTILLPDYISNTSLFDTIVAGHPILYQHLFSYLAHHDXYILLLPVSLLISHI

SEQ ID NO: 31785 - protein, 256 aa, Diabrotica virgifera
  misc_feature: Coding regions on vcDNA: vcDNA=SeqID_11482; Strand=-; Position=1-768
  misc_feature (1)..(256): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31786 - protein, 87 aa, Diabrotica virgifera
  misc_feature: Coding regions on vcDNA: vcDNA=SeqID_11483; Strand=+; Position=314-577
  misc_feature (3)..(9): Xaa can be any naturally occurring amino acid
  misc_feature (49)..(54): Xaa can be any naturally occurring amino acid
  misc_feature (66)..(74): Xaa can be any naturally occurring amino acid
YSXXXXXXXTRQKPLLLIISIYIINNFHMITTKYFIGMIVNNTYSIKIXXXXXXYTIKTFHTLKYXXXXXXXXXFLFFILFLLKYII

SEQ ID NO: 31787 - protein, 125 aa, Diabrotica virgifera
  misc_feature: Coding regions on vcDNA: vcDNA=SeqID_11484; Strand=+; Position=287-664
  misc_feature (2)..(22): Xaa can be any naturally occurring amino acid
  misc_feature (27)..(37): Xaa can be any naturally occurring amino acid
  misc_feature (42)..(59): Xaa can be any naturally occurring amino acid
  misc_feature (64)..(83): Xaa can be any naturally occurring amino acid
IXXXXXXXXXXXXXXXXXXXXXYDLIXXXXXXXXXXXKIRIXXXXXXXXXXXXXXXXXXVFVIXXXXXXXXXXXXXXXXXXXXIILLDIYYEYIGILKVFRNIVFSCVLKTCLSVLHITSRLATD

SEQ ID NO: 31788 - protein, 17 aa, Diabrotica virgifera
  misc_feature: Coding regions on vcDNA: vcDNA=SeqID_11485; Strand=-; Position=2-52
  misc_feature (2)..(14): Xaa can be any naturally occurring amino acid
IXXXXXXXXXXXXXLKT

SEQ ID NO: 31789 - protein, 62 aa, Diabrotica virgifera
  misc_feature: Coding regions on vcDNA: vcDNA=SeqID_11486; Strand=+; Position=214-402
LKNIPLSIIILKRKAISFLIYLTSTKICLFYLLNVYLLPHIPILSLIKTLHVRTSRLDLITT

SEQ ID NO: 31790 - protein, 74 aa, Diabrotica virgifera
  misc_feature: Coding regions on vcDNA: vcDNA=SeqID_11487; Strand=-; Position=153-377
CSYHVLSIYYQHSSEYILFSTSIACTLKNILNFMFFAYTLKYILVPNIPSTCVYVVTRNIRKSLFLEYTFIEYS

SEQ ID NO: 31791 - protein, 134 aa, Diabrotica virgifera
  misc_feature: Coding regions on vcDNA: vcDNA=SeqID_11488; Strand=+; Position=178-579
  misc_feature: Homolog annotation: Hit_ID=JN0871; Match level="QueryCoverage=100%, HitCoverage=51%, E-value=3e-19, Identity=41%"; Hit description =ribosomal protein S4 - fruit fly (Drosophila melanogaster) dbj|BAA03786.1| ribosomal protein S4
  misc_feature: Gene Ontology Annotation: Molecular function=structural constituent of ribosome; Cellular component=cytosolic small ribosomal subunit (sensu Eukarya); Biological process=protein biosynthesis
  misc_feature: Pfam annotation: Pfam_ID=Ribosomal_S4e; Match level="Score=2.9, E -value=0.0023, Copies=1"; Pfam description=Ribosomal family S4e
  misc_feature (31)..(31): Xaa can be any naturally occurring amino acid
  misc_feature (90)..(90): Xaa can be any naturally occurring amino acid
  misc_feature (95)..(95): Xaa can be any naturally occurring amino acid
  misc_feature (109)..(109): Xaa can be any naturally occurring amino acid
MNDITTQNNGEFLHVMYHYSRTFVIDRITPXNAKYNLCKLPTDQSASHGLSFLQTHHELPILYPDTDIYLYDMIELKNASSSILNYIIIXIWKLXMIIVLRNLIVCVHXIYLERYPASFDIVHVRYASAHVFAT

SEQ ID NO: 31792 - protein, 111 aa, Diabrotica virgifera
  misc_feature: Coding regions on vcDNA: vcDNA=SeqID_11489; Strand=+; Position=504-836
SWQCWYLRFVTSSFIIGNQILLCSTEKIYQHQCASKSQIQSEFGQTVLSNNLEVLVSLGDGDLASLIRVMAIVTSNLTCLALFYGVLYLFNLFAHRNHHVCIAVLRFPENF

SEQ ID NO: 31793 - protein, 51 aa, Diabrotica virgifera
  misc_feature: Coding regions on vcDNA: vcDNA=SeqID_11490; Strand=-; Position=1-153
  misc_feature (2)..(51): Xaa can be any naturally occurring amino acid
KXXXXXXXXXXXXXXXXXXXXXXXXXXXXXXXXXXXXXXXXXXXXXXXXXX

SEQ ID NO: 31794 - protein, 93 aa, Diabrotica virgifera
  misc_feature: Coding regions on vcDNA: vcDNA=SeqID_11491; Strand=-; Position=118-399
  misc_feature (2)..(8): Xaa can be any naturally occurring amino acid
  misc_feature (45)..(53): Xaa can be any naturally occurring amino acid
IXXXXXXXIINVLLIKKSKVCLKRLDIFTDRRRLHDAENYLKYLXXXXXXXXXALFGSRVIEYMVISLILRRSGKVQEDVLFLVWETKEFSHT

SEQ ID NO: 31795 - protein, 252 aa, Diabrotica virgifera
  misc_feature: Coding regions on vcDNA: vcDNA=SeqID_11492; Strand=-; Position=1-756
  misc_feature (1)..(22): Xaa can be any naturally occurring amino acid
  misc_feature (25)..(236): Xaa can be any naturally occurring amino acid
  misc_feature (238)..(246): Xaa can be any naturally occurring amino acid
XXXXXXXXXXXXXXXXXXXXXXPFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXXXXXGGRGWG

SEQ ID NO: 31796 - protein, 28 aa, Diabrotica virgifera
  misc_feature: Coding regions on vcDNA: vcDNA=SeqID_11493; Strand=+; Position=1-84
  misc_feature (4)..(11): Xaa can be any naturally occurring amino acid
  misc_feature (20)..(28): Xaa can be any naturally occurring amino acid
LTLXXXXXXXXRDDPIEFMXXXXXXXXX

SEQ ID NO: 31797 - protein, 150 aa, Diabrotica virgifera
  misc_feature: Coding regions on vcDNA: vcDNA=SeqID_11494; Strand=+; Position=48-501
  misc_feature: Homolog annotation: Hit_ID=CAH81944.1; Match level="QueryCoverage =90%, HitCoverage=82%, E-value=2e-10, Identity=29%"; Hit description =conserved hypothetical protein [Plasmodium chabaudi]
  misc_feature (68)..(68): Xaa can be any naturally occurring amino acid
HDKKGQKDQTETRTTNTEKRRNSKTKPETLARRQQRRRETKRTPQAEAGNTRPNNKQQQQRNNGGKRXEPRQQRPPRPKKQKTRENEKQIRTKRKPESHKNRKKRQKTRTRRQKHIDKVHDYAILNRIIKPDERSKQAYSIRLVIGYSCR

SEQ ID NO: 31798 - protein, 27 aa, Diabrotica virgifera
  misc_feature: Coding regions on vcDNA: vcDNA=SeqID_11495; Strand=-; Position=1-81
  misc_feature (1)..(18): Xaa can be any naturally occurring amino acid
  misc_feature (21)..(21): Xaa can be any naturally occurring amino acid
  misc_feature (25)..(25): Xaa can be any naturally occurring amino acid
XXXXXXXXXXXXXXXXXXLFXLKIXFL

SEQ ID NO: 31799 - protein, 58 aa, Diabrotica virgifera
  misc_feature: Coding regions on vcDNA: vcDNA=SeqID_11496; Strand=+; Position=248-424
YTHISISSILTDLLALFISHIFIVNYFYIIHIIDLYPSTSNQYVINIYYLIKTSDKQH

SEQ ID NO: 31800 - protein, 43 aa, Diabrotica virgifera
  misc_feature: Coding regions on vcDNA: vcDNA=SeqID_11497; Strand=+; Position=543-671
  misc_feature (26)..(26): Xaa can be any naturally occurring amino acid
ITTILLLLSLPYIYRPITLLLTYRDXDTSYFDTHGERHPILYH

SEQ ID NO: 31801 - protein, 133 aa, Diabrotica virgifera
  misc_feature: Coding regions on vcDNA: vcDNA=SeqID_11498; Strand=+; Position=3-405
  misc_feature: Homolog annotation: Hit_ID=NP_651825.3; Match level="QueryCoverage =82%, HitCoverage=52%, E-value=1e-26, Identity=57%"; Hit description =CG1349-PA [Drosophila melanogaster] gb|AAF57086.2| CG1349-PA [Drosophila melanogaster]
  misc_feature: Gene Ontology Annotation: Biological process=pyrimidine base metabolism
  misc_feature: Pfam annotation: Pfam_ID=DJ-1_PfpI; Match level="Score=68.2, E-value =2.2e-17, Copies=1"; Pfam description=DJ-1/PfpI family
  misc_feature (79)..(79): Xaa can be any naturally occurring amino acid
PPRVRKEVGELLKEQESSGRLIAAISESKEVGELLKEQESRGRLIAAICAAPLSLKAHGIAKGKNLTSYPSVKKDLLDXVKGYQYKEDKVVVDDKLITSRGPGTAFDFGLALIEKLVGKEKAKEVTNAMLVSW

SEQ ID NO: 31802 - protein, 94 aa, Diabrotica virgifera
  misc_feature: Coding regions on vcDNA: vcDNA=SeqID_11499; Strand=+; Position=405-689
  misc_feature (12)..(34): Xaa can be any naturally occurring amino acid
  misc_feature (52)..(64): Xaa can be any naturally occurring amino acid
NPIFKSKSGLKXXXXXXXXXXXXXXXXXXXXXXXYHNITLYYPHLAPPIILXXXXXXXXXXXXXLTQRTFANLFSTCLFTTSSFCITYKASPAH

SEQ ID NO: 31803 - protein, 222 aa, Diabrotica virgifera
  misc_feature: Coding regions on vcDNA: vcDNA=SeqID_11500; Strand=+; Position=112-780
  misc_feature: Homolog annotation: Hit_ID=CAB39733.1; Match level="QueryCoverage =93%, HitCoverage=18%, E-value=3e-25, Identity=36%"; Hit description =protease, reverse transcriptase, ribonuclease H, integrase [Drosophila buzzatii]
  misc_feature (39)..(39): Xaa can be any naturally occurring amino acid
  misc_feature (102)..(102): Xaa can be any naturally occurring amino acid
RKYTTTEKEFLAILLSIEKFRCYIDGSDNFTVITDHEIXSSLQWLYSMKNPSPRIARWIMKLSCHKFIVVADSLSRIPEASLLNQVSLLNLSDLKTDAWYLXIVTDNSDLYPAFKVQDNVLYKHVFSKFKFSDSTPEWKIFVPAPHKKEIILHMYHDYPTASHLGVFKTLSRNSELYYWPKMRPFVVNYVHKCKVCASCKPSNLPPAGFIGQYRDTWSVSYI

SEQ ID NO: 31804 - protein, 61 aa, Diabrotica virgifera
  misc_feature: Coding regions on vcDNA: vcDNA=SeqID_11501; Strand=-; Position=207-392
  misc_feature (29)..(34): Xaa can be any naturally occurring amino acid
VHVLIQNASLVLFRSCHISVGRFLRIFRXXXXXXPFEIDNNVINLGHDKNFTSLSRCVRAD

SEQ ID NO: 31805 - protein, 124 aa, Diabrotica virgifera
  misc_feature: Coding regions on vcDNA: vcDNA=SeqID_11502; Strand=-; Position=154-528
  misc_feature (27)..(57): Xaa can be any naturally occurring amino acid
  misc_feature (82)..(91): Xaa can be any naturally occurring amino acid
  misc_feature (96)..(108): Xaa can be any naturally occurring amino acid
  misc_feature (111)..(120): Xaa can be any naturally occurring amino acid
YICSRIIVILSSLPNLDNLSLYFHKEXXXXXXXXXXXXXXXXXXXXXXXXXXXXXXXNLHGLLLLTSSVKIFNINHITIFNXXXXXXXXXXCISYXXXXXXXXXXXXXKQXXXXXXXXXXILTF

SEQ ID NO: 31806 - protein, 230 aa, Diabrotica virgifera
  misc_feature: Coding regions on vcDNA: vcDNA=SeqID_11503; Strand=+; Position=85-777
  misc_feature: Homolog annotation: Hit_ID=XP_312131.1; Match level="QueryCoverage =90%, HitCoverage=93%, E-value=6e-42, Identity=42%"; Hit description =ENSANGP00000022131 [Anopheles gambiae]
MLKQQVFTRCLVPTVLAAVATDTKEKAVSDNKIDPKLCRPSELPLYTPDPIHNVKQIDDSESNQLEEAIRATRLKLVEINKEVEAYKRVGVEQFEKGKDELDWVVNYLRQEDNTLPKVGAIGIGGLTGLIFGLRGGFIKKTVYAAVGALGISAVCYPKEASEYSQVALTEGKKYAVVAYNFVHGVKKDDPPLELPSLPKLPTSLDEAESVKSFVSSDSSEKTPEKSKDQQ

SEQ ID NO: 31807 - protein, 93 aa, Diabrotica virgifera
  misc_feature: Coding regions on vcDNA: vcDNA=SeqID_11504; Strand=-; Position=14-295
VIHSGGGESAPGLSMDVKIYKEARLSDHMMQQSVPDANIELIIITSHTNSMYYPYLQAIIIPISLIFQFFNHNIKTSEALTIIFNKSQKRYLA

SEQ ID NO: 31808 - protein, 235 aa, Diabrotica virgifera
  misc_feature: Coding regions on vcDNA: vcDNA=SeqID_11505; Strand=-; Position=3-707
  misc_feature (2)..(231): Xaa can be any naturally occurring amino acid
MXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHSYF

SEQ ID NO: 31809 - protein, 70 aa, Diabrotica virgifera
  misc_feature: Coding regions on vcDNA: vcDNA=SeqID_11506; Strand=+; Position=181-393
SSCPTNGHAYVKVTLKIGLLIKNMILIRSSESFLDTRNAIHDPLLLGTQRGTPSTYIGGPPKENVTPIYY

SEQ ID NO: 31810 - protein, 52 aa, Diabrotica virgifera
  misc_feature: Coding regions on vcDNA: vcDNA=SeqID_11507; Strand=-; Position=349-507
  misc_feature (1)..(8): Xaa can be any naturally occurring amino acid
  misc_feature (14)..(25): Xaa can be any naturally occurring amino acid
XXXXXXXXMVISLXXXXXXXXXXXXITYLYICKLFILTVIIRLNVTSSLVLS

SEQ ID NO: 31811 - protein, 40 aa, Diabrotica virgifera
  misc_feature: Coding regions on vcDNA: vcDNA=SeqID_11508; Strand=-; Position=2-121
  misc_feature (6)..(40): Xaa can be any naturally occurring amino acid
KTLINXXXXXXXXXXXXXXXXXXXXXXXXXXXXXXXXXXX

SEQ ID NO: 31812 - protein, 70 aa, Diabrotica virgifera; identical to SEQ ID NO: 28769
  misc_feature: Coding regions on vcDNA: vcDNA=SeqID_11509; Strand=-; Position=3-212
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 31813 - protein, 83 aa, Diabrotica virgifera
  misc_feature: Coding regions on vcDNA: vcDNA=SeqID_11510; Strand=+; Position=2-253
LLQAPAGAPAGGAKPLEDQETKQKTTETTTATTNAERRVHRYFQPYTEVCAIMCGNMCKTQNGMWNMVEAKGNLELNYALCNV

SEQ ID NO: 31814 - protein, 29 aa, Diabrotica virgifera
  misc_feature: Coding regions on vcDNA: vcDNA=SeqID_11511; Strand=-; Position=1-87
  misc_feature (2)..(26): Xaa can be any naturally occurring amino acid
LXXXXXXXXXXXXXXXXXXXXXXXXXFIK

SEQ ID NO: 31815 - protein, 73 aa, Diabrotica virgifera
  misc_feature: Coding regions on vcDNA: vcDNA=SeqID_11512; Strand=-; Position=2-220
  misc_feature (4)..(73): Xaa can be any naturally occurring amino acid
SFLXXXXXXXXXXXXXXXXXXXXXXXXXXXXXXXXXXXXXXXXXXXXXXXXXXXXXXXXXXXXXXXXXXXXXX

SEQ ID NO: 31816 - protein, 35 aa, Diabrotica virgifera
  misc_feature: Coding regions on vcDNA: vcDNA=SeqID_11513; Strand=-; Position=0-104
  misc_feature (1)..(6): Xaa can be any naturally occurring amino acid
  misc_feature (9)..(33): Xaa can be any naturally occurring amino acid
XXXXXXYNXXXXXXXXXXXXXXXXXXXXXXXXXKL

SEQ ID NO: 31817 - protein, 199 aa, Diabrotica virgifera
  misc_feature: Coding regions on vcDNA: vcDNA=SeqID_11514; Strand=+; Position=9-608
  misc_feature (1)..(34): Xaa can be any naturally occurring amino acid
  misc_feature (37)..(59): Xaa can be any naturally occurring amino acid
  misc_feature (63)..(155): Xaa can be any naturally occurring amino acid
  misc_feature (159)..(170): Xaa can be any naturally occurring amino acid
  misc_feature (183)..(197): Xaa can be any naturally occurring amino acid
XXXXXXXXXXXXXXXXXXXXXXXXXXXXXXXXXXIYXXXXXXXXXXXXXXXXXXXXXXXIRFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDYNXXXXXXXXXXXXGIRLHFFHLIINXXXXXXXXXXXXXXXLM

SEQ ID NO: 31818 - protein, 88 aa, Diabrotica virgifera
  misc_feature: Coding regions on vcDNA: vcDNA=SeqID_11515; Strand=+; Position=369-635
ILHLEQEVNQDSLTQRIKEGRGRISKGSRTDKVKTIRSWRKGAETLQIHCIGVQYQRQDMQLIHITPRIFNESTSSKILMWPYFQAIT

SEQ ID NO: 31819 - protein, 235 aa, Diabrotica virgifera
  misc_feature: Coding regions on vcDNA: vcDNA=SeqID_11516; Strand=-; Position=2-706
  misc_feature (24)..(231): Xaa can be any naturally occurring amino acid
ALIQHRGRNLYYRSELSNKITLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDAWK

SEQ ID NO: 31820 - protein, 73 aa, Diabrotica virgifera
  misc_feature: Coding regions on vcDNA: vcDNA=SeqID_11517; Strand=-; Position=408-629
FLFRDYSSNQQVATNAFQDCGCNFEYFVEILGTHIRNIIKNGGTEPKLRNILVCGNYSVIKYNTNKLKMRALS

SEQ ID NO: 31821 - protein, 302 aa, Diabrotica virgifera
  misc_feature: Coding regions on vcDNA: vcDNA=SeqID_11518; Strand=+; Position=2-907
  misc_feature: Homolog annotation: Hit_ID=EAA14204.2; Match level="QueryCoverage =99%, HitCoverage=7%, E-value=2e-48, Identity=40%"; Hit description =ENSANGP00000015073 [Anopheles gambiae str. PEST] ref|XP_553631.1| ENSANGP00000015073 [Anopheles gambiae str
  misc_feature (290)..(290): Xaa can be any naturally occurring amino acid
  misc_feature (295)..(295): Xaa can be any naturally occurring amino acid
GNLYGKKIGTATMSAAKIQATISSKFELEGSLGSLQVLDLTPEGQIHQSILSVGSDPNSDNSHLLYTISDEDKTAFKFRLVKTEEKDALDVMIRMASVWYTHSPYFILELQSCASEFKQYLSNLAKTIRTAATDMALGLVHVRTEALAQSLNLSKNLPNSVYSSAVSISENFTPTRRRSASTSAKDSMISTPTSPNDDSDLILNVNLDVELDSPVIVLPLSNTSTEVFVAHLGKITVNNKYTDEVRIHSVHYRIEWYNIDVKDMNIYSLDIKTRRVLDFKCIKPEVFYIXKYDAXPILHDTI

SEQ ID NO: 31822 - protein, 89 aa, Diabrotica virgifera
  misc_feature: Coding regions on vcDNA: vcDNA=SeqID_11519; Strand=-; Position=220-489
ISKQSAIYVFGPKALSIFLEPCLLYLGTRHNHYLVSTHHSFLSSIRLLIIFHNSLRNFLSNELFVLLRNMVQYTLKSSPKKLDLFSFIS

SEQ ID NO: 31823 - protein, 18 aa, Diabrotica virgifera
  misc_feature: Coding regions on vcDNA: vcDNA=SeqID_11520; Strand=-; Position=0-53
  misc_feature (9)..(9): Xaa can be any naturally occurring amino acid
PFEGVSLHXLRIAGASEG

SEQ ID NO: 31824 - protein, 91 aa, Diabrotica virgifera
  misc_feature: Coding regions on vcDNA: vcDNA=SeqID_11521; Strand=+; Position=3-278
  misc_feature (1)..(41): Xaa can be any naturally occurring amino acid
  misc_feature (57)..(77): Xaa can be any naturally occurring amino acid
  misc_feature (81)..(87): Xaa can be any naturally occurring amino acid
XXXXXXXXXXXXXXXXXXXXXXXXXXXXXXXXXXXXXXXXXIIKLYIYVIIYRFSKXXXXXXXXXXXXXXXXXXXXXVSPXXXXXXXYTSF

SEQ ID NO: 31825 - protein, 104 aa, Diabrotica virgifera
  misc_feature: Coding regions on vcDNA: vcDNA=SeqID_11522; Strand=+; Position=443-754
  misc_feature (13)..(13): Xaa can be any naturally occurring amino acid
  misc_feature (16)..(22): Xaa can be any naturally occurring amino acid
  misc_feature (31)..(48): Xaa can be any naturally occurring amino acid
  misc_feature (52)..(65): Xaa can be any naturally occurring amino acid
  misc_feature (76)..(76): Xaa can be any naturally occurring amino acid
  misc_feature (86)..(95): Xaa can be any naturally occurring amino acid
  misc_feature (99)..(99): Xaa can be any naturally occurring amino acid
MQRSYSLILLRFXVCXXXXXXXGKLYKYGIXXXXXXXXXXXXXXXXXXVFSXXXXXXXXXXXXXXLVPVLLLIIGXGYQPERLEAXXXXXXXXXXISLXLSLNN

SEQ ID NO: 31826 - protein, 282 aa, Diabrotica virgifera
  misc_feature: Coding regions on vcDNA: vcDNA=SeqID_11523; Strand=+; Position=3-848
  misc_feature: Homolog annotation: Hit_ID=AAH70577.1; Match level="QueryCoverage =99%, HitCoverage=23%, E-value=1e-29, Identity=32%"; Hit description =MGC81066 protein [Xenopus laevis]
  misc_feature: Gene Ontology Annotation: Molecular function=molecular_function unknown; Cellular component=cellular_component unknown; Biological process=biological_process unknown
  misc_feature (104)..(109): Xaa can be any naturally occurring amino acid
  misc_feature (261)..(261): Xaa can be any naturally occurring amino acid
  misc_feature (275)..(275): Xaa can be any naturally occurring amino acid
VEELNNLREVENLYNNNLFRLQITELLNEVKIKAKRKTKLTQWLTLFNGTLESIPANKLTLAELEKLVKKAKQKKKKGCLPLLLRITTYKRIFETDQDVNLFLXXXXXXQCFGLYENNCLPGPNLSLNINVVMPQSAFLIKDYLNNRYLVKRWYYLLYVAEYLKQKRLVDNIEIVYHENNHLCPIIKLQPKDCDKTDVFIYVSPQNESFKCTRFLPEQNNVKVDVFECVVDIDTLKSSPTFLYNSLLAHDVTLHDNNEFVXEVLKDHEHVQDAIXLLCIWLT

SEQ ID NO: 31827 - protein, 298 aa, Diabrotica virgifera
  misc_feature: Coding regions on vcDNA: vcDNA=SeqID_11524; Strand=-; Position=0-893
  misc_feature (1)..(24): Xaa can be any naturally occurring amino acid
  misc_feature (29)..(42): Xaa can be any naturally occurring amino acid
  misc_feature (45)..(55): Xaa can be any naturally occurring amino acid
  misc_feature (65)..(72): Xaa can be any naturally occurring amino acid
  misc_feature (75)..(88): Xaa can be any naturally occurring amino acid
  misc_feature (94)..(107): Xaa can be any naturally occurring amino acid
  misc_feature (109)..(291): Xaa can be any naturally occurring amino acid
  misc_feature (293)..(297): Xaa can be any naturally occurring amino acid
XXXXXXXXXXXXXXXXXXXXXXXXFRVLXXXXXXXXXXXXXXPFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXV

SEQ ID NO: 31828 - protein, 168 aa, Diabrotica virgifera
  misc_feature: Coding regions on vcDNA: vcDNA=SeqID_11525; Strand=+; Position=264-770
  misc_feature: Homolog annotation: Hit_ID=EAL29441.1; Match level="QueryCoverage =97%, HitCoverage=83%, E-value=2e-70, Identity=78%"; Hit description =GA11315-PA [Drosophila pseudoobscura]
  misc_feature: Gene Ontology Annotation: Molecular function=N-acetyltransferase activity; Cellular component=nucleus; Biological process=chromosome organization and biogenesis (sensu Eukarya)
  misc_feature: Pfam annotation: Pfam_ID=Acetyltransf_1; Match level="Score=70.6, E -value=4.3e-18, Copies=1"; Pfam description=Acetyltransferase (GNAT) family
  misc_feature (57)..(68): Xaa can be any naturally occurring amino acid
  misc_feature (165)..(165): Xaa can be any naturally occurring amino acid
MNIRCAKPEDLMNMQHCNLLCLPENYQMKYYFYHGLSWPQLSYVAEDEKGNIVGYVXXXXXXXXXXXXHGHITSLAVKRSHRRLGLAQKLMDQASEAMVECFDAKYVSLHVRKSNRAALNLYKNSLKFETVEIEPKYYADGEDAYSMRRDLSEFAKKVKPKSETXNEE

SEQ ID NO: 31829 - protein, 181 aa, Diabrotica virgifera
  misc_feature: Coding regions on vcDNA: vcDNA=SeqID_11526; Strand=-; Position=2-544
  misc_feature (22)..(28): Xaa can be any naturally occurring amino acid
  misc_feature (33)..(181): Xaa can be any naturally occurring amino acid
RGRNLYYRFELFNKITQLSVRXXXXXXXKIGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31830 - protein, 38 aa, Diabrotica virgifera
  misc_feature: Coding regions on vcDNA: vcDNA=SeqID_11527; Strand=-; Position=1-114
  misc_feature (6)..(38): Xaa can be any naturally occurring amino acid
FIHPKXXXXXXXXXXXXXXXXXXXXXXXXXXXXXXXXX

SEQ ID NO: 31831 - protein, 69 aa, Diabrotica virgifera
  misc_feature: Coding regions on vcDNA: vcDNA=SeqID_11528; Strand=-; Position=302-511
  misc_feature (49)..(56): Xaa can be any naturally occurring amino acid
QINMEYFSPVSELMSALFVCHLQNFDSDLLYEIVNKDTERDKRKIPILXXXXXXXXVNTRKSKTLQNSI

SEQ ID NO: 31832 - protein, 97 aa, Diabrotica virgifera
  misc_feature: Coding regions on vcDNA: vcDNA=SeqID_11529; Strand=+; Position=517-810
  misc_feature (5)..(22): Xaa can be any naturally occurring amino acid
  misc_feature (25)..(41): Xaa can be any naturally occurring amino acid
  misc_feature (59)..(68): Xaa can be any naturally occurring amino acid
  misc_feature (73)..(93): Xaa can be any naturally occurring amino acid
IWNLXXXXXXXXXXXXXXXXXXIFXXXXXXXXXXXXXXXXXSFIINYWLRLSTRTFIGXXXXXXXXXXNIITXXXXXXXXXXXXXXXXXXXXXFKFK

SEQ ID NO: 31833 - protein, 75 aa, Diabrotica virgifera
  misc_feature: Coding regions on vcDNA: vcDNA=SeqID_11530; Strand=-; Position=2-226
SYSIHPPIRDNVKIVVIGGQAKIFSLAVYETENSGSISYIYNMSSCLTEYSWVLSCMDSGRYNIVNAVFARTREW

SEQ ID NO: 31834 - protein, 244 aa, Diabrotica virgifera
  misc_feature: Coding regions on vcDNA: vcDNA=SeqID_11531; Strand=+; Position=49-783
  misc_feature: Homolog annotation: Hit_ID=CAG04038.1; Match level="QueryCoverage =85%, HitCoverage=36%, E-value=2e-49, Identity=47%"; Hit description =unnamed protein product [Tetraodon nigroviridis]
MDIDNGPEVPVPVSGTGVDIEQSFLQQFSCMGTTDKDELIQQLQKLVGSQLNYSTAAFFLDMNNWNLQAAICSYFDIESPCPLPSMKLISDPVASEHTDVEPNVRFTKSWNLVNSGTEKWPANCYAQCSDGDNFGADRVPVPSLDPEEGYHLAVDMVSPTVPGIYQSKWRMCTDIGTYFGDPMWVIVTVVEEGTVALTNQLSHFNELGALPPPTSNYNPFSPHQIHIGHNPDTAPPDEKDTSMF

SEQ ID NO: 31835 - protein, 63 aa, Diabrotica virgifera
  misc_feature: Coding regions on vcDNA: vcDNA=SeqID_11532; Strand=+; Position=64-255
YLTCEILQNVLSLFKKHISYGSIPIKAHLIRMIQFLIYYPQINKLLVSLSNFKWVASSMGHTQ

SEQ ID NO: 31836 - protein, 132 aa, Diabrotica virgifera
  misc_feature: Coding regions on vcDNA: vcDNA=SeqID_11533; Strand=-; Position=1-396
  misc_feature (2)..(132): Xaa can be any naturally occurring amino acid
TXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31837 - protein, 23 aa, Diabrotica virgifera
  misc_feature: Coding regions on vcDNA: vcDNA=SeqID_11534; Strand=+; Position=1-69
QLNDYNLTLQLNTDILKGLNLFR

SEQ ID NO: 31838 - protein, 320 aa, Diabrotica virgifera
  misc_feature: Coding regions on vcDNA: vcDNA=SeqID_11535; Strand=+; Position=3-965
  misc_feature (17)..(156): Xaa can be any naturally occurring amino acid
  misc_feature (161)..(212): Xaa can be any naturally occurring amino acid
  misc_feature (225)..(233): Xaa can be any naturally occurring amino acid
  misc_feature (236)..(243): Xaa can be any naturally occurring amino acid
  misc_feature (254)..(314): Xaa can be any naturally occurring amino acid
CAASHHPSGPPASTHAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIKNFXXXXXXXXXXXXXXXXXXXXXXXXXXXXXXXXXXXXXXXXXXXXXXXXXXXXLKQFGHIFFTCLXXXXXXXXXINXXXXXXXXEWPRYSDRAKXXXXXXXXXXXXXXXXXXXXXXXXXXXXXXXXXXXXXXXXXXXXXXXXXXXXXXXXXXXXXLYIKFI

SEQ ID NO: 31839 - protein, 50 aa, Diabrotica virgifera
  misc_feature: Coding regions on vcDNA: vcDNA=SeqID_11536; Strand=-; Position=228-380
QDLRKHHLLRKITKRQATSLVAGSFTILNLSLYPRTHQALQRLTICNIGK

SEQ ID NO: 31840 - protein, 61 aa, Diabrotica virgifera
  misc_feature: Coding regions on vcDNA: vcDNA=SeqID_11537; Strand=-; Position=390-575
STVWIGEDRSQFVSDYAFLQIKIMPRQSMRKLQAIHQYRVWSHLNVESYQLFRGNFCYFML

SEQ ID NO: 31841 - protein, 53 aa, Diabrotica virgifera
  misc_feature: Coding regions on vcDNA: vcDNA=SeqID_11538; Strand=-; Position=428-589
VRTQSACNERYGRYLVAIRYIHPNDIGHVDTKKRECVGKHRYDYDLIIEHVSQ

SEQ ID NO: 31842 - protein, 85 aa, Diabrotica virgifera
  misc_feature: Coding regions on vcDNA: vcDNA=SeqID_11539; Strand=-; Position=0-254
  misc_feature (70)..(76): Xaa can be any naturally occurring amino acid
TKRRQFSFSSALSFYDSIKYNDDLHFFMLAKNISFIPINHRADGGDVLKLYSHLVNIQVKKTLHNYVHIXXXXXXXVISVILILA

SEQ ID NO: 31843 - protein, 109 aa, Diabrotica virgifera
  misc_feature: Coding regions on vcDNA: vcDNA=SeqID_11540; Strand=+; Position=126-455
QEDFGVYDYAILLFHQLTFSCVYFIGFSNSITNHFFNFNTQGIRIARYEIIRISGIEENPPYTHELSFNPYISFDIKHFNYSATFDRSPFLIGRTIRSRCIFDISSPRM

SEQ ID NO: 31844 - protein, 67 aa, Diabrotica virgifera
  misc_feature: Coding regions on vcDNA: vcDNA=SeqID_11541; Strand=+; Position=43-246
  misc_feature (28)..(38): Xaa can be any naturally occurring amino acid
SKVANFPLKHFDNYLYVGCKVGLCKEIXXXXXXXXXXXWSWQIIRTKRSSLITLPLHFIYVSGSKDQ

SEQ ID NO: 31845 - protein, 254 aa, Diabrotica virgifera
  misc_feature: Coding regions on vcDNA: vcDNA=SeqID_11542; Strand=+; Position=2-766
  misc_feature (9)..(15): Xaa can be any naturally occurring amino acid
  misc_feature (151)..(159): Xaa can be any naturally occurring amino acid
LKSDLPILXXXXXXXEHVHKDEALIVNIDKQVDDILSVHPQHKQYVKMERMKLSLLKAKHVMSLESKESEALIAEQKEKNELIEKMAVTMKYFYQLLQGHGVAPSNVTKQYQEISQSILGRKHITWGPLPDSGISSEASIAVSDLDEMHEXXXXXXXXXNQTFSMPSKPTKTPDLFRIKGRNNITFARPVVRRTPAKNTKDKENKENGYRKPFDSTKTSVTTAKSTAKSLLNSGFKGTVSSRAKTIINPPRFKR

SEQ ID NO: 31846 - protein, 82 aa, Diabrotica virgifera
  misc_feature: Coding regions on vcDNA: vcDNA=SeqID_11543; Strand=+; Position=338-586
  misc_feature (2)..(7): Xaa can be any naturally occurring amino acid
SXXXXXXPIFGHVALKINIFFECTFSPQIYIMNFHILKYDIIDYYILSSCSFFSISSLPIKFYHPTLRTAETSKIPIPEYLK

SEQ ID NO: 31847 - protein, 281 aa, Diabrotica virgifera
  misc_feature: Coding regions on vcDNA: vcDNA=SeqID_11544; Strand=+; Position=3-848
  misc_feature (36)..(66): Xaa can be any naturally occurring amino acid
  misc_feature (72)..(186): Xaa can be any naturally occurring amino acid
  misc_feature (193)..(264): Xaa can be any naturally occurring amino acid
  misc_feature (269)..(279): Xaa can be any naturally occurring amino acid
LHRPGLPSPFHPRARARVGYNSSFKIITSLFSKSNXXXXXXXXXXXXXXXXXXXXXXXXXXXXXXXGFLIPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXINFNYLXXXXXXXXXXXXXXXXXXXXXXXXXXXXXXXXXXXXXXXXXXXXXXXXXXXXXXXXXXXXXXXXXXXXXXXXNAGMXXXXXXXXXXXNS

SEQ ID NO: 31848 - protein, 96 aa, Diabrotica virgifera
  misc_feature: Coding regions on vcDNA: vcDNA=SeqID_11545; Strand=-; Position=0-287
  misc_feature (20)..(26): Xaa can be any naturally occurring amino acid
  misc_feature (65)..(77): Xaa can be any naturally occurring amino acid
  misc_feature (84)..(91): Xaa can be any naturally occurring amino acid
QRSCIPFQKSCCNYFFSGRXXXXXXXLIWKIRSESCWFNISRILQGYNKNRIVSLYNKKEFFLPXXXXXXXXXXXXXLLKKCGXXXXXXXXGGAGG

SEQ ID NO: 31849 - protein, 36 aa, Diabrotica virgifera
  misc_feature: Coding regions on vcDNA: vcDNA=SeqID_11546; Strand=-; Position=0-107
  misc_feature (4)..(30): Xaa can be any naturally occurring amino acid
PPQXXXXXXXXXXXXXXXXXXXXXXXXXXXYRGLLR

SEQ ID NO: 31850 - protein, 70 aa, Diabrotica virgifera
  misc_feature: Coding regions on vcDNA: vcDNA=SeqID_11547; Strand=-; Position=0-209
CESVILRKNLELSQMIQHPVAQLWKVPFVAGLFQVPLFCDSLLLLRGIFTAQHLYKDSLAARVKESAGIR

SEQ ID NO: 31851 - protein, 61 aa, Diabrotica virgifera
  misc_feature: Coding regions on vcDNA: vcDNA=SeqID_11548; Strand=-; Position=2-184
  misc_feature (2)..(10): Xaa can be any naturally occurring amino acid
  misc_feature (12)..(21): Xaa can be any naturally occurring amino acid
  misc_feature (26)..(35): Xaa can be any naturally occurring amino acid
  misc_feature (37)..(59): Xaa can be any naturally occurring amino acid
IXXXXXXXXXPXXXXXXXXXXILKNXXXXXXXXXXLXXXXXXXXXXXXXXXXXXXXXXXSS

SEQ ID NO: 31852 - protein, 117 aa, Diabrotica virgifera
  misc_feature: Coding regions on vcDNA: vcDNA=SeqID_11549; Strand=-; Position=1-351
  misc_feature (2)..(15): Xaa can be any naturally occurring amino acid
  misc_feature (17)..(117): Xaa can be any naturally occurring amino acid
PXXXXXXXXXXXXXXQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31853 - protein, 19 aa, Diabrotica virgifera
  misc_feature: Coding regions on vcDNA: vcDNA=SeqID_11550; Strand=-; Position=1-57
LKSSYLIFSGYKIAPPRRL

SEQ ID NO: 31854 - protein, 156 aa, Diabrotica virgifera
  misc_feature: Coding regions on vcDNA: vcDNA=SeqID_11551; Strand=+; Position=351-818
  misc_feature (8)..(14): Xaa can be any naturally occurring amino acid
  misc_feature (43)..(63): Xaa can be any naturally occurring amino acid
  misc_feature (95)..(156): Xaa can be any naturally occurring amino acid
THLFTIYXXXXXXXSLILHIFRHELTTTISLQFNFSLKITITXXXXXXXXXXXXXXXXXXXXXNFLLTYQLKLFNFSNDDHITIKKSHIYQTYIXXXXXXXXXXXXXXXXXXXXXXXXXXXXXXXXXXXXXXXXXXXXXXXXXXXXXXXXXXXXXX

SEQ ID NO: 31855 - protein, 279 aa, Diabrotica virgifera
  misc_feature: Coding regions on vcDNA: vcDNA=SeqID_11552; Strand=-; Position=0-836
  misc_feature (1)..(19): Xaa can be any naturally occurring amino acid
  misc_feature (29)..(43): Xaa can be any naturally occurring amino acid
  misc_feature (47)..(261): Xaa can be any naturally occurring amino acid
  misc_feature (269)..(275): Xaa can be any naturally occurring amino acid
XXXXXXXXXXXXXXXXXXXRLNNNIRYKXXXXXXXXXXXXXXXVNKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQYVINLSXXXXXXXLLFT

SEQ ID NO: 31856 - protein, 127 aa, Diabrotica virgifera
  misc_feature: Coding regions on vcDNA: vcDNA=SeqID_11553; Strand=+; Position=67-450
  misc_feature (11)..(16): Xaa can be any naturally occurring amino acid
  misc_feature (20)..(36): Xaa can be any naturally occurring amino acid
  misc_feature (47)..(53): Xaa can be any naturally occurring amino acid
  misc_feature (56)..(64): Xaa can be any naturally occurring amino acid
  misc_feature (68)..(78): Xaa can be any naturally occurring amino acid
  misc_feature (80)..(118): Xaa can be any naturally occurring amino acid
YNILLLKRKNXXXXXXLVNXXXXXXXXXXXXXXXXXLGVSRIINYHXXXXXXXISXXXXXXXXXAQYXXXXXXXXXXXIXXXXXXXXXXXXXXXXXXXXXXXXXXXXXXXXXXXXXXXNNILLQFNF

SEQ ID NO: 31857 - protein, 125 aa, Diabrotica virgifera
  misc_feature: Coding regions on vcDNA: vcDNA=SeqID_11554; Strand=+; Position=112-492
  misc_feature: Homolog annotation: Hit_ID=XP_312603.1; Match level="QueryCoverage =94%, HitCoverage=29%, E-value=3e-23, Identity=43%"; Hit description =ENSANGP00000014914 [Anopheles gambiae]
  misc_feature: Gene Ontology Annotation: Molecular function=glutamate-ammonia ligase activity
  misc_feature: Pfam annotation: Pfam_ID=Gln-synt_N; Match level="Score=20.8, E-value= 1.9e-05, Copies=1"; Pfam description=Glutamine synthetase, beta-Grasp domai
  misc_feature (46)..(46): Xaa can be any naturally occurring amino acid
  misc_feature (61)..(61): Xaa can be any naturally occurring amino acid
  misc_feature (85)..(85): Xaa can be any naturally occurring amino acid
  misc_feature (100)..(100): Xaa can be any naturally occurring amino acid
WIKLVYSSPYVALNKSLLQHNLTLPIPDGKCHYTYIWIYVSGENVXCKTMTLDFVPTCPKXLPVWNFNSNFTQIKTNDTAQMSFXPATMCKDPFLKGNYXLFLCDTYKYNHKRNRDSESNSNTHC

SEQ ID NO: 31858 - protein, 236 aa, Diabrotica virgifera
  misc_feature: Coding regions on vcDNA: vcDNA=SeqID_11555; Strand=+; Position=2-712
  misc_feature (1)..(83): Xaa can be any naturally occurring amino acid
  misc_feature (86)..(135): Xaa can be any naturally occurring amino acid
  misc_feature (155)..(184): Xaa can be any naturally occurring amino acid
  misc_feature (216)..(230): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXIFXXXXXXXXXXXXXXXXXXXXXXXXXXXXXXXXXXXXXXXXXXXXXXXXXXITITNFHILPYVIIYLYILXXXXXXXXXXXXXXXXXXXXXXXXXXXXXXYISLQYIGLLKESRNLSFTCLLQTCLSALHTXXXXXXXXXXXXXXXDRANVA

SEQ ID NO: 31859 - protein, 193 aa, Diabrotica virgifera
  misc_feature: Coding regions on vcDNA: vcDNA=SeqID_11556; Strand=-; Position=2-580
  misc_feature (8)..(24): Xaa can be any naturally occurring amino acid
  misc_feature (29)..(120): Xaa can be any naturally occurring amino acid
  misc_feature (125)..(143): Xaa can be any naturally occurring amino acid
  misc_feature (147)..(159): Xaa can be any naturally occurring amino acid
  misc_feature (164)..(179): Xaa can be any naturally occurring amino acid
  misc_feature (185)..(192): Xaa can be any naturally occurring amino acid
PGEKKVAXXXXXXXXXXXXXXXXXLNIIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNTIPXXXXXXXXXXXXXXXXXXXLLNXXXXXXXXXXXXXGSPGXXXXXXXXXXXXXXXXILITYXXXXXXXXF

SEQ ID NO: 31860 - protein, 104 aa, Diabrotica virgifera
  misc_feature: Coding regions on vcDNA: vcDNA=SeqID_11557; Strand=-; Position=220-534
RFLFSLQKVITFSNNLGSITYSKFTQEFYSVSMEDVVLDRVIHFRPWCMKVISGTNKGMEIASHGMGNLKCHLRDSPLRLEDSRAHHLQLFLSHIVNFFGGVYS

SEQ ID NO: 31861 - protein, 294 aa, Diabrotica virgifera
  misc_feature: Coding regions on vcDNA: vcDNA=SeqID_11558; Strand=-; Position=0-881
  misc_feature (1)..(278): Xaa can be any naturally occurring amino acid
  misc_feature (285)..(292): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEYIINIXXXXXXXXIR

SEQ ID NO: 31862 - protein, 146 aa, Diabrotica virgifera
  misc_feature: Coding regions on vcDNA: vcDNA=SeqID_11559; Strand=-; Position=293-733
  misc_feature (27)..(39): Xaa can be any naturally occurring amino acid
  misc_feature (44)..(74): Xaa can be any naturally occurring amino acid
  misc_feature (99)..(114): Xaa can be any naturally occurring amino acid
FIQAFVPAFNKRTNDCAALARSRYRGXXXXXXXXXXXXXDTKRXXXXXXXXXXXXXXXXXXXXXXXXXXXXXXXLSSLVDLNNLSLYVNRKFMKNRNNXXXXXXXXXXXXXXXXIVIFIWKLDFNKMLVLSSALEIFNMKNIKVVN

SEQ ID NO: 31863 - protein, 167 aa, Diabrotica virgifera
  misc_feature: Coding regions on vcDNA: vcDNA=SeqID_11560; Strand=+; Position=236-734
  misc_feature: Homolog annotation: Hit_ID=NP_730443.1; Match level="QueryCoverage =96%, HitCoverage=30%, E-value=2e-44, Identity=53%"; Hit description =CG8756-PB, isoform B [Drosophila melanogaster] gb|AAF49122.1| CG8756- PB, isoform B [Drosophila
  misc_feature (33)..(33): Xaa can be any naturally occurring amino acid
  misc_feature (63)..(63): Xaa can be any naturally occurring amino acid
  misc_feature (95)..(95): Xaa can be any naturally occurring amino acid
MYITSHLYEEIFSCTKLNFFISHKYTNYSSLQXDLHKQSHEITSIAVTHKKDPNYCSQMSYDXVMTKMCVTRLIIEIFAYITCVSILVLISRYLXIGRNMKFTMITYQFFIYDSSITGSLGPVPILSYTLYFKIPHKCYGNDHYCPITSRHVYEIVMNELDRHDNPT

SEQ ID NO: 31864 - protein, 105 aa, Diabrotica virgifera
  misc_feature: Coding regions on vcDNA: vcDNA=SeqID_11561; Strand=+; Position=254-571
  misc_feature (11)..(17): Xaa can be any naturally occurring amino acid
STSLIVGRTWXXXXXXXEGNAEDQEEDLEHDGQTKLRLWWENHNMKASIWHRIAAIGYSKLTIFRVSPRPDKGSRNEEERVFILKLIVKVRQDMLRMPYRTSSRT

SEQ ID NO: 31865 - protein, 18 aa, Diabrotica virgifera
  misc_feature: Coding regions on vcDNA: vcDNA=SeqID_11562; Strand=-; Position=1-54
  misc_feature (1)..(18): Xaa can be any naturally occurring amino acid
XXXXXXXXXXXXXXXXXX

SEQ ID NO: 31866 - protein, 86 aa, Diabrotica virgifera
  misc_feature: Coding regions on vcDNA: vcDNA=SeqID_11563; Strand=-; Position=243-503
KPLVRTSVSSLTLNRHVSQCSHSPPNVHATIVRTNLYPHYYGSENTHPPTCKMVYLAADLLEEWGVVWMGDCENIRVSLPVIDKYD

SEQ ID NO: 31867 - protein, 93 aa, Diabrotica virgifera
  misc_feature: Coding regions on vcDNA: vcDNA=SeqID_11564; Strand=-; Position=183-464
  misc_feature (41)..(54): Xaa can be any naturally occurring amino acid
YFSNTRHVHRYKQEYPRLCIGVCIIDHGDKVASWNVYELSXXXXXXXXXXXXXXAEVDGGVSYIDRYCRIQDGKVYDLDVKFVEIGGGVVDWY

SEQ ID NO: 31868 - protein, 196 aa, Diabrotica virgifera
  misc_feature: Coding regions on vcDNA: vcDNA=SeqID_11565; Strand=+; Position=106-695
  misc_feature: Homolog annotation: Hit_ID=AAF34686.1; Match level="QueryCoverage =96%, HitCoverage=50%, E-value=4e-38, Identity=47%"; Hit description =actin [Schistosoma japonicum] gb|AAC46966.1| actin sp|P53471|ACT2 _SCHMA ACTIN 2
  misc_feature: Gene Ontology Annotation: Biological process=reproduction
  misc_feature (48)..(48): Xaa can be any naturally occurring amino acid
  misc_feature (54)..(54): Xaa can be any naturally occurring amino acid
  misc_feature (71)..(71): Xaa can be any naturally occurring amino acid
  misc_feature (80)..(80): Xaa can be any naturally occurring amino acid
  misc_feature (90)..(90): Xaa can be any naturally occurring amino acid
  misc_feature (129)..(129): Xaa can be any naturally occurring amino acid
  misc_feature (153)..(153): Xaa can be any naturally occurring amino acid
MRMRECAAHDVPIGDFPSIVELSLTPAVLVSMGQKDYCNVELHQTTRXYLCLIXPIQYPILTNCLDMQKTXIYTFYIALXVTREQHPALXTKCPPHSIIDRENMTTVMVEPYYTRSMHVGIYCELSLYXTEHTTGIVLHTGRGVSHTVPVYGXHDHPHGLLHCGLSGGDLTDYLMKPFTERVYSFATQVERVYATD

SEQ ID NO: 31869 - protein, 34 aa, Diabrotica virgifera
  misc_feature: Coding regions on vcDNA: vcDNA=SeqID_11566; Strand=+; Position=3-107
PFCTIIYEEIKDRNQPGSHRIILRSCKSLKDEQT

SEQ ID NO: 31870 - protein, 140 aa, Diabrotica virgifera
  misc_feature: Coding regions on vcDNA: vcDNA=SeqID_11567; Strand=+; Position=2-424
  misc_feature (12)..(49): Xaa can be any naturally occurring amino acid
  misc_feature (55)..(99): Xaa can be any naturally occurring amino acid
  misc_feature (106)..(130): Xaa can be any naturally occurring amino acid
  misc_feature (134)..(140): Xaa can be any naturally occurring amino acid
APEFPPLPPPRXXXXXXXXXXXXXXXXXXXXXXXXXXXXXXXXXXXXXXIRFYIXXXXXXXXXXXXXXXXXXXXXXXXXXXXXXXXXXXXXXXXXXXXXLKITIKXXXXXXXXXXXXXXXXXXXXXXXXXPIYXXXXXXX

SEQ ID NO: 31871 - protein, 23 aa, Diabrotica virgifera
  misc_feature: Coding regions on vcDNA: vcDNA=SeqID_11568; Strand=-; Position=1-69
  misc_feature (1)..(23): Xaa can be any naturally occurring amino acid
XXXXXXXXXXXXXXXXXXXXXXX

SEQ ID NO: 31872 - protein, 242 aa, Diabrotica virgifera
  misc_feature: Coding regions on vcDNA: vcDNA=SeqID_11569; Strand=-; Position=3-728
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(195): Xaa can be any naturally occurring amino acid
  misc_feature (234)..(242): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGIITRRKKCWLNSRHYSIDSLVRLAGFGTVISGCLSRIXXXXXXXXX

SEQ ID NO: 31873 - protein, 24 aa, Diabrotica virgifera
  misc_feature: Coding regions on vcDNA: vcDNA=SeqID_11570; Strand=-; Position=1-72
  misc_feature (17)..(18): Xaa can be any naturally occurring amino acid
INLIQHRGRNLIYRLTXXNKITLL

SEQ ID NO: 31874 - protein, 183 aa, Diabrotica virgifera
  misc_feature: Coding regions on vcDNA: vcDNA=SeqID_11571; Strand=+; Position=113-668
  misc_feature: Homolog annotation: Hit_ID=CAA67343.1; Match level="QueryCoverage =97%, HitCoverage=51%, E-value=1e-40, Identity=49%"; Hit description =40-kDa V-ATPase subunit [Manduca sexta] sp|Q25531|VA0D_MANSE Vacuolar ATP synthase subunit d (V-ATPase d
  misc_feature: Gene Ontology Annotation: Molecular function=hydrogen-transporting ATPase activity, rotational mechanism; Cellular component=hydrogen -transporting ATPase V0 domain; Biological process=hydrogen transport
  misc_feature: Pfam annotation: Pfam_ID=vATP-synt_AC39; Match level="Score=-144.6, E- value=0.028, Copies=1"; Pfam description=ATP synthase (C/AC39) subunit
  misc_feature (27)..(27): Xaa can be any naturally occurring amino acid
  misc_feature (71)..(71): Xaa can be any naturally occurring amino acid
  misc_feature (82)..(82): Xaa can be any naturally occurring amino acid
  misc_feature (89)..(89): Xaa can be any naturally occurring amino acid
  misc_feature (120)..(120): Xaa can be any naturally occurring amino acid
  misc_feature (161)..(161): Xaa can be any naturally occurring amino acid
MDFIIYSYKIVNIITHIPRTRHQRPIXDLLPISHPLHRFDKMQHIHEAATPTQIYHAVLGATRLAPFLAEXFNKQNVAHMNXEIIIITXTKITSETSYTTCNELAGTTDDTLCAILNFEXDILDIMMTIFSVVPELRQDDRDKQYPRCGRLNTVKLADLVXAEDYDKVSSAVVYYTDYSDCLL

SEQ ID NO: 31875 - protein, 107 aa, Diabrotica virgifera
  misc_feature: Coding regions on vcDNA: vcDNA=SeqID_11572; Strand=-; Position=311-634
AEYGLLGLPPSIPALTPYATPSKMAALFFFSAVTVFISNLSKCRLFLSAVTVLLFRNCQNVICHCSRLFFSAITVLFSYLPFLYFFFINYQLSFLSLLFYHCQYAYA

SEQ ID NO: 31876 - protein, 74 aa, Diabrotica virgifera
  misc_feature: Coding regions on vcDNA: vcDNA=SeqID_11573; Strand=-; Position=558-782
NDSIRIKWSSYLCHKRVIFQTNIDGNNRTLKVAGAFIISIYKFIVELNGRQSKGYVILNTQYSDSGICVMRKRC

SEQ ID NO: 31877 - protein, 110 aa, Diabrotica virgifera
  misc_feature: Coding regions on vcDNA: vcDNA=SeqID_11574; Strand=+; Position=38-370
RHRAQMGDVTGMIYNMPKSRGLKIKIGLFRGFFFKIVHSLENEFVPTFACSLYKQGYLAIQTTNIYCTFILDIIFYIKTLQVSFFENFSIKKVERTLYLYIWMSMTLYRN

SEQ ID NO: 31878 - protein, 201 aa, Diabrotica virgifera
  misc_feature: Coding regions on vcDNA: vcDNA=SeqID_11575; Strand=+; Position=1-606
  misc_feature: Homolog annotation: Hit_ID=AAC72921.1; Match level="QueryCoverage =100%, HitCoverage=20%, E-value=3e-21, Identity=32%"; Hit description= putative endonuclease/reverse transcriptase [Lymantria dispar]
  misc_feature: Pfam annotation: Pfam_ID=RVT_1; Match level="Score=-32.4, E-value =0.016, Copies=1"; Pfam description=Reverse transcriptase (RNA -dependent
  misc_feature (91)..(91): Xaa can be any naturally occurring amino acid
LFLDIKEAYDSVDWTILRNKMINLQIPEEVANTILKLYINRSVAIRKDNGIISEYLLVTKGLPQGSVLSPLLFNIYTYDLHNISPNANIIXYADDFVFYTHARSYDKSLQSLNTALTPFIQNISNLGFDLSPHKSKVVIFTRHNIPNCTTIQLNDINFSLTNQIKYLGITLDKKLTFRAHIEEILQKCSKGLNFLKCIMRT

SEQ ID NO: 31879 - protein, 272 aa, Diabrotica virgifera
  misc_feature: Coding regions on vcDNA: vcDNA=SeqID_11576; Strand=+; Position=83-898
  misc_feature: Homolog annotation: Hit_ID=EAL32838.1; Match level="QueryCoverage =93%, HitCoverage=42%, E-value=2e-29, Identity=33%"; Hit description =GA17447-PA [Drosophila pseudoobscura]
MDIQTITPLQFAENEHNFSELLKDESIRNKIPLLNVNKIEHLGDLKLVRFHGMIQDMHSPEYYLEKFEVVNEDTKESSWVIGKYRECIKVKESVEQINFHNNSNITSERQAFVVISIPAKNSWVRSVEETHTIQPTKCAAANTSSGKRIHEESMDAEETVGPSTSRIPGSKKICSETTQSVDNKPASSQQNDIFPLSDTLINDQKQVFHIKLYNDQDQLKINDVCEFVGFLDIDPSTNANMCIGDMETEESTCFIPKIHCVHFTKLKHNNPL

SEQ ID NO: 31880 - protein, 319 aa, Diabrotica virgifera
  misc_feature: Coding regions on vcDNA: vcDNA=SeqID_11577; Strand=+; Position=2-959
  misc_feature: Homolog annotation: Hit_ID=XP_394947.1; Match level="QueryCoverage =94%, HitCoverage=40%, E-value=1e-152, Identity=90%"; Hit description= similar to ENSANGP00000013913 [Apis mellifera]
  misc_feature: Gene Ontology Annotation: Molecular function=dynamine GTPase activity; Cellular component=endoplasmic reticulum; Biological process=cell communication
  misc_feature: Pfam annotation: Pfam_ID=Dynamin_M; Match level="Score=379.4, E-value= 4.8e-111, Copies=1"; Pfam description=Dynamin central region
  misc_feature (291)..(291): Xaa can be any naturally occurring amino acid
RAARHRRREFPASYPRAPANTDMATSESLAIAKDVDIDGRRTLAVVTKLDLMDAGTDAIDILCGRVIPVKLGIIGVVNRSQQDIMNNKSIKDSLKDEATYLQSKYPTLAGRNGTPYLAKTLNRLLMHHIRDCLPDLKTRVNLMMSQYQSLLSSYGEDISDKSKTLLQIITKFASAYCSTIEGTARNIETTELCGGARICYIFHETFGRTLDSIHPLAGLTKMDILTAIRNANGPRPALFVPEVSFELLDKRQIRRLEEPSLRCVELIHEEMQRIIQHCGNEVQQEMLRFPXLRRIVDVVTQLLRRRLPTTNSMVENLVA

SEQ ID NO: 31881 - protein, 216 aa, Diabrotica virgifera
  misc_feature: Coding regions on vcDNA: vcDNA=SeqID_11578; Strand=-; Position=3-650
  misc_feature (13)..(56): Xaa can be any naturally occurring amino acid
  misc_feature (60)..(76): Xaa can be any naturally occurring amino acid
  misc_feature (91)..(112): Xaa can be any naturally occurring amino acid
  misc_feature (115)..(216): Xaa can be any naturally occurring amino acid
MQSFIAAFNKKVXXXXXXXXXXXXXXXXXXXXXXXXXXXXXXXXXXXXXXXXXXXXFSKXXXXXXXXXXXXXXXXXVRDLNNVNLYVNEEXXXXXXXXXXXXXXXXXXXXXXLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31882 - protein, 249 aa, Diabrotica virgifera
  misc_feature: Coding regions on vcDNA: vcDNA=SeqID_11579; Strand=+; Position=122-869
  misc_feature: Homolog annotation: Hit_ID=NP_499890.2; Match level="QueryCoverage =99%, HitCoverage=93%, E-value=4e-35, Identity=33%"; Hit description =polyglutamine binding protein 1 like (32.1 kD) (4B14) [Caenorhabditis elegans] gb|AAC48091.2|
  misc_feature: Pfam annotation: Pfam_ID=WW; Match level="Score=11.6, E-value=0.095, Copies=1"; Pfam description=WW domain
  misc_feature (89)..(94): Xaa can be any naturally occurring amino acid
  misc_feature (131)..(131): Xaa can be any naturally occurring amino acid
  misc_feature (193)..(193): Xaa can be any naturally occurring amino acid
LLPAALAAKLSKLGIIQGKQKPNEPIKKQDFKGSSTCPNKSNIYHECTVWCETHCKGVQTPDPKYFRNLQKLLVKYPIPSNWTEIFDKXXXXXXYWNMENDLVSWLPPKHPQSVKGQSAAKLLENRLKMKXGKNAWKKRKKTKNGRGKGTVKENEKGSEIGYRSSDEEERNHRRREREREREREKEREREERXRRRQERHKKRKDEIDPMDPAAYSDIPAGVWSDGLENNKRTDNTASDVLYQQRPYPA

SEQ ID NO: 31883 - protein, 64 aa, Diabrotica virgifera
  misc_feature: Coding regions on vcDNA: vcDNA=SeqID_11580; Strand=+; Position=1-195
  misc_feature: Homolog annotation: Hit_ID=XP_397128.1; Match level="QueryCoverage =92%, HitCoverage=12%, E-value=7e-12, Identity=50%"; Hit description =similar to ENSANGP00000006836 [Apis mellifera]
RPSTRPLKYTENVDNCTIYVENIKADANHEWVSRIFSKVVNEVYVSIPKYRRNRTNKGFAFVEF

SEQ ID NO: 31884 - protein, 65 aa, Diabrotica virgifera
  misc_feature: Coding regions on vcDNA: vcDNA=SeqID_11581; Strand=+; Position=127-323
  misc_feature: Homolog annotation: Hit_ID=XP_307933.1; Match level="QueryCoverage =98%, HitCoverage=35%, E-value=4e-09, Identity=43%"; Hit description =ENSANGP00000021824 [Anopheles gambiae]
  misc_feature (22)..(22): Xaa can be any naturally occurring amino acid
HLYFPKENPFKTPGMTGLTQIXARADVDRNVDECITVVHEPGDDEFEYEKSLDMVVTRHLLEKLN

SEQ ID NO: 31885 - protein, 79 aa, Diabrotica virgifera
  misc_feature: Coding regions on vcDNA: vcDNA=SeqID_11582; Strand=-; Position=71-310
  misc_feature (1)..(17): Xaa can be any naturally occurring amino acid
XXXXXXXXXXXXXXXXXFGPVLFQYINSLQIVPQLPLPVMYSDRCEILKVGTALYIYKFYTIYPLWSPHSSSSILYYRI

SEQ ID NO: 31886 - protein, 52 aa, Diabrotica virgifera
  misc_feature: Coding regions on vcDNA: vcDNA=SeqID_11583; Strand=+; Position=528-683
YILINYHKHNSEIIIEQLISIINERKIEVALKEIIAVIDITTISVLTEIRST

SEQ ID NO: 31887 - protein, 261 aa, Diabrotica virgifera
  misc_feature: Coding regions on vcDNA: vcDNA=SeqID_11584; Strand=+; Position=97-879
  misc_feature: Homolog annotation: Hit_ID=XP_392229.1; Match level="QueryCoverage =99%, HitCoverage=31%, E-value=5e-89, Identity=64%"; Hit description =similar to CG4276-PA [Apis mellifera]
  misc_feature (167)..(177): Xaa can be any naturally occurring amino acid
MSVMERFPASSIQEPSAFMSQDPMDMYNNILVFIVTNSNQSHPTEMHIFQCQSISAQDLVEDLKELRMGKAPTRSRKSSIPPPSHKPPQNVISPSRDVTRDYYGSDSELTANNDDSSSTTSEKYERDVTILNHCFDDIEKFIARLQHAAAAARELERRRKTRKTKKXXXXXXXXXXXTKPPPEKEFVDIFQKFKLSFNLLAKLKAHIHDPNAPELVHFLFTPLALIVEAAHDQYFDQHIPHNVISPLLTREAGNLLMNCVT

SEQ ID NO: 31888 - protein, 126 aa, Diabrotica virgifera
  misc_feature: Coding regions on vcDNA: vcDNA=SeqID_11585; Strand=-; Position=3-383
  misc_feature (12)..(30): Xaa can be any naturally occurring amino acid
  misc_feature (37)..(48): Xaa can be any naturally occurring amino acid
  misc_feature (54)..(62): Xaa can be any naturally occurring amino acid
  misc_feature (71)..(89): Xaa can be any naturally occurring amino acid
  misc_feature (94)..(121): Xaa can be any naturally occurring amino acid
YNFIFKIILKNXXXXXXXXXXXXXXXXXXXCNVISHXXXXXXXXXXXXLQKTYXXXXXXXXXDNFLALLNXXXXXXXXXXXXXXXXXXXKINLXXXXXXXXXXXXXXXXXXXXXXXXXXXXLIILK

SEQ ID NO: 31889 - protein, 71 aa, Diabrotica virgifera
  misc_feature: Coding regions on vcDNA: vcDNA=SeqID_11586; Strand=-; Position=269-484
SVKVVCSHSGSCKKINLVIEGEGYIYNNRKIHSICYSYIHKNDSIGKFISMFSSNRRMINFTVISNLCKMH

SEQ ID NO: 31890 - protein, 73 aa, Diabrotica virgifera
  misc_feature: Coding regions on vcDNA: vcDNA=SeqID_11587; Strand=+; Position=128-349
FFVIFHIVKQICTVLLNRSVSKKLRNSILQLHNESRIYQHHGSSTNIFKIFKPVYLKTTNFELSSYSIKFRWL

SEQ ID NO: 31891 - protein, 57 aa, Diabrotica virgifera
  misc_feature: Coding regions on vcDNA: vcDNA=SeqID_11588; Strand=-; Position=1-171
  misc_feature (3)..(57): Xaa can be any naturally occurring amino acid
LNXXXXXXXXXXXXXXXXXXXXXXXXXXXXXXXXXXXXXXXXXXXXXXXXXXXXXXX

SEQ ID NO: 31892 - protein, 58 aa, Diabrotica virgifera
  misc_feature: Coding regions on vcDNA: vcDNA=SeqID_11589; Strand=-; Position=28-204
NLVSRYYRKELFMHRRCSSLCHYELQEMWVPFYVRRNLFNYISYGYNLSYHALSHSKQ

SEQ ID NO: 31893 - protein, 274 aa, Diabrotica virgifera
  misc_feature: Coding regions on vcDNA: vcDNA=SeqID_11590; Strand=+; Position=1-825
  misc_feature: Homolog annotation: Hit_ID=EAA11364.2; Match level="QueryCoverage =98%, HitCoverage=38%, E-value=1e-69, Identity=49%"; Hit description =ENSANGP00000004566 [Anopheles gambiae str. PEST] ref|XP_556610.1| ENSANGP00000004566 [Anopheles gambiae st
  misc_feature: Gene Ontology Annotation: Molecular function=deoxycytidyl transferase activity, template dependent; Cellular component=nucleus; Biological process=bypass DNA synthesis
  misc_feature: Pfam annotation: Pfam_ID=IMS; Match level="Score=-15.3, E-value=7.7e -09, Copies=1"; Pfam description=impB/mucB/samB family
  misc_feature (192)..(197): Xaa can be any naturally occurring amino acid
  misc_feature (239)..(245): Xaa can be any naturally occurring amino acid
VASYTLDIEAVSCDEMYVDVTKILRKTGLTVDEWASHIRNEIRTITGCPCSTGFGANRLQARLATRKAKPEGQFYLKPEEVENHMVELTLSDLPGVGRATLAKLQKLGLFTCGDVQLTSLKVLQNEIGQKAGETVKEQSVGVDSKPLNFYHERKSVSADVNYGIRFKTLQECHTFLENLSAEVYNRMNEINXXXXXXTLKLLVRAPEAPVETAKFLGHGICDSLTKSTTSNSLLNNPQXXXXXXXILYEKLGADFADLRGVGLQLTKLEKNASI

SEQ ID NO: 31894 - protein, 145 aa, Diabrotica virgifera
  misc_feature: Coding regions on vcDNA: vcDNA=SeqID_11591; Strand=+; Position=92-531
  misc_feature: Homolog annotation: Hit_ID=EAA46069.1; Match level="QueryCoverage =100%, HitCoverage=85%, E-value=5e-39, Identity=57%"; Hit description= CG40045-PA.3 [Drosophila melanogaster] gb|AAL49196.1| RE63412p [Drosophila melanogaster]
  misc_feature: Gene Ontology Annotation: Molecular function=ubiquitin conjugating enzyme activity; Cellular component=nucleoplasm; Biological process =establishment and/or maintenance of chromatin architecture
  misc_feature: Pfam annotation: Pfam_ID=UQ_con; Match level="Score=59.9, E-value =7.2e-15, Copies=1"; Pfam description=Ubiquitin-conjugating enzyme
  misc_feature (45)..(45): Xaa can be any naturally occurring amino acid
  misc_feature (52)..(52): Xaa can be any naturally occurring amino acid
  misc_feature (79)..(79): Xaa can be any naturally occurring amino acid
  misc_feature (96)..(96): Xaa can be any naturally occurring amino acid
  misc_feature (111)..(111): Xaa can be any naturally occurring amino acid
  misc_feature (118)..(118): Xaa can be any naturally occurring amino acid
MSQRQSALLLITQLVQLNKNPVEAFSAGLIDDDDIYICEELIPSXPDTLYAXGFFKCRLYFPREYPLTPPRNEISITTXDPNIDQKVDVCISILRXPGNDKFDYEKSYFRXIPQHTDXNYLNYLLLSMITDPNDESPAHAHAAKE

SEQ ID NO: 31895 - protein, 240 aa, Diabrotica virgifera
  misc_feature: Coding regions on vcDNA: vcDNA=SeqID_11592; Strand=-; Position=3-722
  misc_feature (3)..(17): Xaa can be any naturally occurring amino acid
  misc_feature (28)..(51): Xaa can be any naturally occurring amino acid
  misc_feature (53)..(61): Xaa can be any naturally occurring amino acid
  misc_feature (63)..(74): Xaa can be any naturally occurring amino acid
  misc_feature (76)..(130): Xaa can be any naturally occurring amino acid
  misc_feature (134)..(240): Xaa can be any naturally occurring amino acid
LNXXXXXXXXXXXXXXXQPFISAYNTIXXXXXXXXXXXXXXXXXXXXXXXXFXXXXXXXXXNXXXXXXXXXXXXKXXXXXXXXXXXXXXXXXXXXXXXXXXXXXXXXXXXXXXXXXXXXXXXXXXXXXXXIIFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31896 - protein, 105 aa, Diabrotica virgifera
  misc_feature: Coding regions on vcDNA: vcDNA=SeqID_11593; Strand=+; Position=445-762
RIDEHGGKNTHSETHNVLGGVSNLAKIGTLLSNVTRSDTDADNADVLKRLESVARLEGALHGLTDDVIGKENLDSSPYVLKSLRAIRSLLAQGQGNNGCARALLL

SEQ ID NO: 31897 - protein, 82 aa, Diabrotica virgifera
  misc_feature: Coding regions on vcDNA: vcDNA=SeqID_11594; Strand=+; Position=30-275
NNSRFIQFFIRRISIKNTYCACTLYARKKIYFYLRFLQNKYTFNRLFEFYYKTKLIFTYYFPKHSLLHQYQKIQTRALSLKY

SEQ ID NO: 31898 - protein, 76 aa, Diabrotica virgifera
  misc_feature: Coding regions on vcDNA: vcDNA=SeqID_11595; Strand=-; Position=326-556
  misc_feature (14)..(41): Xaa can be any naturally occurring amino acid
SSQPCSTLFRVIVXXXXXXXXXXXXXXXXXXXXXXXXXXXXSDIHFFIIIAFQTFMFGTLHYQWVRCTQSRCSVFT

SEQ ID NO: 31899 - protein, 71 aa, Diabrotica virgifera
  misc_feature: Coding regions on vcDNA: vcDNA=SeqID_11596; Strand=+; Position=438-648
  misc_feature: Homolog annotation: Hit_ID=XP_395309.1; Match level="QueryCoverage =98%, HitCoverage=12%, E-value=6e-10, Identity=47%"; Hit description =similar to DNop5 protein [Apis mellifera]
  misc_feature (46)..(46): Xaa can be any naturally occurring amino acid
LMICIHKELDNILSCLPLEEMTAVESKLLHSLSMNKFEYSHNKLDXTMIALSVDILHEIDKGLNNYIMICD

SEQ ID NO: 31900 - protein, 117 aa, Diabrotica virgifera
  misc_feature: Coding regions on vcDNA: vcDNA=SeqID_11597; Strand=+; Position=365-715
  misc_feature: Homolog annotation: Hit_ID=P12717; Match level="QueryCoverage=99%, HitCoverage=30%, E-value=1e-36, Identity=66%"; Hit description =Actin, muscle pir||JS0190 actin, muscle - starfish (Pisaster ochraceus) gb|AAA29787.1| muscle
  misc_feature: Gene Ontology Annotation: Molecular function=structural constituent of cytoskeleton; Cellular component=cytoskeleton; Biological process= reproduction
  misc_feature (21)..(21): Xaa can be any naturally occurring amino acid
  misc_feature (107)..(107): Xaa can be any naturally occurring amino acid
GHTFSNELIPAPEEHPELLTXAPLHPNPYSERMTYITFKTFYTPAMFGGIQAVLSLYASAHTTDIEYNTVEDVSHTPPLYEGYALPHAILRVNLYGRDLTEYLMKIXTQRDYSVSTT

SEQ ID NO: 31901 - protein, 281 aa, Diabrotica virgifera
  misc_feature: Coding regions on vcDNA: vcDNA=SeqID_11598; Strand=-; Position=1-843
  misc_feature (1)..(278): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRAK

SEQ ID NO: 31902 - protein, 247 aa, Diabrotica virgifera
  misc_feature: Coding regions on vcDNA: vcDNA=SeqID_11599; Strand=+; Position=99-839
  misc_feature: Homolog annotation: Hit_ID=XP_310684.1; Match level="QueryCoverage =80%, HitCoverage=58%, E-value=3e-48, Identity=51%"; Hit description =ENSANGP00000020750 [Anopheles gambiae]
  misc_feature (225)..(225): Xaa can be any naturally occurring amino acid
  misc_feature (242)..(242): Xaa can be any naturally occurring amino acid
FALYNCDKLYLIAKCHYKPDNYILDINTNFYSQLYSSSSYCKMVKAKKWNYMKHFEGWPKKTDVELVEEEMRPIEDGEFLAKAVFLSVDPFMRGLSEKFTIGEPIWGTQVARIVESKNEEFPVGKLVVLRAGWRTYSISNGKKEPPTLPEPYLLPDIGDLSPSVALGVLGMTGNTAYFLFLELCQPKEGDTVVVTAAAGAIGSIVGQIGKIYGCNVIGIAGSNEXGEWVAKESRFDHFISYXDDIDA

SEQ ID NO: 31903 - protein, 262 aa, Diabrotica virgifera
  misc_feature: Coding regions on vcDNA: vcDNA=SeqID_11600; Strand=-; Position=1-786
  misc_feature (1)..(259): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRAK

SEQ ID NO: 31904 - protein, 29 aa, Diabrotica virgifera
  misc_feature: Coding regions on vcDNA: vcDNA=SeqID_11601; Strand=+; Position=54-143
LLRLSQYRENLFYVIKNQKCYSLHVKITK

SEQ ID NO: 31905 - protein, 108 aa, Diabrotica virgifera
  misc_feature: Coding regions on vcDNA: vcDNA=SeqID_11602; Strand=-; Position=1-324
  misc_feature (2)..(108): Xaa can be any naturally occurring amino acid
PXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31906 - protein, 52 aa, Diabrotica virgifera
  misc_feature: Coding regions on vcDNA: vcDNA=SeqID_11603; Strand=+; Position=43-201
TFKNITSRLMILFDIEYVILIFYQCNILNLLNLFLYLNYHKLIICPSTHYFF

SEQ ID NO: 31907 - protein, 68 aa, Diabrotica virgifera
  misc_feature: Coding regions on vcDNA: vcDNA=SeqID_11604; Strand=-; Position=428-634
HVDASAFVLLDGVGGPCSRSQLHFSSTRFAVSSSHRLIIAKFSESLNREMGMVACSSSRMFDHSQIVM

SEQ ID NO: 31908 - protein, 94 aa, Diabrotica virgifera
  misc_feature: Coding regions on vcDNA: vcDNA=SeqID_11605; Strand=+; Position=1-282
  misc_feature (1)..(93): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 31909 - protein, 141 aa, Diabrotica virgifera
  misc_feature: Coding regions on vcDNA: vcDNA=SeqID_11606; Strand=+; Position=325-746
  misc_feature: Homolog annotation: Hit_ID=CAA78291.1; Match level="QueryCoverage =94%, HitCoverage=47%, E-value=1e-22, Identity=43%"; Hit description =SSR alpha subunit [Oncorhynchus mykiss] sp|P45433|SSRA_ONCMY Translocon-associated protein, alpha subunit
  misc_feature: Gene Ontology Annotation: Molecular function=signal sequence binding; Cellular component=integral to membrane; Biological process =cotranslational membrane targeting
  misc_feature: Pfam annotation: Pfam_ID=TRAP_alpha; Match level="Score=-113.7, E -value=2.8e-05, Copies=1"; Pfam description=Translocon-associated protein (TRAP),
  misc_feature (41)..(41): Xaa can be any naturally occurring amino acid
  misc_feature (60)..(60): Xaa can be any naturally occurring amino acid
  misc_feature (90)..(90): Xaa can be any naturally occurring amino acid
  misc_feature (114)..(114): Xaa can be any naturally occurring amino acid
QIPHELPAKFLVRFRNKGDQDFGVHTLEPSLLYPMNFNFVXSTNFSDAAYTYIGQTEQEXTFLYRFLPAAHYASQPLGLNLLLNYHDAYXNAFPEAVINDTVHIDELEERLDAXTFFLYVLLDRSSIIASDDMHNKLCYHL

SEQ ID NO: 31910 - protein, 209 aa, Diabrotica virgifera
  misc_feature: Coding regions on vcDNA: vcDNA=SeqID_11607; Strand=+; Position=122-755
  misc_feature: Homolog annotation: Hit_ID=XP_394947.1; Match level="QueryCoverage =96%, HitCoverage=27%, E-value=4e-42, Identity=47%"; Hit description =similar to ENSANGP00000013913 [Apis mellifera]
  misc_feature: Gene Ontology Annotation: Molecular function=dynamine GTPase activity; Cellular component=endoplasmic reticulum; Biological process=cell communication
  misc_feature: Pfam annotation: Pfam_ID=Dynamin_M; Match level="Score=-104.9, E -value=9.7e-05, Copies=1"; Pfam description=Dynamin central region
  misc_feature (52)..(52): Xaa can be any naturally occurring amino acid
  misc_feature (79)..(79): Xaa can be any naturally occurring amino acid
  misc_feature (108)..(108): Xaa can be any naturally occurring amino acid
  misc_feature (122)..(122): Xaa can be any naturally occurring amino acid
  misc_feature (139)..(139): Xaa can be any naturally occurring amino acid
  misc_feature (182)..(182): Xaa can be any naturally occurring amino acid
YRHQSCEKLIQYTLRIIVVVKTSHIRILLTALYIIDSLKNETTYLYTQYPTXLERNATQYLTLQLNILMLHHKKHCLPXNRQLSILCCLTFTLLYCSYEEDISDKNKXMLQLITYIHICELXTIQSTANYIQNTELCDXALICYIYHETFVRNLDSIRPLTELTKMNILTIIKNANGPRTSXFVLYLSFQMLDKRQIRSLEDPSLRVSY

SEQ ID NO: 31911 - protein, 229 aa, Diabrotica virgifera
  misc_feature: Coding regions on vcDNA: vcDNA=SeqID_11608; Strand=+; Position=1-690
  misc_feature (6)..(65): Xaa can be any naturally occurring amino acid
  misc_feature (67)..(82): Xaa can be any naturally occurring amino acid
  misc_feature (84)..(103): Xaa can be any naturally occurring amino acid
  misc_feature (105)..(145): Xaa can be any naturally occurring amino acid
  misc_feature (154)..(164): Xaa can be any naturally occurring amino acid
  misc_feature (175)..(198): Xaa can be any naturally occurring amino acid
  misc_feature (204)..(211): Xaa can be any naturally occurring amino acid
  misc_feature (221)..(229): Xaa can be any naturally occurring amino acid
RPPTRXXXXXXXXXXXXXXXXXXXXXXXXXXXXXXXXXXXXXXXXXXXXXXXXXXXXXXXXXXXXLXXXXXXXXXXXXXXXXLXXXXXXXXXXXXXXXXXXXXHXXXXXXXXXXXXXXXXXXXXXXXXXXXXXXXXXXXXXXXXXKNFPILPYXXXXXXXXXXXSSITFPLHYKXXXXXXXXXXXXXXXXXXXXXXXXRLIHEXXXXXXXXSLKTCLSVLXXXXXXXXX

SEQ ID NO: 31912 - protein, 301 aa, Diabrotica virgifera
  misc_feature: Coding regions on vcDNA: vcDNA=SeqID_11609; Strand=+; Position=2-904
  misc_feature: Homolog annotation: Hit_ID=XP_392097.1; Match level="QueryCoverage =100%, HitCoverage=71%, E-value=8e-92, Identity=41%"; Hit description= similar to ENSANGP00000016783 [Apis mellifera]
  misc_feature: Gene Ontology Annotation: Molecular function=adhesive extracellular matrix constituent activity; Cellular component=basement membrane; Biological process=histogenesis and organogenesis
  misc_feature: Pfam annotation: Pfam_ID=Collagen; Match level="Score=169.8, E-value =6.1e-48, Copies=4"; Pfam description=Collagen triple helix repeat (20 copi
  misc_feature (276)..(276): Xaa can be any naturally occurring amino acid
GIAGTPGRSIVGAKGDKGDQGPSGLDGLAGIQGEKGDAGTPGFPGVKGDRGYPGEQGAPGMDGFPGTNGEKGDRGFAGAPGFTGEKGDRGLSGLDGYEGQKGERGRPGSTGPFGEPGEKGDVGETGPPGPLVQIKGDKGEPGPFGLEGRQGEKGDRGFSGAIGLRGEKGDVGFPGVKGNLGSPGRPGAKGERGLSGVAGLPGLTIKGEKGLPGIPGKNGREGIPGTPGQIGEPGLPGLDGRQGPPGPPGPLCLQGQKGDRGFDGAPGTQGPTGPPXQPGLEGAPGQRGDKGERGNPGAFGA

SEQ ID NO: 31913 - protein, 39 aa, Diabrotica virgifera
  misc_feature: Coding regions on vcDNA: vcDNA=SeqID_11610; Strand=-; Position=2-118
  misc_feature (10)..(24): Xaa can be any naturally occurring amino acid
  misc_feature (26)..(38): Xaa can be any naturally occurring amino acid
PIKLRCYRKXXXXXXXXXXXXXXXRXXXXXXXXXXXXXT

SEQ ID NO: 31914 - protein, 72 aa, Diabrotica virgifera
  misc_feature: Coding regions on vcDNA: vcDNA=SeqID_11611; Strand=+; Position=387-606
  misc_feature (22)..(22): Xaa can be any naturally occurring amino acid
  misc_feature (52)..(52): Xaa can be any naturally occurring amino acid
MEPPARRSKNKRLRIHDYHTSXSWQDYKTISMREPGYVCLAYTLPYGYGVMXILRYEAMKYDIKKPHYTRYT

SEQ ID NO: 31915 - protein, 86 aa, Diabrotica virgifera
  misc_feature: Coding regions on vcDNA: vcDNA=SeqID_11612; Strand=-; Position=1-258
LSDGSICQPHPKFNRCVGGHDTYIDRMVYSALFQSCQDLVPVAFEMDRGPFLFVLPISFSRRATWWKRISCSALSQGKCEQSTGYQ

SEQ ID NO: 31916 - protein, 45 aa, Diabrotica virgifera
  misc_feature: Coding regions on vcDNA: vcDNA=SeqID_11613; Strand=+; Position=92-229
MNTTDGPVVDEFGTESRANRSQVIYCFKRIPYAVPPDGYLRFACT

SEQ ID NO: 31917 - protein, 80 aa, Diabrotica virgifera
  misc_feature: Coding regions on vcDNA: vcDNA=SeqID_11614; Strand=+; Position=246-488
LLIRSSKWRRTYGYISLLAPTNLSGLTLTGSISISNALAITNKHETVISMTMTVSQQLQHVTRCILSICTAHATCHSKLI

SEQ ID NO: 31918 - protein, 249 aa, Diabrotica virgifera
  misc_feature: Coding regions on vcDNA: vcDNA=SeqID_11615; Strand=+; Position=2-751
  misc_feature (5)..(25): Xaa can be any naturally occurring amino acid
  misc_feature (27)..(39): Xaa can be any naturally occurring amino acid
  misc_feature (43)..(65): Xaa can be any naturally occurring amino acid
  misc_feature (70)..(79): Xaa can be any naturally occurring amino acid
  misc_feature (83)..(217): Xaa can be any naturally occurring amino acid
  misc_feature (224)..(243): Xaa can be any naturally occurring amino acid
GRVGXXXXXXXXXXXXXXXXXXXXXGXXXXXXXXXXXXXVECXXXXXXXXXXXXXXXXXXXXXXXIILLXXXXXXXXXXLDLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCIIIMSXXXXXXXXXXXXXXXXXXXXYKECYF

SEQ ID NO: 31919 - protein, 268 aa, Diabrotica virgifera
  misc_feature: Coding regions on vcDNA: vcDNA=SeqID_11616; Strand=+; Position=3-807
  misc_feature: Homolog annotation: Hit_ID=XP_393415.1; Match level="QueryCoverage =86%, HitCoverage=33%, E-value=8e-31, Identity=35%"; Hit description =similar to ENSANGP00000012563 [Apis mellifera]
  misc_feature (52)..(52): Xaa can be any naturally occurring amino acid
  misc_feature (152)..(152): Xaa can be any naturally occurring amino acid
  misc_feature (167)..(167): Xaa can be any naturally occurring amino acid
  misc_feature (192)..(192): Xaa can be any naturally occurring amino acid
  misc_feature (214)..(214): Xaa can be any naturally occurring amino acid
  misc_feature (217)..(217): Xaa can be any naturally occurring amino acid
  misc_feature (233)..(233): Xaa can be any naturally occurring amino acid
YLHVRACREDVKQISEYFRASEDQESAQTWLISNPSRRRSMLSFMNAFVDLXYLFIAVVYRVNIASDNGYLNEYIVDNYCGILHLSCSFPSFIEMDVLCFLPESALIIITEVEMKNIMLSLPTVYHVDTGNDPKNYPAERLYHTNKIYVTLXTESLNCKEKHKCHIXLCDILDISIRIFDSAMLRFSMFQIXIDFTYHIGYYGVIMRIPEMHNXLTXYTRMHDGAQAVVCELXNYLCSIVSRIVCDLCSDKMSSSGFLKSLITVSAAL

SEQ ID NO: 31920 - protein, 74 aa, Diabrotica virgifera
  misc_feature: Coding regions on vcDNA: vcDNA=SeqID_11617; Strand=+; Position=393-617
MTTMEKLQTLVEQYTETITSNTRTQIPSLSPSLLCVILHFGGQPMFNIDIKLFHDLDLTKSRIPGETTRLCSLN

SEQ ID NO: 31921 - protein, 97 aa, Diabrotica virgifera
  misc_feature: Coding regions on vcDNA: vcDNA=SeqID_11618; Strand=-; Position=3-293
  misc_feature (71)..(80): Xaa can be any naturally occurring amino acid
QLIATILLNIYMKSSNIYVVGCHCIQSYCQFIINEHSIQQHLERQSKLSIEVAADYDNKYCYHFSMIIFRXXXXXXXXXXRAWWVDGDNCGAVAQAS

SEQ ID NO: 31922 - protein, 43 aa, Diabrotica virgifera
  misc_feature: Coding regions on vcDNA: vcDNA=SeqID_11619; Strand=-; Position=1-129
  misc_feature (1)..(43): Xaa can be any naturally occurring amino acid
XXXXXXXXXXXXXXXXXXXXXXXXXXXXXXXXXXXXXXXXXXX

SEQ ID NO: 31923 - protein, 71 aa, Diabrotica virgifera
  misc_feature: Coding regions on vcDNA: vcDNA=SeqID_11620; Strand=+; Position=34-249
  misc_feature (3)..(32): Xaa can be any naturally occurring amino acid
  misc_feature (61)..(70): Xaa can be any naturally occurring amino acid
KLXXXXXXXXXXXXXXXXXXXXXXXXXXXXXXPLHYLNLVLTITLASTNCIFNTNIYDSYXXXXXXXXXXY

SEQ ID NO: 31924 - protein, 288 aa, Diabrotica virgifera
  misc_feature: Coding regions on vcDNA: vcDNA=SeqID_11621; Strand=+; Position=3-869
  misc_feature: Homolog annotation: Hit_ID=EAL29841.1; Match level="QueryCoverage =92%, HitCoverage=19%, E-value=4e-84, Identity=49%"; Hit description =GA16846-PA [Drosophila pseudoobscura]
  misc_feature: Gene Ontology Annotation: Molecular function=transmembrane receptor activity; Cellular component=integral to plasma membrane; Biological process=receptor mediated endocytosis
  misc_feature: Pfam annotation: Pfam_ID=Ldl_recept_a; Match level="Score=123.7, E -value=4.4e-34, Copies=4"; Pfam description=Low-density lipoprotein receptor doma
  misc_feature (264)..(264): Xaa can be any naturally occurring amino acid
TKSFLGTFVANHQENAYRERADAISRRVTTMEPTSTTPPELIIPSITTTLPPTTTGIRTRVETGDEAVSLGLPCVTDMQCKMADSSSKCIEGICDCIIRTNGTRSCSAKNRGCIPGTFQCRSTGTCISWFFVCDGRKDCSDGSDEECLPNKCPQEAFSCKSSGKCISRASRCDGSKDCALGEDEMNCQAIGRKGCPPDTFQCRDGKCLPEYEFCNAIIGCSDGSDEPPHICKGRARRRRTEYCPLRCGNGRCRSSAIACSGRDXCGDGTDESQCSVCRCPVIKSALIR

SEQ ID NO: 31925 - protein, 166 aa, Diabrotica virgifera
  misc_feature: Coding regions on vcDNA: vcDNA=SeqID_11622; Strand=+; Position=403-900
  misc_feature (3)..(39): Xaa can be any naturally occurring amino acid
  misc_feature (49)..(63): Xaa can be any naturally occurring amino acid
  misc_feature (73)..(80): Xaa can be any naturally occurring amino acid
  misc_feature (102)..(110): Xaa can be any naturally occurring amino acid
  misc_feature (120)..(126): Xaa can be any naturally occurring amino acid
  misc_feature (145)..(159): Xaa can be any naturally occurring amino acid
QLXXXXXXXXXXXXXXXXXXXXXXXXXXXXXXXXXXXXXPMMIISALKXXXXXXXXXXXXXXXSTFFSPVYLXXXXXXXXIPPRLPTDYFEWSRNSDRATVXXXXXXXXXRWNRSCWMTXXXXXXXLSRLVFLLLTAHILLPYDXXXXXXXXXXXXXXXIIFIYII

SEQ ID NO: 31926 - protein, 87 aa, Diabrotica virgifera
  misc_feature: Coding regions on vcDNA: vcDNA=SeqID_11623; Strand=+; Position=363-625
  misc_feature: Homolog annotation: Hit_ID=CAG01723.1; Match level="QueryCoverage =98%, HitCoverage=30%, E-value=3e-16, Identity=54%"; Hit description =unnamed protein product [Tetraodon nigroviridis]
  misc_feature: Gene Ontology Annotation: Molecular function=succinate dehydrogenase (ubiquinone) activity; Cellular component=mitochondrial inner membrane; Biological process=electron transport
  misc_feature (46)..(46): Xaa can be any naturally occurring amino acid
  misc_feature (55)..(55): Xaa can be any naturally occurring amino acid
EPMELYALIRIKNNTYPTLTYIRSCRAGFCGSCAMYIQSSKYLKLXSIIIRNINXDHHRFIHLPHMYVVKHLKPVMNNYYRQYKTIE

SEQ ID NO: 31927 - protein, 245 aa, Diabrotica virgifera
  misc_feature: Coding regions on vcDNA: vcDNA=SeqID_11624; Strand=-; Position=122-856
  misc_feature: Homolog annotation: Hit_ID=XP_391959.1; Match level="QueryCoverage =98%, HitCoverage=88%, E-value=1e-112, Identity=84%"; Hit description= similar to prohibitin protein Wph [Apis mellifera]
  misc_feature: Gene Ontology Annotation: Molecular function=molecular_function unknown; Cellular component=mitochondrion; Biological process =proteolysis and peptidolysis
  misc_feature: Pfam annotation: Pfam_ID=Band_7; Match level="Score=173.4, E-value =4.9e-49, Copies=1"; Pfam description=SPFH domain / Band 7 family
  misc_feature (8)..(8): Xaa can be any naturally occurring amino acid
  misc_feature (16)..(16): Xaa can be any naturally occurring amino acid
  misc_feature (29)..(29): Xaa can be any naturally occurring amino acid
DGGHRAVXFDRFAGIXNKFIGEGTHFFIXWVQKPIIFDVRSRPRNIPVITGSKDLQNVNITLRILFRPVPDELPKIYTILGQDYEERVLPSITNEVLKAVVAQFDASELITQRDVVSQKVSEDLTERATQFGVILDDISLTHLTFGREFTQAVELKQVAQQEAEKARFLVEKAEQTKKATVISAEGDAQAAVLLAKAFGDAGEGLVELRRIEAAEDIAYQLSRSRQVSYLPGGQNLLLNVPTPGN

SEQ ID NO: 31928 - protein, 261 aa, Diabrotica virgifera
  misc_feature: Coding regions on vcDNA: vcDNA=SeqID_11625; Strand=+; Position=122-904
  misc_feature: Homolog annotation: Hit_ID=NP_724135.1; Match level="QueryCoverage =95%, HitCoverage=48%, E-value=1e-30, Identity=34%"; Hit description =CG17322-PC, isoform C [Drosophila melanogaster] ref|NP_724134.1| CG17322-PB, isoform B [Drosophila
  misc_feature (253)..(253): Xaa can be any naturally occurring amino acid
MRLNQVLKIALLALFCNITFCDSFNILAITPHVGKSHQLVFEPLFKKLVSVGHSVTLITRYPMNVDSPKWRDIPIGPEDTNTTELFDFSLLTGTRFDRYACPLVLAEAARISCSEGLPHPNLQRFLKEDNHFDVVLMEVFNTNCYMGIATKYNVPVIGVHSAGWMPWMYQWFGVPYHPGFVTDHFLGNSQPMDFLARLENTIVHIYNNAIYTVTMCWYGSYLSNKYVGADLYENGDVMKNMSLLSINTHFSLXLPLALGQT

SEQ ID NO: 31929 - protein, 163 aa, Diabrotica virgifera
  misc_feature: Coding regions on vcDNA: vcDNA=SeqID_11626; Strand=-; Position=194-685
  misc_feature (1)..(28): Xaa can be any naturally occurring amino acid
  misc_feature (32)..(103): Xaa can be any naturally occurring amino acid
  misc_feature (107)..(133): Xaa can be any naturally occurring amino acid
  misc_feature (144)..(163): Xaa can be any naturally occurring amino acid
XXXXXXXXXXXXXXXXXXXXXXXXXXXXKGCXXXXXXXXXXXXXXXXXXXXXXXXXXXXXXXXXXXXXXXXXXXXXXXXXXXXXXXXXXXXXXXXXXXXXXXXFYLXXXXXXXXXXXXXXXXXXXXXXXXXXXLFVKKLEIFKXXXXXXXXXXXXXXXXXXXX

SEQ ID NO: 31930 - protein, 99 aa, Diabrotica virgifera
  misc_feature: Coding regions on vcDNA: vcDNA=SeqID_11627; Strand=+; Position=332-628
  misc_feature (2)..(23): Xaa can be any naturally occurring amino acid
  misc_feature (36)..(46): Xaa can be any naturally occurring amino acid
  misc_feature (55)..(81): Xaa can be any naturally occurring amino acid
YXXXXXXXXXXXXXXXXXXXXXXLLMMIVLYIIKMXXXXXXXXXXXVIIYILFTXXXXXXXXXXXXXXXXXXXXXXXXXXXDRAMVSYSLVYYLTAGMK

SEQ ID NO: 31931 - protein, 263 aa, Diabrotica virgifera
  misc_feature: Coding regions on vcDNA: vcDNA=SeqID_11628; Strand=+; Position=1-789
  misc_feature (6)..(92): Xaa can be any naturally occurring amino acid
  misc_feature (95)..(211): Xaa can be any naturally occurring amino acid
  misc_feature (214)..(261): Xaa can be any naturally occurring amino acid
PLPRAXXXXXXXXXXXXXXXXXXXXXXXXXXXXXXXXXXXXXXXXXXXXXXXXXXXXXXXXXXXXXXXXXXXXXXXXXXXXXXXXXXXXXXXFYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLXXXXXXXXXXXXXXXXXXXXXXXXXXXXXXXXXXXXXXXXXXXXXXXXLS

SEQ ID NO: 31932 - protein, 63 aa, Diabrotica virgifera
  misc_feature: Coding regions on vcDNA: vcDNA=SeqID_11629; Strand=-; Position=246-437
RIKQAITSDIVSSGICSIITYYAHAFFVPSSIVWFMKDQVPTSVHKSFLSYPNPMNFVLAYIS

SEQ ID NO: 31933 - protein, 36 aa, Diabrotica virgifera
  misc_feature: Coding regions on vcDNA: vcDNA=SeqID_11630; Strand=-; Position=1-108
FDGGVTIKDHRGQPQKGKILIRGLPVHLHSALMKII

SEQ ID NO: 31934 - protein, 105 aa, Diabrotica virgifera
  misc_feature: Coding regions on vcDNA: vcDNA=SeqID_11631; Strand=-; Position=3-317
EIYVVLTDKSGLKISKIFVHAIHDVGKYVIHYAAVKYSSLDFRLLMYIGVRRKFVVQYGKYRKIISPLRKGTMLAFGNVAFRGKLHLRVLYNKSDFLSDILVQIS

SEQ ID NO: 31935 - protein, 127 aa, Diabrotica virgifera
  misc_feature: Coding regions on vcDNA: vcDNA=SeqID_11632; Strand=-; Position=497-880
  misc_feature (47)..(107): Xaa can be any naturally occurring amino acid
IDPRSYSIIPCTQYSGEVLACFEHSNLFKVNVPAHYDTQSRAPRRDXXXXXXXXXXXXXXXXXXXXXXXXXXXXXXXXXXXXXXXXXXXXXXXXXXXXXXXXXXXXXLQLILVKGFRVYSFRLRGLG

SEQ ID NO: 31936 - protein, 76 aa, Diabrotica virgifera
  misc_feature: Coding regions on vcDNA: vcDNA=SeqID_11633; Strand=+; Position=104-334
NNYCKKNVYYRASKKTIVLCKLTTCCKICLLLYGIWNTANIVRSMCYAIWTSMILQVGGSGAFQTLTYVYASKRSR

SEQ ID NO: 31937 - protein, 139 aa, Diabrotica virgifera
  misc_feature: Coding regions on vcDNA: vcDNA=SeqID_11634; Strand=+; Position=236-655
  misc_feature (7)..(17): Xaa can be any naturally occurring amino acid
  misc_feature (24)..(37): Xaa can be any naturally occurring amino acid
  misc_feature (50)..(59): Xaa can be any naturally occurring amino acid
  misc_feature (69)..(74): Xaa can be any naturally occurring amino acid
  misc_feature (76)..(82): Xaa can be any naturally occurring amino acid
  misc_feature (91)..(100): Xaa can be any naturally occurring amino acid
SFCHEMXXXXXXXXXXXKSHHIYXXXXXXXXXXXXXXPLNILQGMSIMHXXXXXXXXXXIDITIKHSLXXXXXXLXXXXXXXLLLMNCLLXXXXXXXXXXSDDNSNLKKLNITPIHPTLNRVLHPHFSSLCIKNTVFLP

SEQ ID NO: 31938 - protein, 86 aa, Diabrotica virgifera
  misc_feature: Coding regions on vcDNA: vcDNA=SeqID_11635; Strand=-; Position=1-258
  misc_feature (2)..(8): Xaa can be any naturally occurring amino acid
  misc_feature (11)..(86): Xaa can be any naturally occurring amino acid
SXXXXXXXFLXXXXXXXXXXXXXXXXXXXXXXXXXXXXXXXXXXXXXXXXXXXXXXXXXXXXXXXXXXXXXXXXXXXXXXXXXXXX

SEQ ID NO: 31939 - protein, 114 aa, Diabrotica virgifera
  misc_feature: Coding regions on vcDNA: vcDNA=SeqID_11636; Strand=-; Position=243-587
  misc_feature (2)..(10): Xaa can be any naturally occurring amino acid
YXXXXXXXXXVLVSILQGSTFVSYNNPLPLVTLLMISSMIKLKSKLLNEFPVSLSYSTTYVYRVCKLSIYSDVHFIVLVDVFNRFYDKGSSIICFMMNIVSIHTFQYEKFIAHR

SEQ ID NO: 31940 - protein, 225 aa, Diabrotica virgifera
  misc_feature: Coding regions on vcDNA: vcDNA=SeqID_11637; Strand=-; Position=3-677
  misc_feature (12)..(58): Xaa can be any naturally occurring amino acid
  misc_feature (66)..(225): Xaa can be any naturally occurring amino acid
FKLVNVKIKLLXXXXXXXXXXXXXXXXXXXXXXXXXXXXXXXXXXXXXXXXXXXXXXXVMQKDMLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31941 - protein, 70 aa, Diabrotica virgifera
  misc_feature: Coding regions on vcDNA: vcDNA=SeqID_11638; Strand=-; Position=286-498
RCPVMMYEEVDVPLCINYDQELRGNSCILRIDDNVRISSSVAEKKSRYYSKCKIISCRSRFLEILMGRID

SEQ ID NO: 31942 - protein, 87 aa, Diabrotica virgifera
  misc_feature: Coding regions on vcDNA: vcDNA=SeqID_11639; Strand=-; Position=181-444
VSCPSIQLFILYVLVVVYNSFYDKGSSIICLKMNIVSIHACQCDKFIALRYPYPQTQWRLVTPKYGSFAVFLGFLKSISFNRCILRP

SEQ ID NO: 31943 - protein, 276 aa, Diabrotica virgifera
  misc_feature: Coding regions on vcDNA: vcDNA=SeqID_11640; Strand=-; Position=1-828
  misc_feature (4)..(12): Xaa can be any naturally occurring amino acid
  misc_feature (17)..(32): Xaa can be any naturally occurring amino acid
  misc_feature (34)..(54): Xaa can be any naturally occurring amino acid
  misc_feature (57)..(276): Xaa can be any naturally occurring amino acid
INLXXXXXXXXXSLFIXXXXXXXXXXXXXXXXAXXXXXXXXXXXXXXXXXXXXXVHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31944 - protein, 48 aa, Diabrotica virgifera
  misc_feature: Coding regions on vcDNA: vcDNA=SeqID_11641; Strand=-; Position=338-484
ILQWNDPNACQRTFIDLMSRASRTDDTYVICMTSRYFLVISRAYKKKS

SEQ ID NO: 31945 - protein, 121 aa, Diabrotica virgifera
  misc_feature: Coding regions on vcDNA: vcDNA=SeqID_11642; Strand=-; Position=204-569
LRSYAAEQATRVCESRVRTRIQDDPLVRIGLSSPQPGQAPHPCSRSSPTTSRYDLIYSILFSKFRIHFFVSSVLIIILFFRVSSPWSLVADMGTNSVRTSPRPYIGFSRFEEQILSSLLFR

SEQ ID NO: 31946 - protein, 58 aa, Diabrotica virgifera
  misc_feature: Coding regions on vcDNA: vcDNA=SeqID_11643; Strand=-; Position=1-174
  misc_feature (2)..(41): Xaa can be any naturally occurring amino acid
  misc_feature (43)..(58): Xaa can be any naturally occurring amino acid
TXXXXXXXXXXXXXXXXXXXXXXXXXXXXXXXXXXXXXXXXRXXXXXXXXXXXXXXXX

SEQ ID NO: 31947 - protein, 61 aa, Diabrotica virgifera
  misc_feature: Coding regions on vcDNA: vcDNA=SeqID_11644; Strand=-; Position=1-186
NHRFQKIFRKDPVVLSDRFLIYICRDYSMAIVTYYRNSKLIITFRSIVSVYTIINFYNNKR

SEQ ID NO: 31948 - protein, 63 aa, Diabrotica virgifera
  misc_feature: Coding regions on vcDNA: vcDNA=SeqID_11645; Strand=+; Position=391-582
  misc_feature (36)..(36): Xaa can be any naturally occurring amino acid
LITHLQSCDNYANVYIPTTCFTYVIKQLNDQLTYKXINMRIENSYTDGYGTVDIKDFVEMMSE

SEQ ID NO: 31949 - protein, 25 aa, Diabrotica virgifera
  misc_feature: Coding regions on vcDNA: vcDNA=SeqID_11646; Strand=-; Position=2-76
  misc_feature (12)..(24): Xaa can be any naturally occurring amino acid
LRLLNKYKLFNXXXXXXXXXXXXXF

SEQ ID NO: 31950 - protein, 86 aa, Diabrotica virgifera
  misc_feature: Coding regions on vcDNA: vcDNA=SeqID_11647; Strand=+; Position=76-336
FVFASPYFLFIQRQIYLLYLAYQGLLTNTYISTIFEFRRATQFSTFIANSKIFYFTSFAMKSLFRVLQYIYSLYSIPYPHLFSIYL

SEQ ID NO: 31951 - protein, 165 aa, Diabrotica virgifera
  misc_feature: Coding regions on vcDNA: vcDNA=SeqID_11648; Strand=+; Position=118-615
  misc_feature: Homolog annotation: Hit_ID=AAV91413.1; Match level="QueryCoverage =84%, HitCoverage=81%, E-value=7e-33, Identity=54%"; Hit description =myosin 3 light chain [Lonomia obliqua]
  misc_feature: Gene Ontology Annotation: Molecular function=calcium ion binding; Cellular component=myosin; Biological process=smooth muscle contraction
  misc_feature (40)..(44): Xaa can be any naturally occurring amino acid
  misc_feature (64)..(70): Xaa can be any naturally occurring amino acid
  misc_feature (113)..(113): Xaa can be any naturally occurring amino acid
  misc_feature (127)..(127): Xaa can be any naturally occurring amino acid
MCSLELYKKHTTLRCIRIDVFVLVEAPAAAPAPAETRSSXXXXXKKAKRSGSNVFSMFSQSQVXXXXXXXQLMDHHEDGIISKSDMRATFDAVGKLASEKELDEMINESPGPXNFTQLLGLFVYPYXADSSSYMTIDEIDVKAFISIDENYTIDGNRFRHALLTC

SEQ ID NO: 31952 - protein, 313 aa, Diabrotica virgifera
  misc_feature: Coding regions on vcDNA: vcDNA=SeqID_11649; Strand=+; Position=1-938
  misc_feature: Homolog annotation: Hit_ID=XP_395296.1; Match level="QueryCoverage =99%, HitCoverage=37%, E-value=1e-108, Identity=41%"; Hit description= similar to Neuroglian precursor [Apis mellifera]
  misc_feature: Gene Ontology Annotation: Molecular function=cell adhesion molecule activity; Cellular component=plasma membrane; Biological process =neuronal cell adhesion
  misc_feature: Pfam annotation: Pfam_ID=I-set; Match level="Score=125.0, E-value =1.8e-34, Copies=2"; Pfam description=Immunoglobulin I-set domain
  misc_feature (41)..(41): Xaa can be any naturally occurring amino acid
  misc_feature (272)..(272): Xaa can be any naturally occurring amino acid
  misc_feature (281)..(281): Xaa can be any naturally occurring amino acid
IATSNSVFLRREKLDSFKISAPTTVVGNEGEPFKITCNPPXGYPKPKINWVYFYNSGAIKSINSSRITIDPEGNLWFSNLTRVDDSDGQRFYACVAILAVKQEYKIGNRILLNVTRLEDFNRNRQPPTKQYVSKKSEVGLRGKSVELFCIYGGTPVPQIFWSKNGRILETSNRIRQNNYGKSLLIKDVDINDAGTYTCEASNGVGEAQTNSIYLNVFASPYFLTKPTNHNAAEGDSVELECKASGVPEPQIKWIHNGKPIEESLDNPRRKVXGNKIIIENXQKYDTGRYGCNATNRLRYVYEESYVNVLSKFY

SEQ ID NO: 31953 - protein, 57 aa, Diabrotica virgifera
  misc_feature: Coding regions on vcDNA: vcDNA=SeqID_11650; Strand=+; Position=459-632
NSKVINCKLKIYDIHIISIWLHCHLQIFHSENILCNHAFFLQKYTYIILVTDIIFRF

SEQ ID NO: 31954 - protein, 56 aa, Diabrotica virgifera
  misc_feature: Coding regions on vcDNA: vcDNA=SeqID_11651; Strand=-; Position=596-766
SVQSSKIIFTCAYPSYKAFCYIFIYNILRKSVVAISKYYSNVTSIIIIYSVMSMMK

SEQ ID NO: 31955 - protein, 147 aa, Diabrotica virgifera
  misc_feature: Coding regions on vcDNA: vcDNA=SeqID_11652; Strand=+; Position=433-873
  misc_feature: Homolog annotation: Hit_ID=CAH04322.1; Match level="QueryCoverage =88%, HitCoverage=67%, E-value=1e-62, Identity=92%"; Hit description =S9e ribosomal protein [Meladema coriacea]
  misc_feature: Gene Ontology Annotation: Molecular function=structural constituent of ribosome; Cellular component=cytosolic ribosome (sensu Eukarya); Biological process=protein biosynthesis
  misc_feature: Pfam annotation: Pfam_ID=Ribosomal_S4; Match level="Score=132.6, E -value=9.3e-37, Copies=1"; Pfam description=Ribosomal protein S4/S9 N- terminal dom
GIDHTTTHSGPHTSCEHSNTYVTPRRPYERARLDQELKIIGAFGLRNKREVWRVKYTLAKIRKAARELLTLEEKEPKRMFEGNALLRRLVRIGVLDENRMKLDYVLGLKIEDFLERRLQTLVFKSGLAKSIHHARVLIRQRHIRIRK

SEQ ID NO: 31956 - protein, 298 aa, Diabrotica virgifera
  misc_feature: Coding regions on vcDNA: vcDNA=SeqID_11653; Strand=-; Position=0-893
  misc_feature (1)..(229): Xaa can be any naturally occurring amino acid
  misc_feature (231)..(241): Xaa can be any naturally occurring amino acid
  misc_feature (248)..(262): Xaa can be any naturally occurring amino acid
  misc_feature (269)..(287): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXXXXXXXIPVTHEXXXXXXXXXXXXXXXTIIIYHXXXXXXXXXXXXXXXXXXXRARGARREYCA

SEQ ID NO: 31957 - protein, 56 aa, Diabrotica virgifera
  misc_feature: Coding regions on vcDNA: vcDNA=SeqID_11654; Strand=+; Position=478-645
  misc_feature: Homolog annotation: Hit_ID=XP_422048.1; Match level="QueryCoverage =100%, HitCoverage=9%, E-value=3e-13, Identity=67%"; Hit description =PREDICTED: similar to tubulin alpha-5 chain - chicken [Gallus gallus]
  misc_feature: Gene Ontology Annotation: Molecular function=GTP binding; Cellular component=cytoskeleton; Biological process=microtubule-based process
  misc_feature (21)..(21): Xaa can be any naturally occurring amino acid
FYIYPAPQGSTAEEQPFFSIXTTLSTHEHSYCCLMRDNDAIYDFSRRNQDIERPTY

SEQ ID NO: 31958 - protein, 41 aa, Diabrotica virgifera
  misc_feature: Coding regions on vcDNA: vcDNA=SeqID_11655; Strand=-; Position=548-673
AESARITSLLYQLYKGGSAATLLISRATGFVDTTESNIGVQ

SEQ ID NO: 31959 - protein, 100 aa, Diabrotica virgifera
  misc_feature: Coding regions on vcDNA: vcDNA=SeqID_11656; Strand=-; Position=29-331
  misc_feature (2)..(8): Xaa can be any naturally occurring amino acid
  misc_feature (28)..(59): Xaa can be any naturally occurring amino acid
FXXXXXXXMYYILNCTFLFNIGNSNIMXXXXXXXXXXXXXXXXXXXXXXXXXXXXXXXXISITSDLEVETLRGWVRIFGCNAIQMRIHFLRILRKPISIF

SEQ ID NO: 31960 - protein, 137 aa, Diabrotica virgifera
  misc_feature: Coding regions on vcDNA: vcDNA=SeqID_11657; Strand=+; Position=43-456
  misc_feature: Homolog annotation: Hit_ID=XP_396823.1; Match level="QueryCoverage =98%, HitCoverage=82%, E-value=1e-44, Identity=61%"; Hit description =similar to ENSANGP00000011961 [Apis mellifera]
  misc_feature: Gene Ontology Annotation: Cellular component=nuclear pore; Biological process=poly(A)+ mRNA-nucleus export
  misc_feature: Pfam annotation: Pfam_ID=NTF2; Match level="Score=103.0, E-value=7.5e- 28, Copies=1"; Pfam description=Nuclear transport factor 2 (NTF2) dom
MEDLRLKIDQACKVAEDFTKLYYDTLDKRRHLIARLYLETGLLSWNGNGVTGNENILKFMIDLPPSSFTIQTLDAQPVLDSAVNGQLTFIIQVTGSVKYQEKTPKTFQQNFIITAQGDKWKIVSDCMRLQEPLNAKN

SEQ ID NO: 31961 - protein, 205 aa, Diabrotica virgifera
  misc_feature: Coding regions on vcDNA: vcDNA=SeqID_11658; Strand=+; Position=1-618
  misc_feature (14)..(38): Xaa can be any naturally occurring amino acid
  misc_feature (41)..(92): Xaa can be any naturally occurring amino acid
  misc_feature (105)..(116): Xaa can be any naturally occurring amino acid
  misc_feature (123)..(133): Xaa can be any naturally occurring amino acid
  misc_feature (138)..(153): Xaa can be any naturally occurring amino acid
  misc_feature (164)..(180): Xaa can be any naturally occurring amino acid
  misc_feature (184)..(194): Xaa can be any naturally occurring amino acid
TAAIPARDPPAPTXXXXXXXXXXXXXXXXXXXXXXXXXMGXXXXXXXXXXXXXXXXXXXXXXXXXXXXXXXXXXXXXXXXXXXXXXXXXXXXWNGMRISVLYISXXXXXXXXXXXXTIFIIIXXXXXXXXXXXRRTYXXXXXXXXXXXXXXXXEFSYSKICYKXXXXXXXXXXXXXXXXXQIYXXXXXXXXXXXDYIIDIFTNNL

SEQ ID NO: 31962 - protein, 74 aa, Diabrotica virgifera
  misc_feature: Coding regions on vcDNA: vcDNA=SeqID_11659; Strand=+; Position=588-812
LYTYDSPNTATKIVRLYCMTTLSDIDHLYIHFIIVYCWTYVLYYYHRNVIKIKRFVEVLIFSIFLQQDLVPKLR

SEQ ID NO: 31963 - protein, 162 aa, Diabrotica virgifera
  misc_feature: Coding regions on vcDNA: vcDNA=SeqID_11660; Strand=-; Position=1-486
  misc_feature (5)..(162): Xaa can be any naturally occurring amino acid
ITPKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31964 - protein, 93 aa, Diabrotica virgifera
  misc_feature: Coding regions on vcDNA: vcDNA=SeqID_11661; Strand=-; Position=557-838
ITFKSMMLCCNSWINHRCQISGAAFCAHNFSAGCISGPIPLQGDHIMSHIWFNILGTRLLIIQLYNKYGFELCCCIIHAYIIIRYSYNITCWL

SEQ ID NO: 31965 - protein, 67 aa, Diabrotica virgifera
  misc_feature: Coding regions on vcDNA: vcDNA=SeqID_11662; Strand=+; Position=343-546
HFSALNIILTNSLVSQSILLMFMKPDLAISFRLLISFMLSIWQFISLPMFGLTWTECLSILSKYFIY

SEQ ID NO: 31966 - protein, 274 aa, Diabrotica virgifera
  misc_feature: Coding regions on vcDNA: vcDNA=SeqID_11663; Strand=+; Position=31-855
  misc_feature: Homolog annotation: Hit_ID=XP_396972.1; Match level="QueryCoverage =98%, HitCoverage=61%, E-value=4e-58, Identity=45%"; Hit description =similar to CG4202-PA [Apis mellifera]
  misc_feature: Gene Ontology Annotation: Cellular component=nucleus
  misc_feature: Pfam annotation: Pfam_ID=Sas10_Utp3; Match level="Score=-53.2, E -value=2.6e-06, Copies=1"; Pfam description=Sas10/Utp3 family
MRIDNDEDYSASDSDDDYTENERILLNKVRNRGKKFSDDEQEVFGVGGDESEDNEDDDGDGSDLALSDVEGQEDDDLPGYQTHGRKDKRKFYQTDYVDGDYGGFQGKDAQLAELEEEEARNLQKQLAQHLDDDDFGLDIFAKKADEDDKQNEEIIKTDISKLSKRQKLQIMQKESPEFFNLVQDFQNKMAVVTSHLHPVLKKAEAGDIPQCKAVDFVQFKYELILDYCTNIYMYLLLKSSTVNVQNHPLIKRLYQYRQLLLELEPVYEDVIKHQ

SEQ ID NO: 31967 - protein, 47 aa, Diabrotica virgifera
  misc_feature: Coding regions on vcDNA: vcDNA=SeqID_11664; Strand=-; Position=250-393
FMQLFHPYFYFQILRKYISVVNHILYIYIIWIIENRLHPKCLGNKEL

SEQ ID NO: 31968 - protein, 55 aa, Diabrotica virgifera
  misc_feature: Coding regions on vcDNA: vcDNA=SeqID_11665; Strand=+; Position=2-169
KFLDLQTVSEYARGRAVHEIVPGDNGDIAFHPHIVTILSINLLLLSRFRESRSLT

SEQ ID NO: 31969 - protein, 210 aa, Diabrotica virgifera
  misc_feature: Coding regions on vcDNA: vcDNA=SeqID_11666; Strand=-; Position=77-709
  misc_feature: Homolog annotation: Hit_ID=XP_319221.1; Match level="QueryCoverage =100%, HitCoverage=100%, E-value=1e-113, Identity=96%"; Hit description=ENSANGP00000006082 [Anopheles gambiae] gb|EAA43596.1| ENSANGP00000006082 [Anopheles gambiae
  misc_feature: Gene Ontology Annotation: Molecular function=DNA-directed RNA polymerase activity; Cellular component=DNA-directed RNA polymerase I complex; Biological process=embryogenesis and morphogenesis
  misc_feature: Pfam annotation: Pfam_ID=RNA_pol_Rpb5_N; Match level="Score=186.3, E -value=6.2e-53, Copies=1"; Pfam description=RNA polymerase Rpb5, N -terminal domai
MDDEAETYKLWRIRKTVMQLCHDRGYLVTQDELDQTLEQFKEQFGDKPSEKRPSRSDLIVLVAHNDDPTDQLFVFFPDEPKIGIKTIKTYCSRMQEENIHRAIIVVQAGMTPSAKQSLVDMAPKYILEQFLESELLINITEHELVPEHVVMTPEEKQELLARYKLKENMLMRIQAGDPVARYFGLKRGQVVKIIRSSETAGRYISYRLVC

SEQ ID NO: 31970 - protein, 281 aa, Diabrotica virgifera
  misc_feature: Coding regions on vcDNA: vcDNA=SeqID_11667; Strand=+; Position=38-883
  misc_feature: Homolog annotation: Hit_ID=CAI21826.1; Match level="QueryCoverage =96%, HitCoverage=82%, E-value=3e-83, Identity=49%"; Hit description =novel protein [Homo sapiens]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=240.7, E-value =2.6e-69, Copies=9"; Pfam description=Zinc finger, C2H2 type
  misc_feature (76)..(82): Xaa can be any naturally occurring amino acid
  misc_feature (232)..(240): Xaa can be any naturally occurring amino acid
MEVTSTKPFNDTKAHLKTYTGERLYECKICCKQFSYLSTFNEHMKVHTGETPYKCEICSMHFNHRSHLNTHMKIHXXXXXXXCDICSKPFTRLSSLKDHMRVHTGEKPYKCKICSKQFSHISNLNKHMKIHIGEKPYKCEICIKQFSYLSSLNEHTSVHTGEKPYKCKICSKQFSHISNLNKHMKIHIGEKPYKCEICSKQLSRKSGLDKHMKIHTGEKPYKCDICSKLFTXXXXXXXXXRIHTGERLYECEICSKPFTRLSSLKVHVRVHTGEKTYKCEF

SEQ ID NO: 31971 - protein, 289 aa, Diabrotica virgifera
  misc_feature: Coding regions on vcDNA: vcDNA=SeqID_11668; Strand=+; Position=50-917
  misc_feature: Homolog annotation: Hit_ID=AAF87759.1; Match level="QueryCoverage =99%, HitCoverage=65%, E-value=4e-94, Identity=65%"; Hit description =cytochrome oxidase subunit I [Diabrotica virgifera virgifera]
  misc_feature: Pfam annotation: Pfam_ID=COX1; Match level="Score=34.2, E-value=2.2e -12, Copies=1"; Pfam description=Cytochrome C and Quinol oxidase polyp
  misc_feature (18)..(18): Xaa can be any naturally occurring amino acid
  misc_feature (23)..(31): Xaa can be any naturally occurring amino acid
  misc_feature (51)..(51): Xaa can be any naturally occurring amino acid
  misc_feature (74)..(74): Xaa can be any naturally occurring amino acid
  misc_feature (92)..(92): Xaa can be any naturally occurring amino acid
  misc_feature (103)..(103): Xaa can be any naturally occurring amino acid
  misc_feature (121)..(121): Xaa can be any naturally occurring amino acid
  misc_feature (148)..(154): Xaa can be any naturally occurring amino acid
  misc_feature (159)..(165): Xaa can be any naturally occurring amino acid
  misc_feature (205)..(205): Xaa can be any naturally occurring amino acid
  misc_feature (240)..(240): Xaa can be any naturally occurring amino acid
  misc_feature (257)..(257): Xaa can be any naturally occurring amino acid
  misc_feature (274)..(274): Xaa can be any naturally occurring amino acid
ILEAPDIIFPLINNIRFXLLPTXXXXXXXXXIVEMRVVAAGTDYPSLSSDXFAHVCPSINLTIFRLHLTGISSXILGVIKFITTEMNILPIXITFDQIPLFDXTVEITTILLLLSLPVLVXVITILLSDRNLNTSFYDPTDGGDPILXXXXXXXFGHPXXXXXXXPRFGLISHIVKQEIRKKEAFDTLGIIYAIIAIGLLCCIDXAHHIFTVGMDVDTRAYITSATIIIAVPTGIKVFRXLATYHGTTITYSPVTLXALGFILLFTVGGLTGVXIANSSIDIVLHDTYL

SEQ ID NO: 31972 - protein, 75 aa, Diabrotica virgifera
  misc_feature: Coding regions on vcDNA: vcDNA=SeqID_11669; Strand=+; Position=195-422
TYKDPTTPRVGTSRVQSTRDRSGGYTASHLILFILVLLPATLRGAVSVTVGPLHHIGVSFVPRTWVLDIKEHWNL

SEQ ID NO: 31973 - protein, 78 aa, Diabrotica virgifera
  misc_feature: Coding regions on vcDNA: vcDNA=SeqID_11670; Strand=-; Position=40-276
KSTHFYQKTSIYTNITDVPLTYIHNRCSSYTGRCRGQKNKHKTKNISAALPHEMSKENLCKISGRSVKLFLSYNIHRL

SEQ ID NO: 31974 - protein, 60 aa, Diabrotica virgifera
  misc_feature: Coding regions on vcDNA: vcDNA=SeqID_11671; Strand=-; Position=491-673
GNVFYDGLVVLQHSRWHNKRLRESSGYLRAQQGHQHVLYGKVVSHGDMQSLWIYRRDIFS

SEQ ID NO: 31975 - protein, 162 aa, Diabrotica virgifera
  misc_feature: Coding regions on vcDNA: vcDNA=SeqID_11672; Strand=-; Position=322-810
  misc_feature (10)..(20): Xaa can be any naturally occurring amino acid
  misc_feature (28)..(34): Xaa can be any naturally occurring amino acid
  misc_feature (39)..(66): Xaa can be any naturally occurring amino acid
  misc_feature (79)..(100): Xaa can be any naturally occurring amino acid
  misc_feature (106)..(147): Xaa can be any naturally occurring amino acid
  misc_feature (151)..(157): Xaa can be any naturally occurring amino acid
DPSFRLSIGXXXXXXXXXXXDTAAVQIXXXXXXXIFNTXXXXXXXXXXXXXXXXXXXXXXXXXXXXFLIIILSSLLNLXXXXXXXXXXXXXXXXXXXXXXIITYFXXXXXXXXXXXXXXXXXXXXXXXXXXXXXXXXXXXXXXXXXXGDKXXXXXXXKIRCI

SEQ ID NO: 31976 - protein, 112 aa, Diabrotica virgifera
  misc_feature: Coding regions on vcDNA: vcDNA=SeqID_11673; Strand=+; Position=3-341
  misc_feature (38)..(52): Xaa can be any naturally occurring amino acid
  misc_feature (71)..(79): Xaa can be any naturally occurring amino acid
  misc_feature (85)..(91): Xaa can be any naturally occurring amino acid
PRPPALPHAPDLFFNNKTFLSISKEKIVFSDIYLVLWXXXXXXXXXXXXXXXSRRTADHLIIIYFIIFFTXXXXXXXXXIARQIXXXXXXXMTRYSFLNISYFFRKKSHLFT

SEQ ID NO: 31977 - protein, 37 aa, Diabrotica virgifera
  misc_feature: Coding regions on vcDNA: vcDNA=SeqID_11674; Strand=+; Position=2-112
  misc_feature (2)..(15): Xaa can be any naturally occurring amino acid
  misc_feature (20)..(21): Xaa can be any naturally occurring amino acid
NXXXXXXXXXXXXXXATSMXXLKFYNWCSSYINKVWS

SEQ ID NO: 31978 - protein, 160 aa, Diabrotica virgifera
  misc_feature: Coding regions on vcDNA: vcDNA=SeqID_11675; Strand=-; Position=242-724
  misc_feature (14)..(21): Xaa can be any naturally occurring amino acid
  misc_feature (30)..(38): Xaa can be any naturally occurring amino acid
  misc_feature (60)..(83): Xaa can be any naturally occurring amino acid
  misc_feature (91)..(118): Xaa can be any naturally occurring amino acid
  misc_feature (124)..(144): Xaa can be any naturally occurring amino acid
  misc_feature (147)..(159): Xaa can be any naturally occurring amino acid
KDSIVFIQTIIASXXXXXXXXATLARSIYXXXXXXXXXRRVVTVNSKSHAFNDQVKEMSXXXXXXXXXXXXXXXXXXXXXXXXIDLNNLEXXXXXXXXXXXXXXXXXXXXXXXXXXXXIVVIFXXXXXXXXXXXXXXXXXXXXXNEXXXXXXXXXXXXXM

SEQ ID NO: 31979 - protein, 109 aa, Diabrotica virgifera
  misc_feature: Coding regions on vcDNA: vcDNA=SeqID_11676; Strand=+; Position=508-837
LNSTGKQIEIYLYFYRNLIITNQESQYRPLRLFERVHKHTLLVSVTYSILSKVFLAVLFEITKVMTILYMWYLLIDDLSVNTSYLILRKILQESPYSELFQTHSILKYI

SEQ ID NO: 31980 - protein, 62 aa, Diabrotica virgifera
  misc_feature: Coding regions on vcDNA: vcDNA=SeqID_11677; Strand=-; Position=383-571
SIMVHRTSQYIHCSRHRQDKIKFDIESVQLALRRSARKLNTLCMSRFWWRAHQNIWIDVWIR

SEQ ID NO: 31981 - protein, 36 aa, Diabrotica virgifera
  misc_feature: Coding regions on vcDNA: vcDNA=SeqID_11678; Strand=-; Position=3-110
  misc_feature (4)..(19): Xaa can be any naturally occurring amino acid
  misc_feature (24)..(34): Xaa can be any naturally occurring amino acid
FNHXXXXXXXXXXXXXXXXVLIIXXXXXXXXXXXKK

SEQ ID NO: 31982 - protein, 76 aa, Diabrotica virgifera
  misc_feature: Coding regions on vcDNA: vcDNA=SeqID_11679; Strand=-; Position=330-560
TNWCTNGITTCTPTGLSLQMCHLSITGLYQIFSVYLSCAFKVEFSFRYPLYFILGFALSPFLWNTLTSCGVILNAN

SEQ ID NO: 31983 - protein, 74 aa, Diabrotica virgifera
  misc_feature: Coding regions on vcDNA: vcDNA=SeqID_11680; Strand=-; Position=125-349
VQYIMVIIKNKLSKSGSMDLSWRNVSYWNSSIAIVIAYCILEISFSCNEKKLSNPCINVSFKYLYTSFLSHIDL

SEQ ID NO: 31984 - protein, 228 aa, Diabrotica virgifera
  misc_feature: Coding regions on vcDNA: vcDNA=SeqID_11681; Strand=-; Position=3-686
  misc_feature (17)..(27): Xaa can be any naturally occurring amino acid
  misc_feature (29)..(54): Xaa can be any naturally occurring amino acid
  misc_feature (59)..(86): Xaa can be any naturally occurring amino acid
  misc_feature (96)..(148): Xaa can be any naturally occurring amino acid
  misc_feature (152)..(173): Xaa can be any naturally occurring amino acid
  misc_feature (175)..(187): Xaa can be any naturally occurring amino acid
  misc_feature (191)..(208): Xaa can be any naturally occurring amino acid
  misc_feature (212)..(223): Xaa can be any naturally occurring amino acid
RGQNRADIQITQWAGEXXXXXXXXXXXIXXXXXXXXXXXXXXXXXXXXXXXXXXYYPHXXXXXXXXXXXXXXXXXXXXXXXXXXXXHILICENFLXXXXXXXXXXXXXXXXXXXXXXXXXXXXXXXXXXXXXXXXXXXXXXXXXXXXXESHXXXXXXXXXXXXXXXXXXXXXXKXXXXXXXXXXXXXVIHXXXXXXXXXXXXXXXXXXIIIXXXXXXXXXXXXRYCII

SEQ ID NO: 31985 - protein, 99 aa, Diabrotica virgifera
  misc_feature: Coding regions on vcDNA: vcDNA=SeqID_11682; Strand=-; Position=93-392
HEVIRREVVNDCNEHILYKIRHIYNKYNHILLLRYMYLDNIFTGHWYVLCFLERLGNVHMVGTSSGIHYPCFTSYGVINSFWDKDENFCHQSLLSIILL

SEQ ID NO: 31986 - protein, 211 aa, Diabrotica virgifera
  misc_feature: Coding regions on vcDNA: vcDNA=SeqID_11683; Strand=+; Position=77-714
  misc_feature: Homolog annotation: Hit_ID=AAU95193.1; Match level="QueryCoverage =97%, HitCoverage=66%, E-value=2e-55, Identity=55%"; Hit description =putative mitochondrial ADP/ATP translocase [Oncometopia nigricans]
  misc_feature: Gene Ontology Annotation: Molecular function=transporter activity; Cellular component=integral to plasma membrane; Biological process =transport
  misc_feature: Pfam annotation: Pfam_ID=Mito_carr; Match level="Score=5.1, E-value =0.0018, Copies=1"; Pfam description=Mitochondrial carrier protein
  misc_feature (31)..(31): Xaa can be any naturally occurring amino acid
  misc_feature (39)..(39): Xaa can be any naturally occurring amino acid
  misc_feature (56)..(56): Xaa can be any naturally occurring amino acid
  misc_feature (100)..(106): Xaa can be any naturally occurring amino acid
  misc_feature (111)..(111): Xaa can be any naturally occurring amino acid
  misc_feature (148)..(148): Xaa can be any naturally occurring amino acid
  misc_feature (165)..(165): Xaa can be any naturally occurring amino acid
  misc_feature (175)..(175): Xaa can be any naturally occurring amino acid
  misc_feature (192)..(192): Xaa can be any naturally occurring amino acid
MSLADPVAFMKDFLPAGIPAAISRTCAAPSXTRTHAFDXQPFSRQVTEDPRDKGIXYCFLRIAKESAVLAYWRDNTANDIRYFPTKHLNFPFDDKYKQIXXXXXXXNTPFXVRYFLGNLASGGAAASTSLCYVYPLDFSGSFMNADVXNDAHDREFSALTDCISXIYPADYLIRXFRGFGDSVLGIIIYRAXFFYCYHTADVILRDANTLV

SEQ ID NO: 31987 - protein, 103 aa, Diabrotica virgifera
  misc_feature: Coding regions on vcDNA: vcDNA=SeqID_11684; Strand=+; Position=435-743
  misc_feature (14)..(39): Xaa can be any naturally occurring amino acid
  misc_feature (50)..(103): Xaa can be any naturally occurring amino acid
IKIMIKHSHILHYXXXXXXXXXXXXXXXXXXXXXXXXXXLSTAHTISISXXXXXXXXXXXXXXXXXXXXXXXXXXXXXXXXXXXXXXXXXXXXXXXXXXXXXX

SEQ ID NO: 31988 - protein, 296 aa, Diabrotica virgifera
  misc_feature: Coding regions on vcDNA: vcDNA=SeqID_11685; Strand=+; Position=26-916
  misc_feature (6)..(277): Xaa can be any naturally occurring amino acid
INSVLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDKFHLIGGDQKIILTLFIL

SEQ ID NO: 31989 - protein, 307 aa, Diabrotica virgifera
  misc_feature: Coding regions on vcDNA: vcDNA=SeqID_11686; Strand=+; Position=1-921
  misc_feature (1)..(216): Xaa can be any naturally occurring amino acid
  misc_feature (219)..(225): Xaa can be any naturally occurring amino acid
  misc_feature (234)..(244): Xaa can be any naturally occurring amino acid
  misc_feature (248)..(275): Xaa can be any naturally occurring amino acid
  misc_feature (285)..(305): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPCXXXXXXXFWPCLGNIXXXXXXXXXXXEGVXXXXXXXXXXXXXXXXXXXXXXXXXXXXRIKTPLKFFXXXXXXXXXXXXXXXXXXXXXGG

SEQ ID NO: 31990 - protein, 257 aa, Diabrotica virgifera
  misc_feature: Coding regions on vcDNA: vcDNA=SeqID_11687; Strand=+; Position=6-779
  misc_feature (44)..(78): Xaa can be any naturally occurring amino acid
  misc_feature (80)..(105): Xaa can be any naturally occurring amino acid
  misc_feature (109)..(140): Xaa can be any naturally occurring amino acid
  misc_feature (145)..(158): Xaa can be any naturally occurring amino acid
  misc_feature (160)..(201): Xaa can be any naturally occurring amino acid
  misc_feature (210)..(227): Xaa can be any naturally occurring amino acid
  misc_feature (239)..(254): Xaa can be any naturally occurring amino acid
RKAAYARHAPAPAFPRPIHPPGHYRSQRLSLYLFGNILFNASYXXXXXXXXXXXXXXXXXXXXXXXXXXXXXXXXXXXIXXXXXXXXXXXXXXXXXXXXXXXXXXFLNXXXXXXXXXXXXXXXXXXXXXXXXXXXXXXXXMTLKXXXXXXXXXXXXXXLXXXXXXXXXXXXXXXXXXXXXXXXXXXXXXXXXXXXXXXXXXLQHCLFSNXXXXXXXXXXXXXXXXXXKTCHVALNITSXXXXXXXXXXXXXXXXHVA

SEQ ID NO: 31991 - protein, 277 aa, Diabrotica virgifera
  misc_feature: Coding regions on vcDNA: vcDNA=SeqID_11688; Strand=-; Position=1-831
  misc_feature (6)..(27): Xaa can be any naturally occurring amino acid
  misc_feature (32)..(51): Xaa can be any naturally occurring amino acid
  misc_feature (62)..(277): Xaa can be any naturally occurring amino acid
YRVFSXXXXXXXXXXXXXXXXXXXXXXLGHPXXXXXXXXXXXXXXXXXXXXIARPFILISGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31992 - protein, 220 aa, Diabrotica virgifera
  misc_feature: Coding regions on vcDNA: vcDNA=SeqID_11689; Strand=+; Position=71-730
  misc_feature: Homolog annotation: Hit_ID=CAA90716.1; Match level="QueryCoverage =81%, HitCoverage=58%, E-value=4e-36, Identity=47%"; Hit description =hnRNP protein [Chironomus tentans]
  misc_feature: Gene Ontology Annotation: Molecular function=poly(U) binding; Cellular component=nuclear speck; Biological process=mRNA polyadenylation
  misc_feature: Pfam annotation: Pfam_ID=RRM_1; Match level="Score=0.9, E-value =0.065, Copies=1"; Pfam description=RNA recognition motif. (a.k.a. RRM, RB
  misc_feature (51)..(51): Xaa can be any naturally occurring amino acid
  misc_feature (57)..(57): Xaa can be any naturally occurring amino acid
  misc_feature (81)..(81): Xaa can be any naturally occurring amino acid
  misc_feature (90)..(90): Xaa can be any naturally occurring amino acid
  misc_feature (108)..(108): Xaa can be any naturally occurring amino acid
  misc_feature (120)..(120): Xaa can be any naturally occurring amino acid
  misc_feature (128)..(128): Xaa can be any naturally occurring amino acid
  misc_feature (151)..(151): Xaa can be any naturally occurring amino acid
  misc_feature (172)..(172): Xaa can be any naturally occurring amino acid
GDIRRRHVVTSIALTQTIPRDLREAPPDRGHVQTPGRDNDKKLLVAGMYRXTTGREXQQHFGQYAEIQNIIVKTNSNTAIXRGFVFIAFXPTQSIDSPVPAGDHVLSXKKYDPKYPKTRXMQKYYVGXLTSELKDDDIQNYFSQFESTLDXEVTFDKRKNPIDTHPEFITSXNLEQVANASLNRPQQTLMDKEVDVKKAPPKADQTADPMMHMHGMRPGG

SEQ ID NO: 31993 - protein, 92 aa, Diabrotica virgifera
  misc_feature: Coding regions on vcDNA: vcDNA=SeqID_11690; Strand=+; Position=321-599
HTLTTIQQRQLHPQYPTSELIPLKSLLTLDHILNKLWTPESYSSTDPLISTYSAPSTGQGIAPLMYNETAPVVSTYSAPLVTTSDVCHACFI

SEQ ID NO: 31994 - protein, 191 aa, Diabrotica virgifera
  misc_feature: Coding regions on vcDNA: vcDNA=SeqID_11691; Strand=+; Position=1-576
  misc_feature (8)..(14): Xaa can be any naturally occurring amino acid
  misc_feature (22)..(29): Xaa can be any naturally occurring amino acid
  misc_feature (31)..(47): Xaa can be any naturally occurring amino acid
  misc_feature (50)..(61): Xaa can be any naturally occurring amino acid
  misc_feature (81)..(87): Xaa can be any naturally occurring amino acid
  misc_feature (90)..(99): Xaa can be any naturally occurring amino acid
  misc_feature (106)..(119): Xaa can be any naturally occurring amino acid
  misc_feature (127)..(133): Xaa can be any naturally occurring amino acid
  misc_feature (135)..(142): Xaa can be any naturally occurring amino acid
  misc_feature (155)..(165): Xaa can be any naturally occurring amino acid
  misc_feature (171)..(184): Xaa can be any naturally occurring amino acid
PPSHPSVXXXXXXXYPHQTKIXXXXXXXXLXXXXXXXXXXXXXXXXXRIXXXXXXXXXXXXSNLKELKNHNSYCNTNILHXXXXXXXIRXXXXXXXXXXNYPYLLXXXXXXXXXXXXXXHIFRDQLXXXXXXXFXXXXXXXXNNFHILTYAIIYXXXXXXXXXXXSLLQYXXXXXXXXXXXXXXITKLSIY

SEQ ID NO: 31995 - protein, 21 aa, Diabrotica virgifera
  misc_feature: Coding regions on vcDNA: vcDNA=SeqID_11692; Strand=-; Position=0-62
  misc_feature (1)..(18): Xaa can be any naturally occurring amino acid
XXXXXXXXXXXXXXXXXXLFT

SEQ ID NO: 31996 - protein, 87 aa, Diabrotica virgifera
  misc_feature: Coding regions on vcDNA: vcDNA=SeqID_11693; Strand=-; Position=85-348
  misc_feature (58)..(64): Xaa can be any naturally occurring amino acid
EDQCRICVKGNFDKGGIMWLLRSYFLSHTSYGLEVILLHFILLIWSVYYSRYLLTEDXXXXXXXPVCVNYSSQINPIYLKTLVPHII

SEQ ID NO: 31997 - protein, 71 aa, Diabrotica virgifera
  misc_feature: Coding regions on vcDNA: vcDNA=SeqID_11694; Strand=+; Position=2-214
FLLLFFIKYFLYKIWDNMHKKIESYTKFIVLLNFVIQWKYTTPPFTHTSYTYKLKNYVYIILELNKEKHNT

SEQ ID NO: 31998 - protein, 203 aa, Diabrotica virgifera
  misc_feature: Coding regions on vcDNA: vcDNA=SeqID_11695; Strand=-; Position=3-611
  misc_feature (15)..(22): Xaa can be any naturally occurring amino acid
  misc_feature (27)..(38): Xaa can be any naturally occurring amino acid
  misc_feature (44)..(57): Xaa can be any naturally occurring amino acid
  misc_feature (59)..(203): Xaa can be any naturally occurring amino acid
KLKIENNPGSHRFNXXXXXXXXSNSLXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31999 - protein, 77 aa, Diabrotica virgifera
  misc_feature: Coding regions on vcDNA: vcDNA=SeqID_11696; Strand=-; Position=687-920
  misc_feature (30)..(30): Xaa can be any naturally occurring amino acid
  misc_feature (36)..(36): Xaa can be any naturally occurring amino acid
SSVKPDAYIKGIYSIYTTQTNFPIWLKCLXNLHLFXHSRESATDRHIIIIESVLVIRSVGVGVARRRGVVLLFLLFH

SEQ ID NO: 32000 - protein, 133 aa, Diabrotica virgifera
  misc_feature: Coding regions on vcDNA: vcDNA=SeqID_11697; Strand=-; Position=356-757
  misc_feature (109)..(120): Xaa can be any naturally occurring amino acid
  misc_feature (124)..(132): Xaa can be any naturally occurring amino acid
SFHGHLLFSKYICPFSRTIHMLYIDFITSPPAAQQTVVISIFLSLNSVPISSIALKKDSLLGSGFGEFHSGFYVCIIALKWVYILYYGLPSVNIGTPLSIASNFYTNTXXXXXXXXXXXXLFVXXXXXXXXXV

SEQ ID NO: 32001 - protein, 250 aa, Diabrotica virgifera
  misc_feature: Coding regions on vcDNA: vcDNA=SeqID_11698; Strand=+; Position=35-787
  misc_feature: Homolog annotation: Hit_ID=EAL26672.1; Match level="QueryCoverage =86%, HitCoverage=54%, E-value=3e-36, Identity=34%"; Hit description =GA13500-PA [Drosophila pseudoobscura]
  misc_feature: Pfam annotation: Pfam_ID=Peptidase_S9; Match level="Score=-64.0, E -value=0.0062, Copies=1"; Pfam description=Prolyl oligopeptidase family
LPQFHGPNSNHSVLLYFHGTGEVRSYSERKYELLSYNFQIIAFDYRGYGDSSDGELTEDTVGEDCVELYKWVRNRTKSDIYVWGHSLGAALATRTVAEMENYYNVHTKALVLESGFTSMRDELYVHPYGKLFAWLPWFDTVVVEPLMHNGFVFNTTKHLKTITCPVMILHAQDDNEIPYYFGRRLADIAESRNITTVYHEFDAMFGYKHYYLYQDPFMKFYIMNFIEQVNSKRIIEGNNTTVVPSMGTTV

SEQ ID NO: 32002 - protein, 78 aa, Diabrotica virgifera
  misc_feature: Coding regions on vcDNA: vcDNA=SeqID_11699; Strand=-; Position=503-739
CTLLYVLHQGVSVSISHMSSRYCSFMCLMVSSIYNSFFIPHRTSLFVIHFIPSVFVYLITAKNKVNFSIIFLSIRKFI

SEQ ID NO: 32003 - protein, 83 aa, Diabrotica virgifera
  misc_feature: Coding regions on vcDNA: vcDNA=SeqID_11700; Strand=+; Position=470-721
QKFEYSTELSNNANYTQEHELECVLPPTFIRTDFTHRISYYLRCNGFIYRLFYYRYYRIYILSLHCYTLLTILHGLITEFSHI

SEQ ID NO: 32004 - protein, 290 aa, Diabrotica virgifera
  misc_feature: Coding regions on vcDNA: vcDNA=SeqID_11701; Strand=+; Position=43-911
  misc_feature: Homolog annotation: Hit_ID=AAV68692.1; Match level="QueryCoverage =98%, HitCoverage=52%, E-value=5e-38, Identity=44%"; Hit description =putative IDGF [Diaprepes abbreviatus]
  misc_feature: Gene Ontology Annotation: Cellular component=extracellular
  misc_feature: Pfam annotation: Pfam_ID=Glyco_hydro_18; Match level="Score=-36.4, E -value=0.0023, Copies=1"; Pfam description=Glycosyl hydrolases family 18
  misc_feature (138)..(144): Xaa can be any naturally occurring amino acid
  misc_feature (173)..(184): Xaa can be any naturally occurring amino acid
  misc_feature (203)..(212): Xaa can be any naturally occurring amino acid
  misc_feature (216)..(223): Xaa can be any naturally occurring amino acid
  misc_feature (277)..(277): Xaa can be any naturally occurring amino acid
MGSLTLSVIFLSLAAFSVAENIVVCNYESKSHLRDGEGKFDVSNLNEALRYCTHLLYGYAAIDDNTYKLVPMNEQYDVITDLKKTHPKLKVLLSVGGNEDVSNLNEALRYCTHLLYGYAAIDDNTYKLVPMNEQYDVXXXXXXXITDLKKTHPKLKVLLSVGGNEDVSGSGDXXXXXXXXXXXXTAHRLSFVNSAYTLLKAYXXXXXXXXXXFPEXXXXXXXXGLKKLWSSIKTTVAGEHVVDENAQQHREQFVALVKELKMLLSRHMQLSLTVLPXITSTVYYDPRNLA

SEQ ID NO: 32005 - protein, 96 aa, Diabrotica virgifera
  misc_feature: Coding regions on vcDNA: vcDNA=SeqID_11702; Strand=-; Position=356-646
PLRDIMKEEDIVRFINEMKRLRWLRHIQRKKSDLLIKNITKWKPETKRPRGKPRERWEDQVMRDIKILEVRNWRELCIYQNEWKKIVTKDKSYNKL

SEQ ID NO: 32006 - protein, 59 aa, Diabrotica virgifera
  misc_feature: Coding regions on vcDNA: vcDNA=SeqID_11703; Strand=+; Position=597-776
SSSHTPNMKNLYIKLLYCIPLTQTYIAYHSCYERPLCLHTNQTLSCPLTYSIVRLHIPL

SEQ ID NO: 32007 - protein, 98 aa, Diabrotica virgifera
  misc_feature: Coding regions on vcDNA: vcDNA=SeqID_11704; Strand=+; Position=311-607
MYKYTYCFSASRTYCQWSDHKYNIESHHYTIFNSYSNMHHQNTVLILQMLHVVDYCIDINDFTDLIPVILTDKHLFTLNHFMSHLALNDVYTMIYYLN

SEQ ID NO: 32008 - protein, 117 aa, Diabrotica virgifera
  misc_feature: Coding regions on vcDNA: vcDNA=SeqID_11705; Strand=-; Position=3-455
  misc_feature: Homolog annotation: Hit_ID=XP_525925.1; Match level="QueryCoverage =90%, HitCoverage=84%, E-value=8e-34, Identity=70%"; Hit description =PREDICTED: similar to rRNA intron-encoded homing endonuclease [Pan troglodytes]
  misc_feature (18)..(18): Xaa can be any naturally occurring amino acid
  misc_feature (36)..(36): Xaa can be any naturally occurring amino acid
  misc_feature (41)..(41): Xaa can be any naturally occurring amino acid
  misc_feature (90)..(90): Xaa can be any naturally occurring amino acid
LARAVQLNPAAVLLTECXVGRYVYFEQIRVLKAGQXRLNTXAWNNGIGPRFYFVEAKAFAKNAFIDQERKLEVRRRSDTALVLTINDASXRFADVPPMTRRAASGKPKLLGSGGSMV

SEQ ID NO: 32009 - protein, 264 aa, Diabrotica virgifera
  misc_feature: Coding regions on vcDNA: vcDNA=SeqID_11706; Strand=+; Position=2-793
  misc_feature (1)..(23): Xaa can be any naturally occurring amino acid
  misc_feature (25)..(47): Xaa can be any naturally occurring amino acid
  misc_feature (49)..(208): Xaa can be any naturally occurring amino acid
  misc_feature (222)..(235): Xaa can be any naturally occurring amino acid
  misc_feature (249)..(256): Xaa can be any naturally occurring amino acid
XXXXXXXXXXXXXXXXXXXXXXXNXXXXXXXXXXXXXXXXXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDSCNEGVHEKKPVXXXXXXXXXXXXXXLYSFKTREHSIELXXXXXXXXQYYIYIYN

SEQ ID NO: 32010 - protein, 276 aa, Diabrotica virgifera
  misc_feature: Coding regions on vcDNA: vcDNA=SeqID_11707; Strand=+; Position=1-828
  misc_feature (4)..(148): Xaa can be any naturally occurring amino acid
  misc_feature (150)..(199): Xaa can be any naturally occurring amino acid
  misc_feature (206)..(247): Xaa can be any naturally occurring amino acid
  misc_feature (255)..(264): Xaa can be any naturally occurring amino acid
IFIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXXXXXXXXXXXXXXXXXXXXXXXXXXXXXXXXXXXXXXXXXXXXXXXXQHSFHLXXXXXXXXXXXXXXXXXXXXXXXXXXXXXXXXXXXXXXXXXXNEVVDENXXXXXXXXXXIRFKLISLNYCK

SEQ ID NO: 32011 - protein, 271 aa, Diabrotica virgifera
  misc_feature: Coding regions on vcDNA: vcDNA=SeqID_11708; Strand=+; Position=44-856
  misc_feature: Homolog annotation: Hit_ID=XP_307898.1; Match level="QueryCoverage =93%, HitCoverage=85%, E-value=4e-80, Identity=55%"; Hit description =ENSANGP00000021756 [Anopheles gambiae]
  misc_feature: Gene Ontology Annotation: Biological process=embryogenesis and morphogenesis
  misc_feature: Pfam annotation: Pfam_ID=Mito_carr; Match level="Score=54.1, E-value =4.1e-13, Copies=3"; Pfam description=Mitochondrial carrier protein
  misc_feature (252)..(252): Xaa can be any naturally occurring amino acid
MNGGVLSHRSINWKEFACGWGAALINVSVTYPINKLIFRQILHGTKIYPAFLQLRSEGIHYLYRGILPPLCQKTLSLSIMFGVYEEVKRPLIQLGFNPYGAKAIGALVSGTTEVILMPFERVQTILADSKHHTDFRNTLHVFRELGKFGIREYYRGLVPIILRNGPSNVGFFILREEMQERFPKYQNEFLRTSLEFLCGAMIGVILSTVFYPLNVLKIRMQSKIGGSFENPWRVLLDIYNERGGKVRYIYYXVQANYTRAFISWGGHEYCL

SEQ ID NO: 32012 - protein, 68 aa, Diabrotica virgifera
  misc_feature: Coding regions on vcDNA: vcDNA=SeqID_11709; Strand=-; Position=1-204
  misc_feature (7)..(17): Xaa can be any naturally occurring amino acid
LTSNKPXXXXXXXXXXXSILNYFLKTYLIRLLVFILNMLTYNPSKRKTAKELLKLNYLKGTKLTSPEM

SEQ ID NO: 32013 - protein, 149 aa, Diabrotica virgifera
  misc_feature: Coding regions on vcDNA: vcDNA=SeqID_11710; Strand=+; Position=97-548
  misc_feature: Homolog annotation: Hit_ID=EAL27395.1; Match level="QueryCoverage =99%, HitCoverage=36%, E-value=4e-22, Identity=43%"; Hit description =GA18932-PA [Drosophila pseudoobscura]
  misc_feature: Gene Ontology Annotation: Molecular function=structural constituent of ribosome; Cellular component=cytosolic large ribosomal subunit (sensu Eukarya); Biological process=protein biosynthesis
  misc_feature (55)..(61): Xaa can be any naturally occurring amino acid
  misc_feature (92)..(92): Xaa can be any naturally occurring amino acid
  misc_feature (135)..(135): Xaa can be any naturally occurring amino acid
CSVYYDKSDEEKESNISLPLFSNAPILPNENNYCHLHVSINHLQPYSDTDKAVHXXXXXXXDTVLAVARIPRVYEVLPTDFVQGAFCNMSYXGCMFAPTNTCSHWHIRVNIIIRLYVLSSSVSANVVSDLIIEHXHVFDQFSELPLVVS

SEQ ID NO: 32014 - protein, 119 aa, Diabrotica virgifera
  misc_feature: Coding regions on vcDNA: vcDNA=SeqID_11711; Strand=-; Position=1-357
TSPCRLLLYNLEHSSPQRIAADIGSRRSETPSSSSPNFQAFEENIRTVAARAEILTLPTISCYVYRNAGTGTLYRKENFSRISRSPIQAIRAYPVVLSFDAISQLIRFSFPGSEICPAF

SEQ ID NO: 32015 - protein, 50 aa, Diabrotica virgifera
  misc_feature: Coding regions on vcDNA: vcDNA=SeqID_11712; Strand=-; Position=0-149
  misc_feature (1)..(46): Xaa can be any naturally occurring amino acid
XXXXXXXXXXXXXXXXXXXXXXXXXXXXXXXXXXXXXXXXXXXXXXSFLT

SEQ ID NO: 32016 - protein, 276 aa, Diabrotica virgifera
  misc_feature: Coding regions on vcDNA: vcDNA=SeqID_11713; Strand=-; Position=88-918
  misc_feature (1)..(12): Xaa can be any naturally occurring amino acid
  misc_feature (15)..(36): Xaa can be any naturally occurring amino acid
  misc_feature (58)..(66): Xaa can be any naturally occurring amino acid
  misc_feature (72)..(81): Xaa can be any naturally occurring amino acid
  misc_feature (89)..(112): Xaa can be any naturally occurring amino acid
  misc_feature (115)..(127): Xaa can be any naturally occurring amino acid
  misc_feature (129)..(139): Xaa can be any naturally occurring amino acid
  misc_feature (145)..(178): Xaa can be any naturally occurring amino acid
  misc_feature (180)..(210): Xaa can be any naturally occurring amino acid
  misc_feature (212)..(242): Xaa can be any naturally occurring amino acid
  misc_feature (253)..(261): Xaa can be any naturally occurring amino acid
XXXXXXXXXXXXFYXXXXXXXXXXXXXXXXXXXXXXFHPSFSIKNLNDYFSLPRSKSXXXXXXXXXKRPFYXXXXXXXXXXFRGKKSSXXXXXXXXXXXXXXXXXXXXXXXXQIXXXXXXXXXXXXXEXXXXXXXXXXXHILIYXXXXXXXXXXXXXXXXXXXXXXXXXXXXXXXXXXLXXXXXXXXXXXXXXXXXXXXXXXXXXXXXXXLXXXXXXXXXXXXXXXXXXXXXXXXXXXXXXXIPNVHKHNFFXXXXXXXXXHSNYLSLNTIFLYFF

SEQ ID NO: 32017 - protein, 296 aa, Diabrotica virgifera
  misc_feature: Coding regions on vcDNA: vcDNA=SeqID_11714; Strand=+; Position=2-889
  misc_feature: Homolog annotation: Hit_ID=XP_321328.1; Match level="QueryCoverage =97%, HitCoverage=12%, E-value=6e-31, Identity=38%"; Hit description =ENSANGP00000012828 [Anopheles gambiae]
  misc_feature: Gene Ontology Annotation: Cellular component=nuclear pore
ALFKNAKERIVSLTEQNNNLKEEVNRPGRSDGAEKESEDSAKVDELLEKIALLERERDDILEEKQQEQDKHTTEVESLNQRISQLQRQLGLQQGSKPSTSSSTTEKSSTERPTADIKPMAGHSTNTQTQSVPIQPWRSGGEPPLASIRPMSAQLRTGVVLPTSQSPSAVMVPPQQQVHTTGSSSIEALSSSPTSSHTEYVPATSSASPAMLGPRQVAVPPTQSSQDTEDDESSMQVQAAPQTQAVALVLPRVEPPSSGPTQEQGTSSSSSNTVTTTQAGHKRQREADMDSSQSDEQ

SEQ ID NO: 32018 - protein, 174 aa, Diabrotica virgifera
  misc_feature: Coding regions on vcDNA: vcDNA=SeqID_11715; Strand=+; Position=139-663
  misc_feature: Homolog annotation: Hit_ID=CAE70527.1; Match level="QueryCoverage =100%, HitCoverage=93%, E-value=5e-14, Identity=24%"; Hit description= Hypothetical protein CBG17156 [Caenorhabditis briggsae]
KRTKKKKWTEGKRKRNTEHQKTSTAGNTTAEKTTQTEQTTNKKKKKGEQRNNKTQNSTTNEHKPAGRKTTRTPEQPHHKKRNEENTRNQKNDTQNKKTEQRKENRNTTTPRRDKNQNPPAHGPRRKPAGAGTSQSTKPKSPKTQTAKEPTPARKKTKTTKRDQNTKTNTHNQHN

SEQ ID NO: 32019 - protein, 142 aa, Diabrotica virgifera
  misc_feature: Coding regions on vcDNA: vcDNA=SeqID_11716; Strand=-; Position=358-786
  misc_feature (23)..(31): Xaa can be any naturally occurring amino acid
  misc_feature (33)..(44): Xaa can be any naturally occurring amino acid
  misc_feature (51)..(74): Xaa can be any naturally occurring amino acid
  misc_feature (80)..(100): Xaa can be any naturally occurring amino acid
  misc_feature (106)..(137): Xaa can be any naturally occurring amino acid
KTEFFSCIPSFQVSIKRLMIMLXXXXXXXXXIXXXXXXXXXXXXIQEDMFXXXXXXXXXXXXXXXXXXXXXXXXCLILIXXXXXXXXXXXXXXXXXXXXXGNNDIXXXXXXXXXXXXXXXXXXXXXXXXXXXXXXXXIPKNV

SEQ ID NO: 32020 - protein, 136 aa, Diabrotica virgifera
  misc_feature: Coding regions on vcDNA: vcDNA=SeqID_11717; Strand=+; Position=187-594
  misc_feature: Homolog annotation: Hit_ID=BAD11812.1; Match level="QueryCoverage =97%, HitCoverage=21%, E-value=1e-17, Identity=43%"; Hit description =ribonuclease L inhibitor homolog [Bombyx mori]
  misc_feature: Gene Ontology Annotation: Molecular function=ATP-binding cassette (ABC) transporter activity; Cellular component=cellular_component unknown; Biological process=embryogenesis and morphogenesis
  misc_feature (61)..(61): Xaa can be any naturally occurring amino acid
  misc_feature (68)..(68): Xaa can be any naturally occurring amino acid
  misc_feature (88)..(88): Xaa can be any naturally occurring amino acid
  misc_feature (107)..(107): Xaa can be any naturally occurring amino acid
MKGPNDQTEQTTHIIFQELESSYIHLPRTRPGESNSLARSNLIDKSTALKNPTEKQMSNTXKIDGCSXWTQILDHFITTELQKYSTNXIEVDLKALMKSQHVDQNPXSHKGNVRPLLDRKDELYKMRHSCSMQNLL

SEQ ID NO: 32021 - protein, 71 aa, Diabrotica virgifera
  misc_feature: Coding regions on vcDNA: vcDNA=SeqID_11718; Strand=-; Position=143-358
PSQWHLRCYMTEVSIQSNLSSGSFLDWYQDVGNSYVEYDAYGYLHEKLQGKPFIMRTSREVVTYHRNEQST

SEQ ID NO: 32022 - protein, 95 aa, Diabrotica virgifera
  misc_feature: Coding regions on vcDNA: vcDNA=SeqID_11719; Strand=+; Position=432-719
LKICYNAFIIYYDPYIFYNGFIMKYMIFDLNHVLMIILGSMKLNLEDKYKGTIKEFGIFCFHRHHCHVFPHQKERPACPLMNLNGPRNPDRAKAA

SEQ ID NO: 32023 - protein, 256 aa, Diabrotica virgifera
  misc_feature: Coding regions on vcDNA: vcDNA=SeqID_11720; Strand=+; Position=2-769
  misc_feature (1)..(16): Xaa can be any naturally occurring amino acid
  misc_feature (19)..(31): Xaa can be any naturally occurring amino acid
  misc_feature (34)..(53): Xaa can be any naturally occurring amino acid
  misc_feature (59)..(174): Xaa can be any naturally occurring amino acid
  misc_feature (186)..(195): Xaa can be any naturally occurring amino acid
  misc_feature (198)..(229): Xaa can be any naturally occurring amino acid
  misc_feature (236)..(255): Xaa can be any naturally occurring amino acid
XXXXXXXXXXXXXXXXGYXXXXXXXXXXXXXQFXXXXXXXXXXXXXXXXXXXXNEMVFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSPVHYKHDLLXXXXXXXXXXLQXXXXXXXXXXXXXXXXXXXXXXXXXXXXXXXXLYCLYKXXXXXXXXXXXXXXXXXXXXL

SEQ ID NO: 32024 - protein, 68 aa, Diabrotica virgifera
  misc_feature: Coding regions on vcDNA: vcDNA=SeqID_11721; Strand=+; Position=456-662
PLLLLISPWVKNNIIGDSQQTWTQSQPFIQGFTIPMNPKMKHPPTSTKSSTTQLTLIPYQLHDGNDTT

SEQ ID NO: 32025 - protein, 73 aa, Diabrotica virgifera
  misc_feature: Coding regions on vcDNA: vcDNA=SeqID_11722; Strand=+; Position=3-224
QCTGRGIPGPFHACVYLHLCFDSLYLCKQIYMVYLSMTYIVYMAVAQLRCLKIFTVFLFPASYHHSELLLTSS

SEQ ID NO: 32026 - protein, 57 aa, Diabrotica virgifera
  misc_feature: Coding regions on vcDNA: vcDNA=SeqID_11723; Strand=-; Position=0-170
  misc_feature (1)..(56): Xaa can be any naturally occurring amino acid
XXXXXXXXXXXXXXXXXXXXXXXXXXXXXXXXXXXXXXXXXXXXXXXXXXXXXXXXL

SEQ ID NO: 32027 - protein, 224 aa, Diabrotica virgifera
  misc_feature: Coding regions on vcDNA: vcDNA=SeqID_11724; Strand=+; Position=119-790
  misc_feature: Homolog annotation: Hit_ID=AAA52429.1; Match level="QueryCoverage =67%, HitCoverage=38%, E-value=2e-20, Identity=33%"; Hit description =beta-fibrinogen precursor
  misc_feature: Gene Ontology Annotation: Molecular function=receptor binding; Cellular component=extracellular space; Biological process=endoderm development
  misc_feature: Pfam annotation: Pfam_ID=Fibrinogen_C; Match level="Score=-50.4, E -value=2.4e-07, Copies=1"; Pfam description=Fibrinogen beta and gamma chains, C-te
  misc_feature (116)..(123): Xaa can be any naturally occurring amino acid
  misc_feature (200)..(200): Xaa can be any naturally occurring amino acid
MISFVVLLLICAKFGVSQSPAEVVSAPNPINVKFTKSIDFTVEGGTNSWKDDLRKFLFQENEAFNLGTKKDNENVSNKSSSGLHKYENTLKNIFDKCKYMVGKSQIPFCLLNPAQXXXXXXXXYPSSCKEILKSGKNKSDVYIIKPKTSNKPFAVLCDMEIKGGGWTHIQRRFDGSQDFYLPWRDYKFGFGNLMGEFWIXLENIYDMTAFETSELLVEFTDTDK

SEQ ID NO: 32028 - protein, 107 aa, Diabrotica virgifera
  misc_feature: Coding regions on vcDNA: vcDNA=SeqID_11725; Strand=+; Position=103-426
  misc_feature: Homolog annotation: Hit_ID=AAN73310.1; Match level="QueryCoverage =88%, HitCoverage=14%, E-value=1e-15, Identity=47%"; Hit description =heat-shock protein 70 [Cotesia rubecula]
  misc_feature: Gene Ontology Annotation: Molecular function=protein binding; Biological process=reproduction
  misc_feature (27)..(27): Xaa can be any naturally occurring amino acid
  misc_feature (48)..(48): Xaa can be any naturally occurring amino acid
  misc_feature (82)..(82): Xaa can be any naturally occurring amino acid
MDMATTEGIVLITTYSCVQALQHDKVXIIAKDQRKRATPSYVAFTNTXSVIGHADNKHIPINLNEKMFEVQHQKVRNYYDRXLEPDMKHCTFEDILRPLKHILRRYR

SEQ ID NO: 32029 - protein, 85 aa, Diabrotica virgifera
  misc_feature: Coding regions on vcDNA: vcDNA=SeqID_11726; Strand=+; Position=77-334
TVRLLCYFIFYLNTQFDYCEMRCHLVFLISPIYTPHISHAVLMTNLSVYLTKKSVITFFETLSIPYHDIFQLFTKLMTVIYIEYR

SEQ ID NO: 32030 - protein, 70 aa, Diabrotica virgifera
  misc_feature: Coding regions on vcDNA: vcDNA=SeqID_11727; Strand=+; Position=22-234
GTHSEPILKKHHMACTTYLNRQFSYAVLPPTLVCGRHTVGVGTERVSEIYCKFLIRLNDYVVQCQIHSFF

SEQ ID NO: 32031 - protein, 271 aa, Diabrotica virgifera
  misc_feature: Coding regions on vcDNA: vcDNA=SeqID_11728; Strand=+; Position=2-817
  misc_feature (1)..(255): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNYLRNNSVILSESSNR

SEQ ID NO: 32032 - protein, 98 aa, Diabrotica virgifera
  misc_feature: Coding regions on vcDNA: vcDNA=SeqID_11729; Strand=+; Position=187-483
  misc_feature: Homolog annotation: Hit_ID=AAL11394.1; Match level="QueryCoverage =81%, HitCoverage=38%, E-value=9e-10, Identity=50%"; Hit description =cytochrome oxidase subunit II [Platyphora kollari]
  misc_feature (36)..(36): Xaa can be any naturally occurring amino acid
  misc_feature (56)..(56): Xaa can be any naturally occurring amino acid
TILPTITSIFIAIPSLQIYYILYVCNDPAITIKSIXTSLKLESYEYSNLILINMIXYYPSNVLLDMSFQILYDDNLIAEPIMNINSNHILLHDMYILS

SEQ ID NO: 32033 - protein, 197 aa, Diabrotica virgifera
  misc_feature: Coding regions on vcDNA: vcDNA=SeqID_11730; Strand=-; Position=0-590
  misc_feature (4)..(194): Xaa can be any naturally occurring amino acid
TLAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRG

SEQ ID NO: 32034 - protein, 66 aa, Diabrotica virgifera; identical to SEQ ID NO: 26808
  misc_feature: Coding regions on vcDNA: vcDNA=SeqID_11731; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 32035 - protein, 23 aa, Diabrotica virgifera
  misc_feature: Coding regions on vcDNA: vcDNA=SeqID_11732; Strand=-; Position=1-69
  misc_feature (12)..(12): Xaa can be any naturally occurring amino acid
  misc_feature (16)..(16): Xaa can be any naturally occurring amino acid
  misc_feature (22)..(23): Xaa can be any naturally occurring amino acid
AFNKKLNDYATXARSXYRGHQXX

SEQ ID NO: 32036 - protein, 72 aa, Diabrotica virgifera
  misc_feature: Coding regions on vcDNA: vcDNA=SeqID_11733; Strand=+; Position=195-413
  misc_feature (42)..(54): Xaa can be any naturally occurring amino acid
  misc_feature (61)..(67): Xaa can be any naturally occurring amino acid
NLVPQLAGQTGRDVVGKEVTICYAIPLAGFTSSFSYLLVIEXXXXXXXXXXXXXIHEINNXXXXXXXLSIRI

SEQ ID NO: 32037 - protein, 238 aa, Diabrotica virgifera
  misc_feature: Coding regions on vcDNA: vcDNA=SeqID_11734; Strand=+; Position=1-714
EDSPRSSPLTVQETSKKQTKSPETGYIGDKSRSRLSWSPSKGEYIDFNEDIDKLSPPNDSRTRQSWACSDRKPKPKQTSTLDFKRLLLQKSSSNSPKKLSAVEQLKMSKQQIRPSPQKLQPEMNILDLSASPRSLVNRKFMHNPPGSPNREQKPLTEVLSPRTQWRFGSPRSDVLSSPILEDCREDESPNSSCERKKSPKNRSSNSSTESSPKNRSSNSNTETSPKAMPRQTHSTTYT

SEQ ID NO: 32038 - protein, 230 aa, Diabrotica virgifera
  misc_feature: Coding regions on vcDNA: vcDNA=SeqID_11735; Strand=+; Position=86-776
  misc_feature: Homolog annotation: Hit_ID=AAH46090.1; Match level="QueryCoverage =100%, HitCoverage=65%, E-value=6e-66, Identity=54%"; Hit description= Similar to JM5 protein [Danio rerio] ref|NP_956525.1| similar to JM5 protein [Danio rerio]
  misc_feature: Gene Ontology Annotation: Molecular function=molecular_function unknown; Cellular component=cellular_component unknown; Biological process=biological_process unknown
  misc_feature (173)..(173): Xaa can be any naturally occurring amino acid
MGTDRKVISVKFNQDQGCFTCCMESGIRIYNVEPLVEKAHYDIETVGSVSQCEMLFRTNLLAVVSGGSRPKFADNVLLIYDDFLKKFILDITFPSSIRAVRMRRDKLVVALLNQIHVFSYPTPTQRLFTLETRENYRGLCEVSPLASAEKQLLVFPGHKIGSVQLVDLSCTEXGVSSAPVWIQAHKSEVGCLAFESQGTRLATASYQGTLIRVWDTTKQNLVVELRHGSD

SEQ ID NO: 32039 - protein, 287 aa, Diabrotica virgifera
  misc_feature: Coding regions on vcDNA: vcDNA=SeqID_11736; Strand=+; Position=1-864
  misc_feature: Homolog annotation: Hit_ID=NP_731021.1; Match level="QueryCoverage =97%, HitCoverage=57%, E-value=7e-40, Identity=33%"; Hit description =CG1213-PC, isoform C [Drosophila melanogaster] ref|NP_731020.1| CG1213-PB, isoform B [Drosophila
  misc_feature: Gene Ontology Annotation: Molecular function=glucose transporter activity; Cellular component=plasma membrane; Biological process =glucose transport
  misc_feature: Pfam annotation: Pfam_ID=Sugar_tr; Match level="Score=-109.9, E-value= 0.0015, Copies=1"; Pfam description=Sugar (and other) transporter
  misc_feature (270)..(270): Xaa can be any naturally occurring amino acid
LLATTGDSTLSWTSPIFPKLMSNDTSSNPLGRPITKHEDSIIGSILNVGALIGPLIFNFITRRFGYKYTLLGLAIPHIVSFLVLAFARNIYLFYAARFLAGLSLGAGYSLFSLYVGEISDDSNRGGMIVITNIFWSLGNFLPLAIGPYTSIMSFNLILTVLPVLFFVLFFGIGVESPYYLIRQKEEEKAEEALMYLRGKNKKDITEELGKIKNFVEHSTEGRIQDIFTDKVLRKCILICILLLATQDLGGYCSILYHLTLIFKAAGSEIXEDTAALIVGIGLFASSF

SEQ ID NO: 32040 - protein, 251 aa, Diabrotica virgifera
  misc_feature: Coding regions on vcDNA: vcDNA=SeqID_11737; Strand=+; Position=1-753
  misc_feature (1)..(238): Xaa can be any naturally occurring amino acid
  misc_feature (241)..(248): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRGXXXXXXXXFNL

SEQ ID NO: 32041 - protein, 106 aa, Diabrotica virgifera
  misc_feature: Coding regions on vcDNA: vcDNA=SeqID_11738; Strand=-; Position=3-320
TIIYILTLFSDYAKAFDCVNHGIRGISSIRYLFTLRIITHCRSYFRDHGILTLPSLYILETVGLIRKPLHVFPARHNHLYSTRNLSFDIYLPIPSTELVKKSILYS

SEQ ID NO: 32042 - protein, 154 aa, Diabrotica virgifera
  misc_feature: Coding regions on vcDNA: vcDNA=SeqID_11739; Strand=+; Position=194-654
  misc_feature: Homolog annotation: Hit_ID=CAE55862.1; Match level="QueryCoverage =100%, HitCoverage=71%, E-value=2e-81, Identity=92%"; Hit description= GTP-binding nuclear protein RAN1 [Chironomus tentans]
  misc_feature: Gene Ontology Annotation: Molecular function=RAN small monomeric GTPase activity; Cellular component=nucleoplasm; Biological process =embryogenesis and morphogenesis
  misc_feature: Pfam annotation: Pfam_ID=Ras; Match level="Score=167.8, E-value=2.4e -47, Copies=1"; Pfam description=Ras family
  misc_feature (123)..(123): Xaa can be any naturally occurring amino acid
MAGEQDMPTFKCVLVGDGGTGKTTFVKRHMTGEFEKKYVATLGVEVHPLVFHTNRGQIRFNVWDTAGQEKFGGLRDGYYIQGQCAIIMFDVTSRVTYKNSSNWHRDLVRVCENIPIVLCGNKXDIKDRKVNAKSIVFHRKKKFTYYDISAKSNY

SEQ ID NO: 32043 - protein, 224 aa, Diabrotica virgifera
  misc_feature: Coding regions on vcDNA: vcDNA=SeqID_11740; Strand=-; Position=1-672
  misc_feature (1)..(219): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTYALT

SEQ ID NO: 32044 - protein, 68 aa, Diabrotica virgifera
  misc_feature: Coding regions on vcDNA: vcDNA=SeqID_11741; Strand=-; Position=18-224
ISNIDCLHGLQTRPVLYKINDLTFYLSTFSHLLMNIMFNFKYILTLTMLSFILSNIMTISLYHSAKIY

SEQ ID NO: 32045 - protein, 69 aa, Diabrotica virgifera
  misc_feature: Coding regions on vcDNA: vcDNA=SeqID_11742; Strand=+; Position=331-540
ILLVIERFGILKRFFILICEMRCNARNLLFKEYQLYKYCSCLEKTLKYFQLNLRLFNGYLIEQAVAVHF

SEQ ID NO: 32046 - protein, 66 aa, Diabrotica virgifera; identical to SEQ ID NO: 26808
  misc_feature: Coding regions on vcDNA: vcDNA=SeqID_11743; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 32047 - protein, 66 aa, Diabrotica virgifera
  misc_feature: Coding regions on vcDNA: vcDNA=SeqID_11744; Strand=+; Position=171-371
EGVVSMKTVNFQAGIAQEVLSFRKELIEQFLLNIGFSSNFRGWLGKGISTPETGWEPPPGQRHASA

SEQ ID NO: 32048 - protein, 231 aa, Diabrotica virgifera
  misc_feature: Coding regions on vcDNA: vcDNA=SeqID_11745; Strand=+; Position=3-695
  misc_feature: Homolog annotation: Hit_ID=DAA04499.1; Match level="QueryCoverage =73%, HitCoverage=12%, E-value=4e-23, Identity=34%"; Hit description =TPA: pol polyprotein [Schistosoma mansoni]
RTVGKYLTKMVSNHQRDWDQYLPFFAMAYRSAVNESTGQTPAKVLFGREMRLPCDLEFGCRPGEDVAGEDYVNELRRRMDDIHELVRSNLQIASDRMKKRYDTQAEKGCFKENDKVWLYNPKKRTGCSPKLQQFWEGPYLIVKKINDVIYRISKIPRGKPMIVHHNRLAPYEGDHDVDEEVEVNQIRGIPDLTFERVMSAYGGTGKARHGVTTEEKRDFLALPDDYSLAHT

SEQ ID NO: 32049 - protein, 149 aa, Diabrotica virgifera
  misc_feature: Coding regions on vcDNA: vcDNA=SeqID_11746; Strand=+; Position=2-448
  misc_feature: Homolog annotation: Hit_ID=AAF87760.1; Match level="QueryCoverage =100%, HitCoverage=33%, E-value=7e-49, Identity=68%"; Hit description= cytochrome oxidase subunit I [Diabrotica virgifera zeae]
  misc_feature (13)..(19): Xaa can be any naturally occurring amino acid
  misc_feature (33)..(33): Xaa can be any naturally occurring amino acid
  misc_feature (41)..(57): Xaa can be any naturally occurring amino acid
  misc_feature (87)..(87): Xaa can be any naturally occurring amino acid
  misc_feature (103)..(110): Xaa can be any naturally occurring amino acid
  misc_feature (131)..(131): Xaa can be any naturally occurring amino acid
DIVLHDTYYVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFSFQRKRLRPLRITSSIEXLQFNPPAEHRYSELPILS

SEQ ID NO: 32050 - protein, 108 aa, Diabrotica virgifera
  misc_feature: Coding regions on vcDNA: vcDNA=SeqID_11747; Strand=-; Position=86-412
HVKYIGYGPLMQAEDESHEAPKALKCSLVGAIPSMKWFASTGITSIEARSNISYSFALFCFRAVYSMLGCIRPALLRVMSSGIDKISRSQCTICLQYNVVIRINCKSI

SEQ ID NO: 32051 - protein, 278 aa, Diabrotica virgifera
  misc_feature: Coding regions on vcDNA: vcDNA=SeqID_11748; Strand=+; Position=3-839
  misc_feature: Homolog annotation: Hit_ID=AAC06263.1; Match level="QueryCoverage =98%, HitCoverage=37%, E-value=4e-56, Identity=43%"; Hit description =pol [Schistosoma mansoni]
  misc_feature: Pfam annotation: Pfam_ID=RVT_1; Match level="Score=111.8, E-value =1.7e-30, Copies=1"; Pfam description=Reverse transcriptase (RNA -dependent
  misc_feature (212)..(217): Xaa can be any naturally occurring amino acid
  misc_feature (278)..(278): Xaa can be any naturally occurring amino acid
ISKIYEKLSSLSVNKGPGPDGIPPNFLKEFSFVLSRPLFHIFNKSLDVGQFPDFWKLSYVTPIYKSGNKSNISNYRPISILSVIPKVFESIITDFLTFDSSGILNSQQFGFTTGKSAELSLLTYVDFLCEALEEGLQVDSIYTDFSKAFDRVNHELLIQKLSSYGISGPLLQWLQSYLTERFQQVRVNHFYSQTFPVKSGVPQGSHLGPLLXXXXXXDITNCFHDCNALLFADDLKCFKVIKNHYDAAILQSELNNLSAWCSLNGMNLNFIKCHVINX

SEQ ID NO: 32052 - protein, 88 aa, Diabrotica virgifera
  misc_feature: Coding regions on vcDNA: vcDNA=SeqID_11749; Strand=+; Position=533-796
  misc_feature: Homolog annotation: Hit_ID=XP_315491.1; Match level="QueryCoverage =90%, HitCoverage=7%, E-value=5e-10, Identity=37%"; Hit description =ENSANGP00000021218 [Anopheles gambiae]
KDPLVRANEENLRLLRQAIPVYEEMFAADLTIGISKAFDILENFRRTQTSANCNPAIMVIHEGLDYDYDKEIYANRNWKKTFLCEFLL

SEQ ID NO: 32053 - protein, 71 aa, Diabrotica virgifera
  misc_feature: Coding regions on vcDNA: vcDNA=SeqID_11750; Strand=+; Position=237-449
  misc_feature: Homolog annotation: Hit_ID=XP_392465.1; Match level="QueryCoverage =98%, HitCoverage=9%, E-value=3e-10, Identity=48%"; Hit description =similar to Bmsqd-2 [Apis mellifera]
  misc_feature: Gene Ontology Annotation: Cellular component=nuclear speck
  misc_feature: Pfam annotation: Pfam_ID=RRM_1; Match level="Score=0.5, E-value =0.073, Copies=1"; Pfam description=RNA recognition motif. (a.k.a. RRM, RB
  misc_feature (48)..(59): Xaa can be any naturally occurring amino acid
FVGGWVGETPVRGLREHFGPNGGIERIKVKTDPPPGGSRGFAFLFFSXXXXXXXXXXXXDHVLIGEKDDPP

SEQ ID NO: 32054 - protein, 45 aa, Diabrotica virgifera
  misc_feature: Coding regions on vcDNA: vcDNA=SeqID_11751; Strand=-; Position=3-137
  misc_feature (19)..(25): Xaa can be any naturally occurring amino acid
  misc_feature (28)..(34): Xaa can be any naturally occurring amino acid
  misc_feature (36)..(36): Xaa can be any naturally occurring amino acid
  misc_feature (40)..(45): Xaa can be any naturally occurring amino acid
KKTMICYLARQNTRPIQLXXXXXXXILXXXXXXXNXQVKXXXXXX

SEQ ID NO: 32055 - protein, 58 aa, Diabrotica virgifera
  misc_feature: Coding regions on vcDNA: vcDNA=SeqID_11752; Strand=-; Position=6-182
IPSRRRVVLTCSYYHCGLTKSFSTDELLESSFLACGTTAPHRSTATNISEFMWVRLYQ

SEQ ID NO: 32056 - protein, 57 aa, Diabrotica virgifera
  misc_feature: Coding regions on vcDNA: vcDNA=SeqID_11753; Strand=+; Position=3-176
  misc_feature (5)..(12): Xaa can be any naturally occurring amino acid
  misc_feature (15)..(25): Xaa can be any naturally occurring amino acid
  misc_feature (27)..(34): Xaa can be any naturally occurring amino acid
FKASXXXXXXXXILXXXXXXXXXXXVXXXXXXXXIETNLSSHRFKLRSCKILKVEQT

SEQ ID NO: 32057 - protein, 271 aa, Diabrotica virgifera
  misc_feature: Coding regions on vcDNA: vcDNA=SeqID_11754; Strand=+; Position=3-818
  misc_feature: Homolog annotation: Hit_ID=XP_318058.1; Match level="QueryCoverage =88%, HitCoverage=56%, E-value=2e-57, Identity=46%"; Hit description =ENSANGP00000010737 [Anopheles gambiae]
  misc_feature: Gene Ontology Annotation: Cellular component=integral to plasma membrane
  misc_feature: Pfam annotation: Pfam_ID=ARM_1; Match level="Score=123.6, E-value =4.6e-34, Copies=1"; Pfam description=Adhesion regulating molecule conserve
KPVNEILSSGSAEGRTVNADKRKGLLYVYQSDDSLMHFCWQDRTTGIVEDDLIIFPDDCEYVKVPQCTTGRAYLLKFKSSNKKFFFWLQEPKTDKDEDNCKRINELLNNPSSAVQNTPNPDQDLQSLLNNMSQSQLMQLFGSGVGQIGGLSSLLGTIRGPNSGSARTSTTPAITHRTTVPTTPTPTPATNSQTSTTPAPGTTTPQNPIPTVTPDAPRVRGSTTRPQDESSPSSFPSSSPIQLADLQNFLSGLTPPPGSRSTCWRGSPGSIS

SEQ ID NO: 32058 - protein, 184 aa, Diabrotica virgifera
  misc_feature: Coding regions on vcDNA: vcDNA=SeqID_11755; Strand=+; Position=2-556
  misc_feature: Homolog annotation: Hit_ID=NP_477001.2; Match level="QueryCoverage =91%, HitCoverage=96%, E-value=5e-34, Identity=48%"; Hit description =CG5655-PA [Drosophila melanogaster] gb|AAF52890.1| CG5655-PA [Drosophila melanogaster]
  misc_feature: Gene Ontology Annotation: Molecular function=RNA binding; Cellular component=nuclear speck; Biological process=response to cold
  misc_feature: Pfam annotation: Pfam_ID=RRM_1; Match level="Score=57.9, E-value=2.8e- 14, Copies=1"; Pfam description=RNA recognition motif. (a.k.a. RRM, RB
  misc_feature (66)..(73): Xaa can be any naturally occurring amino acid
  misc_feature (123)..(132): Xaa can be any naturally occurring amino acid
HRFEFGNMGDRSRDRTTRVYVGGLTESIKKEDLEGEFEKYGKLNSVWVAFNPPGFAFIEFNNHTDXXXXXXXXNGTEFLGAKLRVEIARGRPRRGGPRGGFRGSRGSRGGRFDRFDGGRVDRXXXXXXXXXXGRFGGRSFDRRRDFPPRNGYGGSGPRGSRGGGRFNDRFRSRSPNMGAPRRRD

SEQ ID NO: 32059 - protein, 74 aa, Diabrotica virgifera
  misc_feature: Coding regions on vcDNA: vcDNA=SeqID_11756; Strand=-; Position=341-565
NFVTRPFPGAPLKSSDFFLIYTVLHVLNLTYLNLTISSFSKDRFLFGPPSTNSLVLRANMVEVHLQGTRFLPMW

SEQ ID NO: 32060 - protein, 145 aa, Diabrotica virgifera
  misc_feature: Coding regions on vcDNA: vcDNA=SeqID_11757; Strand=+; Position=245-682
  misc_feature: Homolog annotation: Hit_ID=EAL31002.1; Match level="QueryCoverage =80%, HitCoverage=92%, E-value=1e-34, Identity=62%"; Hit description =GA19929-PA [Drosophila pseudoobscura]
  misc_feature (21)..(29): Xaa can be any naturally occurring amino acid
MTAPMERIQVLDSIEKDIITXXXXXXXXXVELGKEKSSLKQAENHTQMFLKTLSAVENKLTDQINYLTQVSTGQPHEGSGYASQKVLQMAWHRLEHARSRVNELERYKIKHMQGRTAQRSITAPANVTSSASGISGQNIPPGSAT

SEQ ID NO: 32061 - protein, 151 aa, Diabrotica virgifera
  misc_feature: Coding regions on vcDNA: vcDNA=SeqID_11758; Strand=+; Position=2-457
  misc_feature: Homolog annotation: Hit_ID=AAF87760.1; Match level="QueryCoverage =100%, HitCoverage=34%, E-value=2e-49, Identity=68%"; Hit description= cytochrome oxidase subunit I [Diabrotica virgifera zeae]
  misc_feature (13)..(19): Xaa can be any naturally occurring amino acid
  misc_feature (33)..(33): Xaa can be any naturally occurring amino acid
  misc_feature (41)..(57): Xaa can be any naturally occurring amino acid
  misc_feature (87)..(87): Xaa can be any naturally occurring amino acid
  misc_feature (103)..(110): Xaa can be any naturally occurring amino acid
  misc_feature (131)..(131): Xaa can be any naturally occurring amino acid
DIVLHDTYHVVAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFSFQRKRLRPLRITSSIEXLQFNPPAEHRYSELPILSSN

SEQ ID NO: 32062 - protein, 42 aa, Diabrotica virgifera
  misc_feature: Coding regions on vcDNA: vcDNA=SeqID_11759; Strand=-; Position=1-126
  misc_feature (4)..(42): Xaa can be any naturally occurring amino acid
KKLXXXXXXXXXXXXXXXXXXXXXXXXXXXXXXXXXXXXXXX

SEQ ID NO: 32063 - protein, 255 aa, Diabrotica virgifera
  misc_feature: Coding regions on vcDNA: vcDNA=SeqID_11760; Strand=+; Position=58-822
  misc_feature: Homolog annotation: Hit_ID=NP_649690.1; Match level="QueryCoverage =99%, HitCoverage=32%, E-value=6e-78, Identity=53%"; Hit description =CG1104-PA, isoform A [Drosophila melanogaster] gb|AAF54073.1| CG1104- PA, isoform A [Drosophila
  misc_feature: Gene Ontology Annotation: Biological process=positive regulation of growth rate
MADWEEVKRLAADFQKVQLSSTTQKLSERNCIQIISWLIDQKMLDLIFTSDGKEYLTPAQLVLDIKGELYDHSGRINLVELAKIIGVDLAHINAHLNDVLKSNKDIQSVLGQLIDSSYIQRIAGEINEKLVQQGQISISDLTIQYDLPADFLQNQVVEKNLGKIIFGKQDKNDPKVFFTESFIARTKAKIKGALTGLTRPTPISSILNQIDISDKLFFSLFDQTVSYGSLTGRMAGAQYIPNVYARSQNEWVSHF

SEQ ID NO: 32064 - protein, 43 aa, Diabrotica virgifera
  misc_feature: Coding regions on vcDNA: vcDNA=SeqID_11761; Strand=+; Position=249-380
TKNTHYNQISGKFWSTRFCLSICILYKRGHVKILYFKVSLGIF

SEQ ID NO: 32065 - protein, 363 aa, Diabrotica virgifera
  misc_feature: Coding regions on vcDNA: vcDNA=SeqID_11762; Strand=-; Position=2-1090
  misc_feature (8)..(20): Xaa can be any naturally occurring amino acid
  misc_feature (23)..(33): Xaa can be any naturally occurring amino acid
  misc_feature (36)..(43): Xaa can be any naturally occurring amino acid
  misc_feature (47)..(363): Xaa can be any naturally occurring amino acid
LFNINTPXXXXXXXXXXXXXFKXXXXXXXXXXXPLXXXXXXXXKKMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32066 - protein, 75 aa, Diabrotica virgifera
  misc_feature: Coding regions on vcDNA: vcDNA=SeqID_11763; Strand=-; Position=198-425
SYIYFQKPFYHYERSYQAHILDLLPFSINNKRERYNEYIITNIIECYLLSKNVIQDIRSYIFIIDRVRRRYNCST

SEQ ID NO: 32067 - protein, 89 aa, Diabrotica virgifera
  misc_feature: Coding regions on vcDNA: vcDNA=SeqID_11764; Strand=-; Position=301-570
KNHITVFKVFAGLIILSYMYYIRIGYSLNQCVSNSYSKNMKNSFSPQRSKYNHRLCEKPGFQGLFWGFTGFTTLFYFLHHQTVCFQKFS

SEQ ID NO: 32068 - protein, 72 aa, Diabrotica virgifera
  misc_feature: Coding regions on vcDNA: vcDNA=SeqID_11765; Strand=-; Position=304-522
  misc_feature (13)..(22): Xaa can be any naturally occurring amino acid
NVYPGQKNVFPQXXXXXXXXXXSNNFEIMASRYREHNMRNNQHFLRTSTRKNIQDVPFEIRKFTRSSEKWRI

SEQ ID NO: 32069 - protein, 54 aa, Diabrotica virgifera
  misc_feature: Coding regions on vcDNA: vcDNA=SeqID_11766; Strand=-; Position=1-162
  misc_feature (7)..(54): Xaa can be any naturally occurring amino acid
KPIYFTXXXXXXXXXXXXXXXXXXXXXXXXXXXXXXXXXXXXXXXXXXXXXXXX

SEQ ID NO: 32070 - protein, 53 aa, Diabrotica virgifera
  misc_feature: Coding regions on vcDNA: vcDNA=SeqID_11767; Strand=-; Position=1-159
  misc_feature (1)..(19): Xaa can be any naturally occurring amino acid
  misc_feature (21)..(34): Xaa can be any naturally occurring amino acid
  misc_feature (41)..(51): Xaa can be any naturally occurring amino acid
XXXXXXXXXXXXXXXXXXXIXXXXXXXXXXXXXXTSKYAAXXXXXXXXXXXYL

SEQ ID NO: 32071 - protein, 55 aa, Diabrotica virgifera
  misc_feature: Coding regions on vcDNA: vcDNA=SeqID_11768; Strand=+; Position=278-445
RYTDHLPTAPCYTVLPTMPSLFLLCLCPINPDNRFFVHFLLFYLSSQYNGHIDGA

SEQ ID NO: 32072 - protein, 192 aa, Diabrotica virgifera
  misc_feature: Coding regions on vcDNA: vcDNA=SeqID_11769; Strand=+; Position=230-808
  misc_feature (68)..(115): Xaa can be any naturally occurring amino acid
  misc_feature (187)..(188): Xaa can be any naturally occurring amino acid
GMAVALQVTLPDLNGAIEAGLAVGADPSLEDSVKLPVVTGGDLATASRFAASWAFSTFQQRSAEVLKXXXXXXXXXXXXXXXXXXXXXXXXXXXXXXXXXXXXXXXXXXXXXXXXLTREAMQHAITVIIATKANWWGMNHHTGQGTCQGYTRKVLHTIYGAEPTAEMTTAAHTIGHWCSTLHVLSLXXIAGG

SEQ ID NO: 32073 - protein, 49 aa, Diabrotica virgifera
  misc_feature: Coding regions on vcDNA: vcDNA=SeqID_11770; Strand=+; Position=1-150
  misc_feature (3)..(48): Xaa can be any naturally occurring amino acid
MAXXXXXXXXXXXXXXXXXXXXXXXXXXXXXXXXXXXXXXXXXXXXXXF

SEQ ID NO: 32074 - protein, 18 aa, Diabrotica virgifera
  misc_feature: Coding regions on vcDNA: vcDNA=SeqID_11771; Strand=-; Position=0-53
  misc_feature (1)..(16): Xaa can be any naturally occurring amino acid
XXXXXXXXXXXXXXXXAA

SEQ ID NO: 32075 - protein, 52 aa, Diabrotica virgifera
  misc_feature: Coding regions on vcDNA: vcDNA=SeqID_11772; Strand=+; Position=51-209
HVVSHCVRICHYHTGHSLCRTFCSEVYQCVIINVLLSNHQELTNYLLSLDSK

SEQ ID NO: 32076 - protein, 97 aa, Diabrotica virgifera
  misc_feature: Coding regions on vcDNA: vcDNA=SeqID_11773; Strand=+; Position=1-291
  misc_feature: Homolog annotation: Hit_ID=AAL67861.1; Match level="QueryCoverage =100%, HitCoverage=29%, E-value=6e-11, Identity=38%"; Hit description= NADH dehydrogenase subunit 2 [Crioceris duodecimpunctata] ref|NP _569060.1| NADH dehydrogenase subunit 2
  misc_feature (8)..(17): Xaa can be any naturally occurring amino acid
  misc_feature (31)..(38): Xaa can be any naturally occurring amino acid
  misc_feature (70)..(70): Xaa can be any naturally occurring amino acid
  misc_feature (77)..(88): Xaa can be any naturally occurring amino acid
EVVEGLNXXXXXXXXXXQKIAPIIIIIYNYXXXXXXXXIVICSLIRGILGLNQIRLRKLIAYSSINHIAXILASILXXXXXXXXXXXXYSIILISII

SEQ ID NO: 32077 - protein, 56 aa, Diabrotica virgifera
  misc_feature: Coding regions on vcDNA: vcDNA=SeqID_11774; Strand=-; Position=1-168
  misc_feature (2)..(56): Xaa can be any naturally occurring amino acid
PXXXXXXXXXXXXXXXXXXXXXXXXXXXXXXXXXXXXXXXXXXXXXXXXXXXXXXX

SEQ ID NO: 32078 - protein, 121 aa, Diabrotica virgifera
  misc_feature: Coding regions on vcDNA: vcDNA=SeqID_11775; Strand=+; Position=248-610
  misc_feature (24)..(32): Xaa can be any naturally occurring amino acid
  misc_feature (48)..(54): Xaa can be any naturally occurring amino acid
PLKKMVILASGISAGVQRRGQKIXXXXXXXXXIRPKGLYILPYSFKKXXXXXXXPPPKKTLFFFLGERFQNFCSTYLMKPISGGKEKQKGPPWIYIGIILHPNPFQNPGVRSLSFPNHFST

SEQ ID NO: 32079 - protein, 139 aa, Diabrotica virgifera
  misc_feature: Coding regions on vcDNA: vcDNA=SeqID_11776; Strand=+; Position=339-755
  misc_feature: Homolog annotation: Hit_ID=XP_317515.1; Match level="QueryCoverage =94%, HitCoverage=22%, E-value=1e-39, Identity=60%"; Hit description =ENSANGP00000009976 [Anopheles gambiae]
  misc_feature: Gene Ontology Annotation: Molecular function=choline kinase activity
  misc_feature: Pfam annotation: Pfam_ID=Choline_kinase; Match level="Score=-1.8, E -value=1.5e-06, Copies=1"; Pfam description=Choline/ethanolamine kinase
SGGLSNHLFHVSLPDSLKTADANVEHEPKDVLIRVYGQTHGEGALEALITESVIFTLLSERNLGPKLHGIFPGGRIEQYIDARPLLTKELSDERLSVSIAKKMAAIHSMEVPLHKAPEWIWNTLDRWLNSLKNMQLTNM

SEQ ID NO: 32080 - protein, 280 aa, Diabrotica virgifera
  misc_feature: Coding regions on vcDNA: vcDNA=SeqID_11777; Strand=-; Position=0-839
  misc_feature (1)..(278): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEG

SEQ ID NO: 32081 - protein, 230 aa, Diabrotica virgifera
  misc_feature: Coding regions on vcDNA: vcDNA=SeqID_11778; Strand=+; Position=87-776
  misc_feature: Homolog annotation: Hit_ID=NP_650026.1; Match level="QueryCoverage =79%, HitCoverage=84%, E-value=9e-52, Identity=51%"; Hit description =CG4511-PA [Drosophila melanogaster] gb|AAF54565.1| CG4511-PA [Drosophila melanogaster]
  misc_feature: Gene Ontology Annotation: Molecular function=GTPase inhibitor activity; Cellular component=cytoplasm; Biological process=positive regulation of transcription from Pol II promoter by pheromones
  misc_feature: Pfam annotation: Pfam_ID=Thioredoxin; Match level="Score=-32.2, E -value=0.019, Copies=1"; Pfam description=Thioredoxin
  misc_feature (151)..(156): Xaa can be any naturally occurring amino acid
  misc_feature (189)..(197): Xaa can be any naturally occurring amino acid
  misc_feature (201)..(209): Xaa can be any naturally occurring amino acid
MDAVENNLLRVTQAIEKQVDAVIDQIDNLDTNDLEQLKINRIKELKKLEEQKKIWLSRDHGKYEELAEEKMFFDLIKKSENVIIHFYRDSTLRCKIVDKHLKILAPKHIETRFTKLDAEKCPFLVEKLKVKTLPTIVLIQNGVMVDKIVGXXXXXXTDEFTTDILEWRIAQNGIIKYEGDLSIPPDHTXXXXXXXXXIRSXXXXXXXXXDIEEYGIMRESAKSETRLKND

SEQ ID NO: 32082 - protein, 207 aa, Diabrotica virgifera
  misc_feature: Coding regions on vcDNA: vcDNA=SeqID_11779; Strand=+; Position=1-621
  misc_feature: Homolog annotation: Hit_ID=XP_312920.1; Match level="QueryCoverage =96%, HitCoverage=33%, E-value=1e-105, Identity=90%"; Hit description= ENSANGP00000024669 [Anopheles gambiae]
  misc_feature: Gene Ontology Annotation: Biological process=wing morphogenesis
  misc_feature: Pfam annotation: Pfam_ID=Zona_pellucida; Match level="Score=-11.7, E -value=6.4e-05, Copies=1"; Pfam description=Zona pellucida-like domain
  misc_feature (1)..(8): Xaa can be any naturally occurring amino acid
  misc_feature (193)..(199): Xaa can be any naturally occurring amino acid
XXXXXXXXGGGGGAGDDPWPLATPDMPQIKHLQVQCEKTHMRVNIEFDRPFYGMIFSKGFYSDSHCVHLKPGTGHLSATFEIFLNSCGMSSSANHNAASYGGPTPSGSYVENTIIIQYDPYVQEVWDQARKLRCTWYDFYEKAVTFKPFQADMLHAVTANFLGDNLQCWMQIQVGKGPWASEVSRIVKIGHTXXXXXXXKDDENIFN

SEQ ID NO: 32083 - protein, 23 aa, Diabrotica virgifera
  misc_feature: Coding regions on vcDNA: vcDNA=SeqID_11780; Strand=-; Position=1-72
  misc_feature (3)..(10): Xaa can be any naturally occurring amino acid
  misc_feature (12)..(22): Xaa can be any naturally occurring amino acid
KKXXXXXXXXTXXXXXXXXXXXI

SEQ ID NO: 32084 - protein, 204 aa, Diabrotica virgifera
  misc_feature: Coding regions on vcDNA: vcDNA=SeqID_11781; Strand=-; Position=1-612
  misc_feature (1)..(204): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32085 - protein, 214 aa, Diabrotica virgifera
  misc_feature: Coding regions on vcDNA: vcDNA=SeqID_11782; Strand=+; Position=21-665
  misc_feature: Homolog annotation: Hit_ID=XP_392348.1; Match level="QueryCoverage =73%, HitCoverage=32%, E-value=2e-42, Identity=55%"; Hit description =similar to CG8745-PA [Apis mellifera]
  misc_feature: Gene Ontology Annotation: Biological process=nitrogen metabolism
  misc_feature (51)..(57): Xaa can be any naturally occurring amino acid
  misc_feature (85)..(92): Xaa can be any naturally occurring amino acid
KTEQLGNLTPLTLPMGNGHPVACVVTTREISKSFTQTGVEYFNTYGGNPVXXXXXXXVFDTIEDENLRENAVVVGEYLLDNCQLXXXXXXXXGNVRGVGLFVGIDLVKDRTTREPNTECAKFVLQRMREEHILISLDGPHGNIIKFKPPMVFTKENVDEVVSTLDRVFKEWRHQEELYDVNTHKPSIHVGESTKTTKEHRPMGSLFKDSNIKSI

SEQ ID NO: 32086 - protein, 199 aa, Diabrotica virgifera
  misc_feature: Coding regions on vcDNA: vcDNA=SeqID_11783; Strand=+; Position=139-738
  misc_feature: Homolog annotation: Hit_ID=NP_572423.1; Match level="QueryCoverage =100%, HitCoverage=100%, E-value=3e-75, Identity=69%"; Hit description=CG1515-PA [Drosophila melanogaster] gb|AAF46294.1| CG1515-PA [Drosophila melanogaster]
  misc_feature: Gene Ontology Annotation: Molecular function=v-SNARE activity; Cellular component=vacuolar membrane; Biological process =intracellular protein transport
  misc_feature: Pfam annotation: Pfam_ID=Synaptobrevin; Match level="Score=42.4, E -value=1.3e-09, Copies=1"; Pfam description=Synaptobrevin
MVKIYCLSVLYKGPTTATWLKSAFELQSFSFFQRGSIQEFMSFFCKTIVERTIPASRQSVKEGEYLCHVYVRADNLAGVIITDHEYPSRVSHTLITKILDEFGAKIPAANWPSLEERDVPFPQLNTYLAKYQNPREADAITKIQEDLDETKIILHNTIQAVLERGEKLDDLVSKSEGLSIQSKAFYKTARKTNSCCSFT

SEQ ID NO: 32087 - protein, 51 aa, Diabrotica virgifera
  misc_feature: Coding regions on vcDNA: vcDNA=SeqID_11784; Strand=-; Position=1-153
  misc_feature (32)..(38): Xaa can be any naturally occurring amino acid
FYNNNFILASLALSDNRDVFTVHRPNPLGLTXXXXXXXNGALTIFYLSFEE

SEQ ID NO: 32088 - protein, 132 aa, Diabrotica virgifera
  misc_feature: Coding regions on vcDNA: vcDNA=SeqID_11785; Strand=-; Position=2-397
  misc_feature (3)..(35): Xaa can be any naturally occurring amino acid
  misc_feature (39)..(39): Xaa can be any naturally occurring amino acid
  misc_feature (45)..(56): Xaa can be any naturally occurring amino acid
  misc_feature (58)..(132): Xaa can be any naturally occurring amino acid
TPXXXXXXXXXXXXXXXXXXXXXXXXXXXXXXXXXAFTXKINSYXXXXXXXXXXXXHXXXXXXXXXXXXXXXXXXXXXXXXXXXXXXXXXXXXXXXXXXXXXXXXXXXXXXXXXXXXXXXXXXXXXXXXXXX

SEQ ID NO: 32089 - protein, 221 aa, Diabrotica virgifera
  misc_feature: Coding regions on vcDNA: vcDNA=SeqID_11786; Strand=+; Position=125-790
  misc_feature: Homolog annotation: Hit_ID=XP_318422.1; Match level="QueryCoverage =96%, HitCoverage=24%, E-value=2e-18, Identity=24%"; Hit description =ENSANGP00000014253 [Anopheles gambiae]
  misc_feature: Pfam annotation: Pfam_ID=Sec34; Match level="Score=-15.0, E-value =0.0022, Copies=1"; Pfam description=Sec34-like family
  misc_feature (148)..(157): Xaa can be any naturally occurring amino acid
MANLPEQLENLKELRIQENIVKWQAADDPLAPLSSEQLEVIYELGDLISNKSKKVPEVVKQDKNQPETIHTIKDFVKWSTSVENNIKHENLKKYQDYYEQLSAYKSNAEDLLNLSNNVLDYLNDLKSNYVSVTERTNYLHDLSEQLMXXXXXXXXXXQDLSNKLKYFVNFTKCQEEVERMRSKMNSEECIKILDEIDESITCLNNHLHYKESRIYKMKYES

SEQ ID NO: 32090 - protein, 169 aa, Diabrotica virgifera
  misc_feature: Coding regions on vcDNA: vcDNA=SeqID_11787; Strand=+; Position=145-651
  misc_feature: Homolog annotation: Hit_ID=XP_309396.1; Match level="QueryCoverage =94%, HitCoverage=37%, E-value=5e-27, Identity=41%"; Hit description =ENSANGP00000014970 [Anopheles gambiae]
  misc_feature (131)..(131): Xaa can be any naturally occurring amino acid
ITPRLNNIGYNGPLLTKPNFPLAIKSGPKSLKYTELVNFLTNEIKTLEDIDEEFNAITSPEDAVTFIMEVTSFLKELNCPYKSLLQGHVSETLQNVSDTLLLLDYLMTELMWARILQEKRPNKKIELKLHXTTEGKDMRLILQTLQFPKPPANISIRTLFQKLVPTIPI

SEQ ID NO: 32091 - protein, 80 aa, Diabrotica virgifera
  misc_feature: Coding regions on vcDNA: vcDNA=SeqID_11788; Strand=-; Position=225-467
KTLGQLNEPQNKREIKTVTEMVTIHCRLRNHLYKLCKVNEPWGRKCKMEEETVIHILCHCTVLGVWLGHKSTNRKTVGLR

SEQ ID NO: 32092 - protein, 109 aa, Diabrotica virgifera
  misc_feature: Coding regions on vcDNA: vcDNA=SeqID_11789; Strand=+; Position=54-383
TLQSFLQDTEQCSSVLDGVFSPKCYKITAKSKGGSEYIARGCMATGLGGGCSAMAKTLSWFSSAVSSDDPDSLQVLGCETCETDKCNSATKLTGFAFIGLVLSAMAFLM

SEQ ID NO: 32093 - protein, 22 aa, Diabrotica virgifera
  misc_feature: Coding regions on vcDNA: vcDNA=SeqID_11790; Strand=-; Position=0-65
  misc_feature (1)..(20): Xaa can be any naturally occurring amino acid
XXXXXXXXXXXXXXXXXXXXFT

SEQ ID NO: 32094 - protein, 307 aa, Diabrotica virgifera
  misc_feature: Coding regions on vcDNA: vcDNA=SeqID_11791; Strand=-; Position=2-922
  misc_feature (3)..(13): Xaa can be any naturally occurring amino acid
  misc_feature (23)..(30): Xaa can be any naturally occurring amino acid
  misc_feature (32)..(45): Xaa can be any naturally occurring amino acid
  misc_feature (48)..(48): Xaa can be any naturally occurring amino acid
  misc_feature (52)..(64): Xaa can be any naturally occurring amino acid
  misc_feature (67)..(297): Xaa can be any naturally occurring amino acid
  misc_feature (300)..(307): Xaa can be any naturally occurring amino acid
PFXXXXXXXXXXXTNLAHTGLNXXXXXXXXRXXXXXXXXXXXXXXIHXRGRXXXXXXXXXXXXXLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDEXXXXXXXX

SEQ ID NO: 32095 - protein, 71 aa, Diabrotica virgifera
  misc_feature: Coding regions on vcDNA: vcDNA=SeqID_11792; Strand=-; Position=169-384
IRFRYTCQSARPSKTTAPRISDNSIQTCSGNKEKCIKIILNKSRVSKIYEVENRIYIKIIENTRIKMSFLT

SEQ ID NO: 32096 - protein, 176 aa, Diabrotica virgifera
  misc_feature: Coding regions on vcDNA: vcDNA=SeqID_11793; Strand=+; Position=308-835
  misc_feature: Homolog annotation: Hit_ID=XP_393125.1; Match level="QueryCoverage =99%, HitCoverage=78%, E-value=3e-56, Identity=60%"; Hit description =similar to syntaxin-like protein [Apis mellifera]
  misc_feature: Gene Ontology Annotation: Cellular component=integral to plasma membrane; Biological process=nonselective vesicle transport
  misc_feature (147)..(147): Xaa can be any naturally occurring amino acid
GVYSEVFKALNKTRGLFLRWSELQEDGICCTKDEVEWTNTELKNSLRSIEWDLEDLEDTIDIVEKNPSKFKIDNKELTTRKHFIDSTKNEVKYMKESINMSRSRSKDRSARQPLLESSPVRIASARVTTKYSKLENDFDSPQRQFLXDTLSQQQYLTRQQDEHLEAISDSLRSLKT

SEQ ID NO: 32097 - protein, 26 aa, Diabrotica virgifera
  misc_feature: Coding regions on vcDNA: vcDNA=SeqID_11794; Strand=-; Position=1-78
  misc_feature (5)..(5): Xaa can be any naturally occurring amino acid
  misc_feature (9)..(15): Xaa can be any naturally occurring amino acid
  misc_feature (17)..(25): Xaa can be any naturally occurring amino acid
LKKIXAFYXXXXXXXNXXXXXXXXXP

SEQ ID NO: 32098 - protein, 50 aa, Diabrotica virgifera
  misc_feature: Coding regions on vcDNA: vcDNA=SeqID_11795; Strand=-; Position=92-244
EILLSRYLHLNHTKYMKAATLFVFKKIIFTKCTSIEVQPTHNIIFTIRKS

SEQ ID NO: 32099 - protein, 209 aa, Diabrotica virgifera
  misc_feature: Coding regions on vcDNA: vcDNA=SeqID_11796; Strand=+; Position=42-668
  misc_feature: Homolog annotation: Hit_ID=XP_414429.1; Match level="QueryCoverage =94%, HitCoverage=18%, E-value=5e-26, Identity=33%"; Hit description =PREDICTED: similar to hypothetical protein FLJ10539 [Gallus gallus]
  misc_feature: Gene Ontology Annotation: Biological process=cell organization and biogenesis
  misc_feature (36)..(42): Xaa can be any naturally occurring amino acid
  misc_feature (195)..(195): Xaa can be any naturally occurring amino acid
MITPRFQLTQDDKSLTIQIRAPYCSLRELQVEIEDXXXXXXXKPYFLRLFLPGKLLDNDNYKSSFECDSGEFSFTYDKAVQGEHFEDLDFITKFLVSKVETSYENNKKILVIDNEAKLDNDEELSQGFGFALMGHKNFVVVSSEFSDVFEIDPNEVNLKDRRKLRLQFEQGKFDMGHYLADFIENEEILSLIELXSPWNALEDSDITFD

SEQ ID NO: 32100 - protein, 238 aa, Diabrotica virgifera
  misc_feature: Coding regions on vcDNA: vcDNA=SeqID_11797; Strand=-; Position=2-715
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(238): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32101 - protein, 66 aa, Diabrotica virgifera
  misc_feature: Coding regions on vcDNA: vcDNA=SeqID_11798; Strand=-; Position=2-199
  misc_feature (2)..(11): Xaa can be any naturally occurring amino acid
  misc_feature (20)..(20): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
LXXXXXXXXXXIETNLAHTXLNXXXXXXXXSNXXXXXXXXXXXXXXPTSRSXXXXXXXXXXXXXXV

SEQ ID NO: 32102 - protein, 79 aa, Diabrotica virgifera
  misc_feature: Coding regions on vcDNA: vcDNA=SeqID_11799; Strand=+; Position=211-450
TGVVGQRTRFLSFGFLCAFSFECIFVKRVSLTLKSYIWMGGLARNNFYVDLFVPKVHGTHPSVTCAQGLIHTFLKGATL

SEQ ID NO: 32103 - protein, 275 aa, Diabrotica virgifera
  misc_feature: Coding regions on vcDNA: vcDNA=SeqID_11800; Strand=-; Position=0-824
  misc_feature (1)..(273): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKP

SEQ ID NO: 32104 - protein, 96 aa, Diabrotica virgifera
  misc_feature: Coding regions on vcDNA: vcDNA=SeqID_11801; Strand=-; Position=748 -1038
  misc_feature (17)..(34): Xaa can be any naturally occurring amino acid
  misc_feature (38)..(50): Xaa can be any naturally occurring amino acid
  misc_feature (53)..(67): Xaa can be any naturally occurring amino acid
  misc_feature (72)..(84): Xaa can be any naturally occurring amino acid
FESNYLKQEKTVFFMRXXXXXXXXXXXXXXXXXXGAKXXXXXXXXXXXXXNEXXXXXXXXXXXXXXXGFFSXXXXXXXXXXXXXRVHVFFAAKKAV

SEQ ID NO: 32105 - protein, 151 aa, Diabrotica virgifera
  misc_feature: Coding regions on vcDNA: vcDNA=SeqID_11802; Strand=+; Position=328-783
IKIIICPLCDQETNFESHEKLRKHLQDCHQVSIELITFEFSSKQEYETWKDMQKIETSYACSKTKRGKEHKIMYYDCNRSDLHGYKPNYKIRTEKAGGSIRIKGVCPSRLACKLRDQGQVSVSYWKTHVGHKEELRTMHLSKAEEKTVVEK

SEQ ID NO: 32106 - protein, 44 aa, Diabrotica virgifera
  misc_feature: Coding regions on vcDNA: vcDNA=SeqID_11803; Strand=-; Position=203-337
KQREESNFIIKTMYLNINKIHSIYFSSLVSTLMIKYLNLYYSTY

SEQ ID NO: 32107 - protein, 81 aa, Diabrotica virgifera
  misc_feature: Coding regions on vcDNA: vcDNA=SeqID_11804; Strand=+; Position=161-406
ILSHLVAFFCKSGNLKTIPGESYLASVGFRIAGLHPNAISLLGVLPQDTSISHSTLSLIFSLGYFCYLCLLLLSLSRKSIF

SEQ ID NO: 32108 - protein, 83 aa, Diabrotica virgifera
  misc_feature: Coding regions on vcDNA: vcDNA=SeqID_11805; Strand=-; Position=354-605
  misc_feature (37)..(47): Xaa can be any naturally occurring amino acid
LFLVLGPNNHNPIGPQSARVTAHLAYFAPLPKGNIDXXXXXXXXXXXGNIKCLTWNFHLSIKVGVDVVYVTVQVDYPVGVDFS

SEQ ID NO: 32109 - protein, 188 aa, Diabrotica virgifera
  misc_feature: Coding regions on vcDNA: vcDNA=SeqID_11806; Strand=+; Position=129-695
  misc_feature: Homolog annotation: Hit_ID=AAL29939.1; Match level="QueryCoverage =63%, HitCoverage=30%, E-value=9e-10, Identity=32%"; Hit description =scarf3a [Girardia tigrina]
  misc_feature: Pfam annotation: Pfam_ID=Lectin_C; Match level="Score=53.5, E-value =6.2e-13, Copies=1"; Pfam description=Lectin C-type domain
  misc_feature (139)..(139): Xaa can be any naturally occurring amino acid
MGTGLFCVVLLFVTGSGYCSREYGTDYVETTEPPVTQNYYFSKTGESFYEAVHTCLEKSMQLVSIDDAKKNRELANLMKDSGGVNRYWTSGNKIAKNTFFWSKGEPIEYANWHPDLPVSQASSNQKCIKIAKSEDKLYXELAFCNEKNLYICEKTLKVSQSDCDDVVENFWSKGIVSHIINITSLRRL

SEQ ID NO: 32110 - protein, 18 aa, Diabrotica virgifera
  misc_feature: Coding regions on vcDNA: vcDNA=SeqID_11807; Strand=+; Position=1-54
  misc_feature (2)..(12): Xaa can be any naturally occurring amino acid
AXXXXXXXXXXXEFIKLL

SEQ ID NO: 32111 - protein, 34 aa, Diabrotica virgifera
  misc_feature: Coding regions on vcDNA: vcDNA=SeqID_11808; Strand=-; Position=1-102
  misc_feature (6)..(14): Xaa can be any naturally occurring amino acid
  misc_feature (17)..(33): Xaa can be any naturally occurring amino acid
FINSIXXXXXXXXXLLXXXXXXXXXXXXXXXXXP

SEQ ID NO: 32112 - protein, 103 aa, Diabrotica virgifera
  misc_feature: Coding regions on vcDNA: vcDNA=SeqID_11809; Strand=+; Position=46-357
SVHISPHSSFTELLPRMECDDSIVLLTYSLVALPAASEREWLNVNTHSRCLSFDFRAKNPTIEGAPCNGSCMSSGSASDLFTHSSCPLSCSVLCPSGLSVNPA

SEQ ID NO: 32113 - protein, 191 aa, Diabrotica virgifera
  misc_feature: Coding regions on vcDNA: vcDNA=SeqID_11810; Strand=+; Position=77-652
  misc_feature: Homolog annotation: Hit_ID=XP_308610.1; Match level="QueryCoverage =92%, HitCoverage=91%, E-value=2e-32, Identity=45%"; Hit description =ENSANGP00000018811 [Anopheles gambiae] ref|XP_308609.1| ENSANGP00000018813 [Anopheles gambiae]
  misc_feature: Gene Ontology Annotation: Molecular function=chaperone activity; Cellular component=cytosol; Biological process=protein folding
  misc_feature: Pfam annotation: Pfam_ID=HSP20; Match level="Score=102.3, E-value =1.2e-27, Copies=1"; Pfam description=Hsp20/alpha crystallin family
  misc_feature (39)..(46): Xaa can be any naturally occurring amino acid
  misc_feature (170)..(176): Xaa can be any naturally occurring amino acid
KLFCKKQLSVKMSLLPYLFGDGPYNRPSRLFDQHFGMVXXXXXXXXPVSRNFLRCPAGYMRNWRSVASRNDDGSTVNFGKDQFSANLDVQQFKPEEITVKVTGDREVTIEGKHEEKEDEHGSVYRHFVRRYVLPKNYDMGKIESKLSSDGVLFIMAPQVEDESKEHKSIXXXXXXXPVKAVEGEKRAVPEK

SEQ ID NO: 32114 - protein, 66 aa, Diabrotica virgifera
  misc_feature: Coding regions on vcDNA: vcDNA=SeqID_11811; Strand=-; Position=2-199
  misc_feature (3)..(13): Xaa can be any naturally occurring amino acid
  misc_feature (22)..(30): Xaa can be any naturally occurring amino acid
  misc_feature (33)..(46): Xaa can be any naturally occurring amino acid
  misc_feature (52)..(65): Xaa can be any naturally occurring amino acid
SFXXXXXXXXXXXNQLGSHRLXXXXXXXXXSNXXXXXXXXXXXXXXPTSRSXXXXXXXXXXXXXXV

SEQ ID NO: 32115 - protein, 52 aa, Diabrotica virgifera
  misc_feature: Coding regions on vcDNA: vcDNA=SeqID_11812; Strand=-; Position=204-362
  misc_feature (22)..(32): Xaa can be any naturally occurring amino acid
RIEKYLHLYVVFSKKSNLFSKXXXXXXXXXXXHQKVSLIFYFTVIIIISRSF

SEQ ID NO: 32116 - protein, 106 aa, Diabrotica virgifera
  misc_feature: Coding regions on vcDNA: vcDNA=SeqID_11813; Strand=-; Position=1-318
  misc_feature (10)..(29): Xaa can be any naturally occurring amino acid
  misc_feature (31)..(52): Xaa can be any naturally occurring amino acid
  misc_feature (58)..(85): Xaa can be any naturally occurring amino acid
  misc_feature (90)..(96): Xaa can be any naturally occurring amino acid
FIIIIKIIGXXXXXXXXXXXXXXXXXXXXYXXXXXXXXXXXXXXXXXXXXXXLYRVLXXXXXXXXXXXXXXXXXXXXXXXXXXXXSFISXXXXXXXDYVTLARSKY

SEQ ID NO: 32117 - protein, 60 aa, Diabrotica virgifera
  misc_feature: Coding regions on vcDNA: vcDNA=SeqID_11814; Strand=-; Position=389-571
ILNGSYRICTCKSPFKHASSPITLSDETSISIRTHLEYGFSLLCMSDSIFLVTFLRRKML

SEQ ID NO: 32118 - protein, 100 aa, Diabrotica virgifera
  misc_feature: Coding regions on vcDNA: vcDNA=SeqID_11815; Strand=-; Position=1-300
  misc_feature (41)..(97): Xaa can be any naturally occurring amino acid
WIDFVAPEIFTLNFKVFLYLTWSIKFASIYEKSCKLSKQRXXXXXXXXXXXXXXXXXXXXXXXXXXXXXXXXXXXXXXXXXXXXXXXXXXXXXXXXXIYF

SEQ ID NO: 32119 - protein, 280 aa, Diabrotica virgifera
  misc_feature: Coding regions on vcDNA: vcDNA=SeqID_11816; Strand=+; Position=3-845
  misc_feature: Homolog annotation: Hit_ID=XP_311564.1; Match level="QueryCoverage =85%, HitCoverage=43%, E-value=4e-63, Identity=48%"; Hit description =ENSANGP00000016033 [Anopheles gambiae]
  misc_feature: Gene Ontology Annotation: Molecular function=molecular_function unknown; Cellular component=cellular_component unknown; Biological process=biological_process unknown
HASATHNFDNDTYKVNLKASSHISAGEHITTMYTHCLWGTQARREHLRETKYFDCQCKRCSDPTEMGSYLSALKCIGTNDEPCGGTQLPINPLDDKTEWTCDQCTVKISNEEVSFLVNGIGEEVDNVQLANPTVRELEALLNKMLTFLHPNHYHVYAVKHSLIQLYGYQQGYTPTQITDDCLVRKAAMCRELLDITRKIDPGNFRLALYHAVLLHELFLANWITIKRKWDLGIKAKVKSVLTTMNECKTCLDQLEVKNERTLQLEITNHSNILRRVNNLS

SEQ ID NO: 32120 - protein, 44 aa, Diabrotica virgifera
  misc_feature: Coding regions on vcDNA: vcDNA=SeqID_11817; Strand=+; Position=110-244
  misc_feature (21)..(28): Xaa can be any naturally occurring amino acid
ITCFQCIKYLMLKMRTCNDDXXXXXXXXELGTTWLQRIDMFNEI

SEQ ID NO: 32121 - protein, 61 aa, Diabrotica virgifera
  misc_feature: Coding regions on vcDNA: vcDNA=SeqID_11818; Strand=-; Position=2-184
  misc_feature (6)..(49): Xaa can be any naturally occurring amino acid
VIIQHXXXXXXXXXXXXXXXXXXXXXXXXXXXXXXXXXXXXXXXXXXXXQVKIMLPNSFIK

SEQ ID NO: 32122 - protein, 271 aa, Diabrotica virgifera
  misc_feature: Coding regions on vcDNA: vcDNA=SeqID_11819; Strand=-; Position=1-813
  misc_feature (1)..(271): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32123 - protein, 222 aa, Diabrotica virgifera
  misc_feature: Coding regions on vcDNA: vcDNA=SeqID_11820; Strand=-; Position=1-666
  misc_feature (1)..(6): Xaa can be any naturally occurring amino acid
  misc_feature (8)..(19): Xaa can be any naturally occurring amino acid
  misc_feature (29)..(36): Xaa can be any naturally occurring amino acid
  misc_feature (38)..(46): Xaa can be any naturally occurring amino acid
  misc_feature (57)..(70): Xaa can be any naturally occurring amino acid
  misc_feature (72)..(222): Xaa can be any naturally occurring amino acid
XXXXXXLXXXXXXXXXXXXPPWLTPVKTXXXXXXXXEXXXXXXXXXNYKLNPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32124 - protein, 135 aa, Diabrotica virgifera
  misc_feature: Coding regions on vcDNA: vcDNA=SeqID_11821; Strand=-; Position=1-405
  misc_feature (5)..(14): Xaa can be any naturally occurring amino acid
HLCQXXXXXXXXXXVSYVLRGSSWNLFSTLIFFSLTTSTDCFSSVDLVIFSSLRFELFTTLTISLVSTLQRLFEMTSFTISSGSSKYLFRFFVSSCILSESLSELDACIDFSLAGLFLLILRYSLKGLISSTTCF

SEQ ID NO: 32125 - protein, 264 aa, Diabrotica virgifera
  misc_feature: Coding regions on vcDNA: vcDNA=SeqID_11822; Strand=+; Position=84-873
  misc_feature: Homolog annotation: Hit_ID=XP_396048.1; Match level="QueryCoverage =100%, HitCoverage=16%, E-value=1e-112, Identity=77%"; Hit description=similar to ENSANGP00000003051 [Apis mellifera]
  misc_feature: Gene Ontology Annotation: Cellular component=nucleus; Biological process=DNA replication
  misc_feature (46)..(57): Xaa can be any naturally occurring amino acid
  misc_feature (73)..(73): Xaa can be any naturally occurring amino acid
  misc_feature (115)..(115): Xaa can be any naturally occurring amino acid
  misc_feature (227)..(227): Xaa can be any naturally occurring amino acid
  misc_feature (233)..(234): Xaa can be any naturally occurring amino acid
  misc_feature (238)..(238): Xaa can be any naturally occurring amino acid
  misc_feature (256)..(256): Xaa can be any naturally occurring amino acid
MTHHYVVTAHKPTAVTACVTGNFTSPSDLNLIVAKNTRLEIYLVTXXXXXXXXXXXXYGKVAVMKLFRPQNEXKDLLFIVTLRYNAMILECVTEGENIDIITKAHGNVADRIGKXSETGILAVIDPKARVIGLRLYEGLFKVIPLDKDNYELKATNFRMEELQVYDVEFLHGCVNPTLILIHQDGNGRHVKTREISLREKEFVKIPWRQDNVETEASIIIPVPSPPXGAIIIXXESIXYHDGILPVCVGPPGIKQXTIICYAKV

SEQ ID NO: 32126 - protein, 22 aa, Diabrotica virgifera
  misc_feature: Coding regions on vcDNA: vcDNA=SeqID_11823; Strand=-; Position=0-65
  misc_feature (1)..(21): Xaa can be any naturally occurring amino acid
XXXXXXXXXXXXXXXXXXXXXT

SEQ ID NO: 32127 - protein, 72 aa, Diabrotica virgifera; identical to SEQ ID NO: 30479
  misc_feature: Coding regions on vcDNA: vcDNA=SeqID_11824; Strand=-; Position=1-216
  misc_feature (1)..(72): Xaa can be any naturally occurring amino acid

SEQ ID NO: 32128 - protein, 257 aa, Diabrotica virgifera
  misc_feature: Coding regions on vcDNA: vcDNA=SeqID_11825; Strand=+; Position=83-853
  misc_feature: Homolog annotation: Hit_ID=NP_731602.1; Match level="QueryCoverage =95%, HitCoverage=76%, E-value=2e-11, Identity=24%"; Hit description =CG6808-PA [Drosophila melanogaster] gb|AAN13517.1| CG6808-PA [Drosophila melanogaster]
  misc_feature: Pfam annotation: Pfam_ID=zf-AD; Match level="Score=38.9, E-value=1.5e- 08, Copies=1"; Pfam description=Zinc-finger associated domain (zf-AD)
MAVEIQVNNHPILAIHRSICRICLNTTEPLNLWQDYENLKQLFEKITGIKIEGVKGVDRYICTKCVGQLQNIYQFIDKATYNDSLIKDTLHFCDITPFGNTQIEIHHDDRDRNDLHQSSQNNNLNGTESHIDLTEDSLEEIIQIKCENDDDINEVRSSEADDCFIEENFAINDTDSKLESADVKPYMYQFSKKTTDTNTDHTMTLRRKRTKSNKLRVPDYLRPFECPICSRRFTQKGNMHTHMRLHTGEMPFQCTFC

SEQ ID NO: 32129 - protein, 214 aa, Diabrotica virgifera
  misc_feature: Coding regions on vcDNA: vcDNA=SeqID_11826; Strand=+; Position=124-765
VDCAVSMSFYDNQATSYPGGTFTSAENFFTGSQSGHFSGTTPVDISHSTLEPTAREFFPTSSFSETNNGAVRRRPQQHNKFRDNKESGNWRNRYGSGRTFNSSRSNFSNKTGREDQYAHVPANYRSDNSYNTTDFQNDEERQPEPERNSQKYHEDHYDDHVEYNDFQSRDQGNNSVPQSSRYYRDTKRYDDYYRGRSRGNYNDNDCMNYDDKRS

SEQ ID NO: 32130 - protein, 259 aa, Diabrotica virgifera
  misc_feature: Coding regions on vcDNA: vcDNA=SeqID_11827; Strand=+; Position=38-816
  misc_feature: Homolog annotation: Hit_ID=AAH20029.1; Match level="QueryCoverage =94%, HitCoverage=73%, E-value=1e-32, Identity=32%"; Hit description =4930453N24Rik protein [Mus musculus]
  misc_feature (209)..(209): Xaa can be any naturally occurring amino acid
  misc_feature (233)..(233): Xaa can be any naturally occurring amino acid
MANNSETGIIDLLSKLDEDNLLSLGRTVTQGLLKINSKDDAIKAILKHSPDTLSILRRKSVTREVLFSYLDEKDIVMKAPITKNELIDRIMEFWNIKRADVITTVSCRNNEETISETKPLREDSNSISALAEQFAGWFYSLMNDEGVGPENFYPDAKMKINLHSNNDCDTIVVEDDPDGLAQQLLRIKLQHGIFFNPNVSKEGTQGRMXSHGLVVVLVCGTLHVQKTCVGVFXQVFSLARDPFCDNNWKIKNSEIELTK

SEQ ID NO: 32131 - protein, 210 aa, Diabrotica virgifera
  misc_feature: Coding regions on vcDNA: vcDNA=SeqID_11828; Strand=-; Position=1-630
  misc_feature (3)..(169): Xaa can be any naturally occurring amino acid
  misc_feature (173)..(210): Xaa can be any naturally occurring amino acid
HPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFHXXXXXXXXXXXXXXXXXXXXXXXXXXXXXXXXXXXXXX

SEQ ID NO: 32132 - protein, 45 aa, Diabrotica virgifera
  misc_feature: Coding regions on vcDNA: vcDNA=SeqID_11829; Strand=-; Position=3-137
  misc_feature (1)..(10): Xaa can be any naturally occurring amino acid
  misc_feature (13)..(43): Xaa can be any naturally occurring amino acid
XXXXXXXXXXVIXXXXXXXXXXXXXXXXXXXXXXXXXXXXXXXYK

SEQ ID NO: 32133 - protein, 57 aa, Diabrotica virgifera
  misc_feature: Coding regions on vcDNA: vcDNA=SeqID_11830; Strand=-; Position=0-170
  misc_feature (1)..(24): Xaa can be any naturally occurring amino acid
  misc_feature (26)..(56): Xaa can be any naturally occurring amino acid
XXXXXXXXXXXXXXXXXXXXXXXXPXXXXXXXXXXXXXXXXXXXXXXXXXXXXXXXR

SEQ ID NO: 32134 - protein, 67 aa, Diabrotica virgifera
  misc_feature: Coding regions on vcDNA: vcDNA=SeqID_11831; Strand=+; Position=3-206
  misc_feature (1)..(35): Xaa can be any naturally occurring amino acid
XXXXXXXXXXXXXXXXXXXXXXXXXXXXXXXXXXXHEMIFEYKYIYFFLKYKSYISKRDIRPSPTFL

SEQ ID NO: 32135 - protein, 280 aa, Diabrotica virgifera
  misc_feature: Coding regions on vcDNA: vcDNA=SeqID_11832; Strand=-; Position=1-840
  misc_feature (1)..(16): Xaa can be any naturally occurring amino acid
  misc_feature (19)..(54): Xaa can be any naturally occurring amino acid
  misc_feature (57)..(75): Xaa can be any naturally occurring amino acid
  misc_feature (80)..(86): Xaa can be any naturally occurring amino acid
  misc_feature (110)..(203): Xaa can be any naturally occurring amino acid
  misc_feature (206)..(280): Xaa can be any naturally occurring amino acid
XXXXXXXXXXXXXXXXPPXXXXXXXXXXXXXXXXXXXXXXXXXXXXXXXXXXXXFFXXXXXXXXXXXXXXXXXXXPSFHXXXXXXXIILPKHFQNNPPIQINHLSHYTLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLIXXXXXXXXXXXXXXXXXXXXXXXXXXXXXXXXXXXXXXXXXXXXXXXXXXXXXXXXXXXXXXXXXXXXXXXXXXX

SEQ ID NO: 32136 - protein, 34 aa, Diabrotica virgifera
  misc_feature: Coding regions on vcDNA: vcDNA=SeqID_11833; Strand=-; Position=0-101
  misc_feature (1)..(8): Xaa can be any naturally occurring amino acid
  misc_feature (10)..(11): Xaa can be any naturally occurring amino acid
  misc_feature (15)..(33): Xaa can be any naturally occurring amino acid
XXXXXXXXKXXKLFXXXXXXXXXXXXXXXXXXXP

SEQ ID NO: 32137 - protein, 203 aa, Diabrotica virgifera
  misc_feature: Coding regions on vcDNA: vcDNA=SeqID_11834; Strand=+; Position=8-619
  misc_feature: Homolog annotation: Hit_ID=XP_321277.1; Match level="QueryCoverage =74%, HitCoverage=21%, E-value=2e-25, Identity=36%"; Hit description =ENSANGP00000008439 [Anopheles gambiae]
  misc_feature (113)..(135): Xaa can be any naturally occurring amino acid
MTSGVKQTVIKNPTWWKRRTSMERCLTLSTGIALLIGISLLIALATVLYSRDQHVSNKPYTAQPLQGKIVTITSQDHEDEKVCLSPGCIHTASRVLEYMDESVDPCDDFYQFXXXXXXXXXXXXXXXXXXXXXXXIGDELQEQLRTMIEEPIQEDEPKPFKLDQASLGLRREFLIKGLDEKIVKVYYDYMVDLAVLFGDERER

SEQ ID NO: 32138 - protein, 84 aa, Diabrotica virgifera
  misc_feature: Coding regions on vcDNA: vcDNA=SeqID_11835; Strand=-; Position=5-259
  misc_feature (46)..(54): Xaa can be any naturally occurring amino acid
  misc_feature (77)..(77): Xaa can be any naturally occurring amino acid
  misc_feature (82)..(82): Xaa can be any naturally occurring amino acid
LAAPKEQDTYEILIHRCRHLSEYRKLLYKQLYTYHIYLTNTNTYRXXXXXXXXXRYLYIYASYSYVSFLRVKGIPPXPQNVXPP

SEQ ID NO: 32139 - protein, 68 aa, Diabrotica virgifera
  misc_feature: Coding regions on vcDNA: vcDNA=SeqID_11836; Strand=-; Position=172-378
  misc_feature (8)..(21): Xaa can be any naturally occurring amino acid
  misc_feature (58)..(64): Xaa can be any naturally occurring amino acid
NFTVELVXXXXXXXXXXXXXXGIYGSQINLMYIIINKMIWEVECQRQYIKIISKCDLXXXXXXXEDLL

SEQ ID NO: 32140 - protein, 270 aa, Diabrotica virgifera
  misc_feature: Coding regions on vcDNA: vcDNA=SeqID_11837; Strand=+; Position=82-892
  misc_feature: Homolog annotation: Hit_ID=NP_610996.1; Match level="QueryCoverage =100%, HitCoverage=80%, E-value=1e-108, Identity=65%"; Hit description=CG12797-PA [Drosophila melanogaster] gb|AAF58195.1| CG12797-PA [Drosophila melanogaster]
  misc_feature: Gene Ontology Annotation: Molecular function=molecular_function unknown; Cellular component=cellular_component unknown; Biological process=biological_process unknown
  misc_feature: Pfam annotation: Pfam_ID=WD40; Match level="Score=211.2, E-value=2.1e- 60, Copies=5"; Pfam description=WD domain, G-beta repeat
  misc_feature (240)..(240): Xaa can be any naturally occurring amino acid
  misc_feature (246)..(247): Xaa can be any naturally occurring amino acid
MGKLELVQTLKKDNGRVWNLDWHPKGDSLASCGEEKSIRIWTKDLTGKWSNRVVLTDGHKRTIRQVSWSPCGNYLASGSFDATTCIWDKKSGEFECNATLEGHENEVKSIAWSKSGHLLATCSRDKSVWVWEVADEDEYDCAAVLNAHSQDVKKVIFHPEKDLLASASYDDTIKLFRDDPNDGDWVCCGTLAGHESTVWSISFDKTGTRLASCSDDNTVKIWKEYPPGNPEGIATQDGDXHGKCVXXVSGHHERTIYDIHWCHLTGFIAT

SEQ ID NO: 32141 - protein, 54 aa, Diabrotica virgifera
  misc_feature: Coding regions on vcDNA: vcDNA=SeqID_11838; Strand=+; Position=177-338
  misc_feature: Homolog annotation: Hit_ID=AAV34814.1; Match level="QueryCoverage =100%, HitCoverage=18%, E-value=6e-11, Identity=57%"; Hit description= ribosomal protein L5 [Bombyx mori]
  misc_feature: Gene Ontology Annotation: Molecular function=5S RNA binding; Cellular component=ribosome; Biological process=protein biosynthesis
NSYNTPNSVVIIRISNKNIACQSAYSRIVSDYIVCAAYSHVMTIYVIKYGHTIY

SEQ ID NO: 32142 - protein, 45 aa, Diabrotica virgifera
  misc_feature: Coding regions on vcDNA: vcDNA=SeqID_11839; Strand=-; Position=59-196
  misc_feature (15)..(20): Xaa can be any naturally occurring amino acid
SVGLLEVNNNYLQIXXXXXXRARQLWLLAQGYYTSCNLVYNSINK

SEQ ID NO: 32143 - protein, 77 aa, Diabrotica virgifera
  misc_feature: Coding regions on vcDNA: vcDNA=SeqID_11840; Strand=-; Position=3-233
  misc_feature (1)..(10): Xaa can be any naturally occurring amino acid
  misc_feature (14)..(21): Xaa can be any naturally occurring amino acid
  misc_feature (40)..(40): Xaa can be any naturally occurring amino acid
  misc_feature (44)..(57): Xaa can be any naturally occurring amino acid
  misc_feature (64)..(76): Xaa can be any naturally occurring amino acid
XXXXXXXXXXGPFXXXXXXXXKIETNLGSHRFKLRSCKIXKVEXXXXXXXXXXXXXXSNIEVAXXXXXXXXXXXXXC

SEQ ID NO: 32144 - protein, 176 aa, Diabrotica virgifera
  misc_feature: Coding regions on vcDNA: vcDNA=SeqID_11841; Strand=+; Position=3-533
  misc_feature (120)..(126): Xaa can be any naturally occurring amino acid
CIMDLRAFLCLALVVCTNASSVYEYSHSHHPKVTKSVVVQTYVHRPRPIPLATRAFAGIASQVLANYAESKVPTVGIPVGAKKIYPVEYASHSPHVVPYVTKSKSYYHSELPVSAYSSPXXXXXXXGGSLGYDSHRGSLLSSHSYGGSLAHGGNHGSLLSSHSYGGSLEHGGHHYY

SEQ ID NO: 32145 - protein, 50 aa, Diabrotica virgifera
  misc_feature: Coding regions on vcDNA: vcDNA=SeqID_11842; Strand=+; Position=462-614
GILSLDHSPNSSYLTECDYLFVSEKYTIKFLRFQTIKNIKDSFTESCLVI

SEQ ID NO: 32146 - protein, 51 aa, Diabrotica virgifera
  misc_feature: Coding regions on vcDNA: vcDNA=SeqID_11843; Strand=-; Position=43-198
GSLIISTLSINITNPFQKKIDILKSEIHILLTLTIYNMNLLIKILLNRSSY

SEQ ID NO: 32147 - protein, 121 aa, Diabrotica virgifera
  misc_feature: Coding regions on vcDNA: vcDNA=SeqID_11844; Strand=+; Position=46-462
  misc_feature: Homolog annotation: Hit_ID=AAF87760.1; Match level="QueryCoverage =94%, HitCoverage=33%, E-value=5e-44, Identity=69%"; Hit description =cytochrome oxidase subunit I [Diabrotica virgifera zeae]
  misc_feature (38)..(38): Xaa can be any naturally occurring amino acid
  misc_feature (73)..(73): Xaa can be any naturally occurring amino acid
LLRASAEGFGLISHIVRFGTLGIIYAIIAIGLLGFIVXAHHIFTVGMDVDTRAYFTSATIIIAVPTGIKVFRXLATYHGTTITYRLTGVVLANSSIDIVLHDTYYVVAIGAVFAIIAGFIQ

SEQ ID NO: 32148 - protein, 119 aa, Diabrotica virgifera; identical to SEQ ID NO: 29283
  misc_feature: Coding regions on vcDNA: vcDNA=SeqID_11845; Strand=+; Position=229-588
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 32149 - protein, 41 aa, Diabrotica virgifera
  misc_feature: Coding regions on vcDNA: vcDNA=SeqID_11846; Strand=-; Position=1-123
SIFTSLTELDTLNNVLGCDLVLFNCSITNFSIANFLIVIFR

SEQ ID NO: 32150 - protein, 256 aa, Diabrotica virgifera
  misc_feature: Coding regions on vcDNA: vcDNA=SeqID_11847; Strand=+; Position=35-805
  misc_feature: Homolog annotation: Hit_ID=XP_487285.1; Match level="QueryCoverage =72%, HitCoverage=96%, E-value=7e-29, Identity=39%"; Hit description =similar to hypothetical protein FLJ14345 [Mus musculus]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=28.4, E-value =2.1e-05, Copies=1"; Pfam description=Zinc finger, C2H2 type
  misc_feature (135)..(141): Xaa can be any naturally occurring amino acid
  misc_feature (162)..(169): Xaa can be any naturally occurring amino acid
  misc_feature (190)..(198): Xaa can be any naturally occurring amino acid
  misc_feature (219)..(225): Xaa can be any naturally occurring amino acid
MEFKVEIKEELVEYNQKDLESQLSTSIDLENFKNELELEDNSEMGPKAEIKEEFAAECSQEYRENQLCTSQDLEDLVNKADEDNSGFPHNDLKRHLMRVHTDETPYKCEICFKQLTRRAGLKTHLRVHTGEKPYXXXXXXXQFSQAHSLKFHLRGHTGEKHXXXXXXXXQFSQAHSLKSHLRGHTDEKPXXXXXXXXXFSQVGHLKTHLRVHTGEKTYXXXXXXXQFTSANDLKKHLRVHTGGETLTVKFVLNSSV

SEQ ID NO: 32151 - protein, 19 aa, Diabrotica virgifera
  misc_feature: Coding regions on vcDNA: vcDNA=SeqID_11848; Strand=-; Position=1-57
  misc_feature (1)..(19): Xaa can be any naturally occurring amino acid
XXXXXXXXXXXXXXXXXXX

SEQ ID NO: 32152 - protein, 27 aa, Diabrotica virgifera
  misc_feature: Coding regions on vcDNA: vcDNA=SeqID_11849; Strand=+; Position=1-81
  misc_feature (1)..(5): Xaa can be any naturally occurring amino acid
  misc_feature (8)..(14): Xaa can be any naturally occurring amino acid
XXXXXHLXXXXXXXNDYITIGLIPVSM

SEQ ID NO: 32153 - protein, 107 aa, Diabrotica virgifera
  misc_feature: Coding regions on vcDNA: vcDNA=SeqID_11850; Strand=+; Position=2-325
  misc_feature (1)..(19): Xaa can be any naturally occurring amino acid
  misc_feature (23)..(36): Xaa can be any naturally occurring amino acid
  misc_feature (38)..(74): Xaa can be any naturally occurring amino acid
  misc_feature (80)..(86): Xaa can be any naturally occurring amino acid
  misc_feature (91)..(98): Xaa can be any naturally occurring amino acid
XXXXXXXXXXXXXXXXXXXVFLXXXXXXXXXXXXXXGXXXXXXXXXXXXXXXXXXXXXXXXXXXXXXXXXXXXXFREKKXXXXXXXKSSKXXXXXXXXGPPPKGVGI

SEQ ID NO: 32154 - protein, 22 aa, Diabrotica virgifera
  misc_feature: Coding regions on vcDNA: vcDNA=SeqID_11851; Strand=-; Position=1-66
  misc_feature (16)..(16): Xaa can be any naturally occurring amino acid
FIQHRGRNLYYRFDSXNKITLL

SEQ ID NO: 32155 - protein, 275 aa, Diabrotica virgifera
  misc_feature: Coding regions on vcDNA: vcDNA=SeqID_11852; Strand=-; Position=1-825
  misc_feature (3)..(29): Xaa can be any naturally occurring amino acid
  misc_feature (31)..(275): Xaa can be any naturally occurring amino acid
ITXXXXXXXXXXXXXXXXXXXXXXXXXXXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32156 - protein, 78 aa, Diabrotica virgifera
  misc_feature: Coding regions on vcDNA: vcDNA=SeqID_11853; Strand=-; Position=1-234
  misc_feature (30)..(41): Xaa can be any naturally occurring amino acid
FLGLMTHDGNIIVVWIRSLYLKAPGFYTNXXXXXXXXXXXXIQAQLQYIAICVSCSLSSYVLMSAHSHSLYSRLVRTL

SEQ ID NO: 32157 - protein, 83 aa, Diabrotica virgifera
  misc_feature: Coding regions on vcDNA: vcDNA=SeqID_11854; Strand=-; Position=34-285
  misc_feature (10)..(22): Xaa can be any naturally occurring amino acid
  misc_feature (36)..(45): Xaa can be any naturally occurring amino acid
  misc_feature (71)..(77): Xaa can be any naturally occurring amino acid
SYTYIYIKYXXXXXXXXXXXXXSITYLFKNNINHIXXXXXXXXXXSNLITNLINIYIINLYLHILNLQNIXXXXXXXNILSHS

SEQ ID NO: 32158 - protein, 129 aa, Diabrotica virgifera
  misc_feature: Coding regions on vcDNA: vcDNA=SeqID_11855; Strand=+; Position=1-387
  misc_feature (1)..(75): Xaa can be any naturally occurring amino acid
  misc_feature (77)..(100): Xaa can be any naturally occurring amino acid
  misc_feature (102)..(115): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXIXXXXXXXXXXXXXXHKGKKTGGEIFFLG

SEQ ID NO: 32159 - protein, 94 aa, Diabrotica virgifera
  misc_feature: Coding regions on vcDNA: vcDNA=SeqID_11856; Strand=-; Position=52-336
  misc_feature (90)..(90): Xaa can be any naturally occurring amino acid
LSYNSPLTINPIFSPYSTFPLPPPNPQYFTLLILIFTHLSFSKYNYKKPYIKHKSNKSILSPPPKLPNLTLNIQYLSIFHHINITNKIIXPFIL

SEQ ID NO: 32160 - protein, 152 aa, Diabrotica virgifera
  misc_feature: Coding regions on vcDNA: vcDNA=SeqID_11857; Strand=+; Position=183-641
  misc_feature: Homolog annotation: Hit_ID=NP_611982.2; Match level="QueryCoverage =84%, HitCoverage=80%, E-value=1e-21, Identity=38%"; Hit description =CG2811-PA [Drosophila melanogaster] gb|AAF47297.2| CG2811-PA [Drosophila melanogaster]
  misc_feature: Gene Ontology Annotation: Molecular function=molecular_function unknown; Cellular component=cellular_component unknown; Biological process=biological_process unknown
  misc_feature: Pfam annotation: Pfam_ID=UPF0131; Match level="Score=46.6, E-value=7e- 11, Copies=1"; Pfam description=Uncharacterised protein family (UPF01
  misc_feature (79)..(97): Xaa can be any naturally occurring amino acid
MNLHKVFVYGTLKKNEPNHSWFAKNAEGYYKYIGDAKTVEKLPLIIATKYNVPFILKSPGNGTNIIGEVYEVDDKVFAXXXXXXXXXXXXXXXXXXXTLVNGGSSVKVWIYVIPNFNPKLLNETCYESYSNSGSHGKRYDPRDASTLEELNA

SEQ ID NO: 32161 - protein, 195 aa, Diabrotica virgifera
  misc_feature: Coding regions on vcDNA: vcDNA=SeqID_11858; Strand=+; Position=257-841
  misc_feature (3)..(13): Xaa can be any naturally occurring amino acid
  misc_feature (16)..(32): Xaa can be any naturally occurring amino acid
  misc_feature (38)..(59): Xaa can be any naturally occurring amino acid
  misc_feature (72)..(163): Xaa can be any naturally occurring amino acid
  misc_feature (169)..(177): Xaa can be any naturally occurring amino acid
  misc_feature (179)..(195): Xaa can be any naturally occurring amino acid
IIXXXXXXXXXXXLIXXXXXXXXXXXXXXXXXLLGIEXXXXXXXXXXXXXXXXXXXXXXILKYGIHLSFIIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLGNEGXXXXXXXXXHXXXXXXXXXXXXXXXXX

SEQ ID NO: 32162 - protein, 28 aa, Diabrotica virgifera
  misc_feature: Coding regions on vcDNA: vcDNA=SeqID_11859; Strand=-; Position=1-84
  misc_feature (5)..(6): Xaa can be any naturally occurring amino acid
  misc_feature (9)..(9): Xaa can be any naturally occurring amino acid
  misc_feature (11)..(11): Xaa can be any naturally occurring amino acid
  misc_feature (14)..(27): Xaa can be any naturally occurring amino acid
SSLKXXKLXNXKIXXXXXXXXXXXXXXH

SEQ ID NO: 32163 - protein, 117 aa, Diabrotica virgifera
  misc_feature: Coding regions on vcDNA: vcDNA=SeqID_11860; Strand=-; Position=74-427
  misc_feature (102)..(113): Xaa can be any naturally occurring amino acid
IKPGFLSIQPVHANFQQKNYLIILRSRGENLGPIQTNQWPAETKYLKQKGYFFNQQVTKKMSNLFNKLIYFFYIYNFLMLIVSSLLNLNNPQEYFNQRFISXXXXXXXXXXXXYFSI

SEQ ID NO: 32164 - protein, 264 aa, Diabrotica virgifera
  misc_feature: Coding regions on vcDNA: vcDNA=SeqID_11861; Strand=+; Position=3-797
  misc_feature: Homolog annotation: Hit_ID=EAA11584.2; Match level="QueryCoverage =99%, HitCoverage=21%, E-value=6e-63, Identity=47%"; Hit description =ENSANGP00000020618 [Anopheles gambiae str. PEST] ref|XP_556923.1| ENSANGP00000020618 [Anopheles gambiae st
  misc_feature: Gene Ontology Annotation: Molecular function=electron carrier activity
  misc_feature: Pfam annotation: Pfam_ID=CO_deh_flav_C; Match level="Score=72.8, E -value=9.1e-19, Copies=1"; Pfam description=CO dehydrogenase flavoprotein C-termin
FLLLETFNASIRLVDVDGNESFCTPQEFLRVDMTRRVIKNIILSTLDSSYKYATYKMMPRAQNAHAMVNAGFLVKLKNNVVTYANIVYGGINPQFIHASKTEKFLIQQNLYKNDTLQKAFNTLKQELIPDWVLPDPTPEFRKNLAISLFYKFVLKTSPPNLVGARYKSGGTILTRALSTGVQQYGTDNKQWPLTQPIPKVESLAQTSGQIKYILDMPDIPHECHASFVTAKCVAGSKITNVDVSQALKIEGYVGYVDKKDIPWS

SEQ ID NO: 32165 - protein, 90 aa, Diabrotica virgifera
  misc_feature: Coding regions on vcDNA: vcDNA=SeqID_11862; Strand=-; Position=1-270
  misc_feature (1)..(31): Xaa can be any naturally occurring amino acid
  misc_feature (34)..(56): Xaa can be any naturally occurring amino acid
  misc_feature (61)..(90): Xaa can be any naturally occurring amino acid
XXXXXXXXXXXXXXXXXXXXXXXXXXXXXXXPPXXXXXXXXXXXXXXXXXXXXXXXLYRVXXXXXXXXXXXXXXXXXXXXXXXXXXXXXX

SEQ ID NO: 32166 - protein, 73 aa, Diabrotica virgifera
  misc_feature: Coding regions on vcDNA: vcDNA=SeqID_11863; Strand=+; Position=1-219
PSPAPGPFQRYRRYFQHRTPKIDKFWYFEVNTHEKNLFFSTISGSMRSGRCVDEGISLDERIYEKGGEHIYQS

SEQ ID NO: 32167 - protein, 259 aa, Diabrotica virgifera
  misc_feature: Coding regions on vcDNA: vcDNA=SeqID_11864; Strand=+; Position=3-782
  misc_feature: Homolog annotation: Hit_ID=EAA02972.3; Match level="QueryCoverage =82%, HitCoverage=91%, E-value=2e-87, Identity=64%"; Hit description =ENSANGP00000001797 [Anopheles gambiae str. PEST] gb|EAA01641.2| ENSANGP00000008574 [Anopheles gambiae str.
  misc_feature: Gene Ontology Annotation: Molecular function=calcium ion binding; Cellular component=smooth endoplasmic reticulum; Biological process =muscle contraction
  misc_feature (254)..(254): Xaa can be any naturally occurring amino acid
PQASDSHQDEYLHLSHPLALVALVGVTLTQSREISRDTREVSSDLEAAASGHGHHWKKGGGHEGHSDHHSSHGEKGDKGYKGHHHHEKGSKGHHDKEGHKKHYEEHGGHKKKHHHDDGYHAEHHKGEKGEKGHKYGEKGSYKKGHSTKGGHDVHKLDEYKKEKHFFDEDHDSGHHEKHGGHHHEDGYKKGGHKKGGHKKGGHHEDHYGKKGGHEKGSHYHESAGHKKAGGHDDHYHHDHKYGKKGGHEDHKKWXFKKGH

SEQ ID NO: 32168 - protein, 86 aa, Diabrotica virgifera
  misc_feature: Coding regions on vcDNA: vcDNA=SeqID_11865; Strand=-; Position=160-420
  misc_feature (8)..(8): Xaa can be any naturally occurring amino acid
  misc_feature (10)..(10): Xaa can be any naturally occurring amino acid
  misc_feature (23)..(30): Xaa can be any naturally occurring amino acid
  misc_feature (32)..(32): Xaa can be any naturally occurring amino acid
  misc_feature (46)..(54): Xaa can be any naturally occurring amino acid
  misc_feature (73)..(73): Xaa can be any naturally occurring amino acid
  misc_feature (85)..(85): Xaa can be any naturally occurring amino acid
TTLLPLIXIXILTKFKYFSINIXXXXXXXXNXSPTNLNISFSNLPXXXXXXXXXKFSTIYPYLFSTIKSNIQXLLQINLYFFQSXN

SEQ ID NO: 32169 - protein, 65 aa, Diabrotica virgifera
  misc_feature: Coding regions on vcDNA: vcDNA=SeqID_11866; Strand=-; Position=144-341
  misc_feature (9)..(16): Xaa can be any naturally occurring amino acid
  misc_feature (42)..(49): Xaa can be any naturally occurring amino acid
IKNFSLYHXXXXXXXXPPYNYINTYNHITHHHFQYLHLLSFXXXXXXXXSSNIIYSYTYTSKYLF

SEQ ID NO: 32170 - protein, 84 aa, Diabrotica virgifera
  misc_feature: Coding regions on vcDNA: vcDNA=SeqID_11867; Strand=-; Position=744-998
IRFLDRLYYYSDPRKINWIFWFPPFPKFTECGRALPNSRSKKIFFPQNQNPTPGFFFNSFKMTLFPDPSFKKEENYLNKEIFLI

SEQ ID NO: 32171 - protein, 83 aa, Diabrotica virgifera
  misc_feature: Coding regions on vcDNA: vcDNA=SeqID_11868; Strand=+; Position=3-254
  misc_feature (1)..(25): Xaa can be any naturally occurring amino acid
  misc_feature (41)..(52): Xaa can be any naturally occurring amino acid
  misc_feature (58)..(68): Xaa can be any naturally occurring amino acid
XXXXXXXXXXXXXXXXXXXXXXXXXRPLIYLNGRGIFERVXXXXXXXXXXXXGEWKGXXXXXXXXXXXLRIFLFSGKIFKFFI

SEQ ID NO: 32172 - protein, 155 aa, Diabrotica virgifera
  misc_feature: Coding regions on vcDNA: vcDNA=SeqID_11869; Strand=+; Position=1-469
  misc_feature: Homolog annotation: Hit_ID=XP_306952.1; Match level="QueryCoverage =98%, HitCoverage=51%, E-value=2e-21, Identity=38%"; Hit description =ENSANGP00000024153 [Anopheles gambiae]
  misc_feature (125)..(125): Xaa can be any naturally occurring amino acid
NKCSFNLSRPLYHIFNCSRQIPDYWKESFLKRIFKDGDKSLVDNYRPISIIGVIPKVFESLVCDFLTPLLEPKLINQQFGFITHRSTELNLLTYVDFLFDSLEKGFQVDTIYTDFSKAFDRMSHXYKLRMIGVDEPMISWFSSRVGRFKPTCLKP

SEQ ID NO: 32173 - protein, 33 aa, Diabrotica virgifera
  misc_feature: Coding regions on vcDNA: vcDNA=SeqID_11870; Strand=-; Position=1-99
  misc_feature (1)..(26): Xaa can be any naturally occurring amino acid
  misc_feature (29)..(33): Xaa can be any naturally occurring amino acid
XXXXXXXXXXXXXXXXXXXXXXXXXXSSXXXXX

SEQ ID NO: 32174 - protein, 317 aa, Diabrotica virgifera
  misc_feature: Coding regions on vcDNA: vcDNA=SeqID_11871; Strand=-; Position=0-950
  misc_feature (1)..(7): Xaa can be any naturally occurring amino acid
  misc_feature (9)..(27): Xaa can be any naturally occurring amino acid
  misc_feature (33)..(63): Xaa can be any naturally occurring amino acid
  misc_feature (71)..(85): Xaa can be any naturally occurring amino acid
  misc_feature (87)..(315): Xaa can be any naturally occurring amino acid
XXXXXXXIXXXXXXXXXXXXXXXXXXXYRGPSXXXXXXXXXXXXXXXXXXXXXXXXXXXXXXXNPFIAAFXXXXXXXXXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVG

SEQ ID NO: 32175 - protein, 141 aa, Diabrotica virgifera
  misc_feature: Coding regions on vcDNA: vcDNA=SeqID_11872; Strand=-; Position=196-621
  misc_feature (60)..(86): Xaa can be any naturally occurring amino acid
  misc_feature (88)..(110): Xaa can be any naturally occurring amino acid
  misc_feature (121)..(135): Xaa can be any naturally occurring amino acid
HVQNTRGHSINSVVRRDLILIQKTHNFNKHINKIITNSFIHPIYFSYIYNFSILILSSLXXXXXXXXXXXXXXXXXXXXXXXXXXXSXXXXXXXXXXXXXXXXXXXXXXXLISTLKTFYSXXXXXXXXXXXXXXXTFIFLI

SEQ ID NO: 32176 - protein, 119 aa, Diabrotica virgifera
  misc_feature: Coding regions on vcDNA: vcDNA=SeqID_11873; Strand=-; Position=2-358
  misc_feature (44)..(53): Xaa can be any naturally occurring amino acid
  misc_feature (56)..(66): Xaa can be any naturally occurring amino acid
  misc_feature (76)..(83): Xaa can be any naturally occurring amino acid
  misc_feature (86)..(99): Xaa can be any naturally occurring amino acid
  misc_feature (105)..(118): Xaa can be any naturally occurring amino acid
WCFQIVAICHKYAGFPLEYSKKSLMDLPPRALPEGSLFFLIFIXXXXXXXXXXPFXXXXXXXXXXXTNLAHTGLNXXXXXXXXSNXXXXXXXXXXXXXXPTSRSXXXXXXXXXXXXXXV

SEQ ID NO: 32177 - protein, 18 aa, Diabrotica virgifera
  misc_feature: Coding regions on vcDNA: vcDNA=SeqID_11874; Strand=-; Position=0-53
  misc_feature (1)..(17): Xaa can be any naturally occurring amino acid
XXXXXXXXXXXXXXXXXG

SEQ ID NO: 32178 - protein, 247 aa, Diabrotica virgifera
  misc_feature: Coding regions on vcDNA: vcDNA=SeqID_11875; Strand=-; Position=1-741
  misc_feature (2)..(2): Xaa can be any naturally occurring amino acid
  misc_feature (6)..(230): Xaa can be any naturally occurring amino acid
  misc_feature (233)..(247): Xaa can be any naturally occurring amino acid
NXSFLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 32179 - protein, 256 aa, Diabrotica virgifera
  misc_feature: Coding regions on vcDNA: vcDNA=SeqID_11876; Strand=+; Position=114-884
  misc_feature: Homolog annotation: Hit_ID=EAL39126.1; Match level="QueryCoverage =87%, HitCoverage=86%, E-value=4e-43, Identity=40%"; Hit description =ENSANGP00000025700 [Anopheles gambiae str. PEST] ref|XP_553409.1| ENSANGP00000025700 [Anopheles gambiae st
MEFKEKHIPTQPSTKVPDRPLTVSHSSEPQAEGEVDLDEDEISQQMTQSYSEISFKSGGQSPEDDIPMSSTLESLQIGEEVKRPMTLPYTNPKPLNLEGSVHIEGNMTHFVAEEIEQKIRLSSPVSKKDTPGVSTSRTCTPSPLYRQLLIPQVGQLDSALINDLEVEAHRMATSVDSLIENLCEILHSISSITADNVDVYKNAVSKMSDAMDGNIKSMYTMMAQAEEVTQSMKIVEGLSVRIKEIKRFSDLFESFV

SEQ ID NO: 32180 - protein, 67 aa, Diabrotica virgifera
  misc_feature: Coding regions on vcDNA: vcDNA=SeqID_11877; Strand=-; Position=278-481
  misc_feature (8)..(18): Xaa can be any naturally occurring amino acid
  misc_feature (50)..(56): Xaa can be any naturally occurring amino acid
IIISPRIXXXXXXXXXXXVWGMSMMIYRNIFEHIFTYVKFLVPVFSQAFXXXXXXXLSSHLQLPNLI

SEQ ID NO: 32181 - protein, 68 aa, Diabrotica virgifera
  misc_feature: Coding regions on vcDNA: vcDNA=SeqID_11878; Strand=+; Position=11-217
GPPHSDIGTLYSFFGIGAGVVGPSVTILVRAELREVFYLPMETTSLLMRLVQITRCIIIYCIRDTIDY

SEQ ID NO: 32182 - protein, 114 aa, Diabrotica virgifera
  misc_feature: Coding regions on vcDNA: vcDNA=SeqID_11879; Strand=+; Position=499-843
  misc_feature (92)..(92): Xaa can be any naturally occurring amino acid
LKLKMKFLNQMDKKKVNIQKLAQSEITHKKNISPKKMLFIPSSDEDSTQVLTENNTFQIKLEEDTNEVAFVSDIEQGEETEENAIEENIEYXTFSNVDAEILDSGAWITRLIQI

SEQ ID NO: 32183 - protein, 182 aa, Diabrotica virgifera
  misc_feature: Coding regions on vcDNA: vcDNA=SeqID_11880; Strand=+; Position=1-549
  misc_feature (6)..(51): Xaa can be any naturally occurring amino acid
  misc_feature (55)..(129): Xaa can be any naturally occurring amino acid
  misc_feature (137)..(143): Xaa can be any naturally occurring amino acid
PSRRPXXXXXXXXXXXXXXXXXXXXXXXXXXXXXXXXXXXXXXXXXXXXXXVVYXXXXXXXXXXXXXXXXXXXXXXXXXXXXXXXXXXXXXXXXXXXXXXXXXXXXXXXXXXXXXXXXXXXXXXXXXXXLSLKRIYXXXXXXXIIGKTRKFKICSYDIILSNSIADNMFYVSPSCKLPLPAA

SEQ ID NO: 32184 - protein, 185 aa, Diabrotica virgifera
  misc_feature: Coding regions on vcDNA: vcDNA=SeqID_11881; Strand=+; Position=650 -1204
  misc_feature (4)..(12): Xaa can be any naturally occurring amino acid
  misc_feature (20)..(20): Xaa can be any naturally occurring amino acid
  misc_feature (25)..(44): Xaa can be any naturally occurring amino acid
  misc_feature (49)..(75): Xaa can be any naturally occurring amino acid
  misc_feature (78)..(117): Xaa can be any naturally occurring amino acid
  misc_feature (125)..(132): Xaa can be any naturally occurring amino acid
  misc_feature (139)..(144): Xaa can be any naturally occurring amino acid
  misc_feature (154)..(163): Xaa can be any naturally occurring amino acid
  misc_feature (170)..(177): Xaa can be any naturally occurring amino acid
LGSXXXXXXXXXWNVGLDEXKVDFXXXXXXXXXXXXXXXXXXXXREEIXXXXXXXXXXXXXXXXXXXXXXXXXXXGGXXXXXXXXXXXXXXXXXXXXXXXXXXXXXXXXXXXXXXXXFQGVKQGXXXXXXXXRGLKNSXXXXXXGAGVFQVVLXXXXXXXXXXGGGTRGXXXXXXXXVCVCVVGG

SEQ ID NO: 32185 - protein, 66 aa, Diabrotica virgifera; identical to SEQ ID NO: 26808
  misc_feature: Coding regions on vcDNA: vcDNA=SeqID_11882; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 32186 - protein, 81 aa, Diabrotica virgifera
  misc_feature: Coding regions on vcDNA: vcDNA=SeqID_11883; Strand=-; Position=73-318
  misc_feature (9)..(17): Xaa can be any naturally occurring amino acid
  misc_feature (47)..(53): Xaa can be any naturally occurring amino acid
  misc_feature (73)..(79): Xaa can be any naturally occurring amino acid
NFIFNLIHXXXXXXXXXHTYLYIYSSSINFIYFLNTFIYFKTNITSXXXXXXXYFFLNTNFIFSSLQKFNIIXXXXXXXHP

SEQ ID NO: 32187 - protein, 64 aa, Diabrotica virgifera
  misc_feature: Coding regions on vcDNA: vcDNA=SeqID_11884; Strand=+; Position=3-197
  misc_feature (2)..(12): Xaa can be any naturally occurring amino acid
LXXXXXXXXXXXPFGLRYINKLQDRNLPDVTPVKIHMMANAKSPTDLIIELLLEVCTFNPKSKS

SEQ ID NO: 32188 - protein, 68 aa, Diabrotica virgifera
  misc_feature: Coding regions on vcDNA: vcDNA=SeqID_11885; Strand=-; Position=24-230
  misc_feature (5)..(15): Xaa can be any naturally occurring amino acid
  misc_feature (29)..(37): Xaa can be any naturally occurring amino acid
  misc_feature (40)..(47): Xaa can be any naturally occurring amino acid
  misc_feature (66)..(66): Xaa can be any naturally occurring amino acid
GSFSXXXXXXXXXXXNRNQTLASPRVKTXXXXXXXXXEQXXXXXXXXQLLTLIQHRGRNLYYRLTXSQ

SEQ ID NO: 32189 - protein, 216 aa, Diabrotica virgifera
  misc_feature: Coding regions on vcDNA: vcDNA=SeqID_11886; Strand=-; Position=1-648
  misc_feature (1)..(216): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32190 - protein, 58 aa, Diabrotica virgifera
  misc_feature: Coding regions on vcDNA: vcDNA=SeqID_11887; Strand=-; Position=114-290
  misc_feature (8)..(14): Xaa can be any naturally occurring amino acid
  misc_feature (28)..(42): Xaa can be any naturally occurring amino acid
LIKQLVIXXXXXXXMQFMTSVCIRDVSXXXXXXXXXXXXXXXPSTYIKIIDSHKCHFL

SEQ ID NO: 32191 - protein, 34 aa, Diabrotica virgifera
  misc_feature: Coding regions on vcDNA: vcDNA=SeqID_11888; Strand=+; Position=112-216
  misc_feature (9)..(9): Xaa can be any naturally occurring amino acid
  misc_feature (20)..(20): Xaa can be any naturally occurring amino acid
LLGLCLGIXIIIGIFLGIYXWVNVELVFNRVDNI

SEQ ID NO: 32192 - protein, 66 aa, Diabrotica virgifera; identical to SEQ ID NO: 26808
  misc_feature: Coding regions on vcDNA: vcDNA=SeqID_11889; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 32193 - protein, 336 aa, Diabrotica virgifera
  misc_feature: Coding regions on vcDNA: vcDNA=SeqID_11890; Strand=-; Position=0-1007
  misc_feature (11)..(39): Xaa can be any naturally occurring amino acid
  misc_feature (44)..(51): Xaa can be any naturally occurring amino acid
  misc_feature (55)..(332): Xaa can be any naturally occurring amino acid
PKKSGVQKVYXXXXXXXXXXXXXXXXXXXXXXXXXXXXXPKKPXXXXXXXXGLFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLRG

SEQ ID NO: 32194 - protein, 67 aa, Diabrotica virgifera
  misc_feature: Coding regions on vcDNA: vcDNA=SeqID_11891; Strand=-; Position=186-389
  misc_feature (15)..(28): Xaa can be any naturally occurring amino acid
  misc_feature (32)..(46): Xaa can be any naturally occurring amino acid
  misc_feature (51)..(59): Xaa can be any naturally occurring amino acid
KIYLSINNLYKIPIXXXXXXXXXXXXXXNYNXXXXXXXXXXXXXXXNLIHXXXXXXXXXHTYLYIYF

SEQ ID NO: 32195 - protein, 70 aa, Diabrotica virgifera
  misc_feature: Coding regions on vcDNA: vcDNA=SeqID_11892; Strand=-; Position=22-234
  misc_feature (56)..(64): Xaa can be any naturally occurring amino acid
SNSHISSNLSHPVYEELLLISVLSKFCSVFVRFCTLSASNNPVSGRKQYNFPLLRXXXXXXXXXIKFSMS

SEQ ID NO: 32196 - protein, 264 aa, Diabrotica virgifera
  misc_feature: Coding regions on vcDNA: vcDNA=SeqID_11893; Strand=+; Position=38-832
  misc_feature: Homolog annotation: Hit_ID=XP_314761.1; Match level="QueryCoverage =96%, HitCoverage=39%, E-value=5e-76, Identity=54%"; Hit description =ENSANGP00000014257 [Anopheles gambiae]
  misc_feature: Gene Ontology Annotation: Biological process=protein folding
  misc_feature: Pfam annotation: Pfam_ID=WD40; Match level="Score=35.2, E-value=2e -07, Copies=3"; Pfam description=WD domain, G-beta repeat
  misc_feature (74)..(81): Xaa can be any naturally occurring amino acid
RAPNSDEDVAIGPAIPEAEKPKKRKVSPHEQLYLDSLPSAESYERSYMHRDVITHIVVTCTDFIITASCDGHIXXXXXXXXGIEFVKHFRSHLGPIVKIACNCEGTLLCSASVDRSLKIFDVVNFDMINMIRLEFVPGTIEWIHGSGEPIHTLAVADKATARIHIYDGKDGKALTVFEKIHTSPVTLIKYNPKYDVVISADQKGMGEYWHGSKHDYGGPKNIRFDSKLDTDLVEFAKNKMVPNGLVFSHGGKKFGTISGGENDF

SEQ ID NO: 32197 - protein, 18 aa, Diabrotica virgifera
  misc_feature: Coding regions on vcDNA: vcDNA=SeqID_11894; Strand=-; Position=1-54
  misc_feature (1)..(15): Xaa can be any naturally occurring amino acid
XXXXXXXXXXXXXXXKNL

SEQ ID NO: 32198 - protein, 48 aa, Diabrotica virgifera
  misc_feature: Coding regions on vcDNA: vcDNA=SeqID_11895; Strand=-; Position=24-170
SIPKYLLILICIYLTRHFYLVSLGTHVQCNGIQTITHYVPRHYQSLFS

SEQ ID NO: 32199 - protein, 34 aa, Diabrotica virgifera
  misc_feature: Coding regions on vcDNA: vcDNA=SeqID_11896; Strand=-; Position=1-102
  misc_feature (1)..(33): Xaa can be any naturally occurring amino acid
XXXXXXXXXXXXXXXXXXXXXXXXXXXXXXXXXN

SEQ ID NO: 32200 - protein, 47 aa, Diabrotica virgifera
  misc_feature: Coding regions on vcDNA: vcDNA=SeqID_11897; Strand=-; Position=2-142
  misc_feature (5)..(5): Xaa can be any naturally occurring amino acid
  misc_feature (9)..(20): Xaa can be any naturally occurring amino acid
  misc_feature (24)..(47): Xaa can be any naturally occurring amino acid
KLLLXNKFXXXXXXXXXXXXTLIXXXXXXXXXXXXXXXXXXXXXXXX

SEQ ID NO: 32201 - protein, 127 aa, Diabrotica virgifera
  misc_feature: Coding regions on vcDNA: vcDNA=SeqID_11898; Strand=+; Position=3-386
  misc_feature (7)..(23): Xaa can be any naturally occurring amino acid
  misc_feature (28)..(47): Xaa can be any naturally occurring amino acid
  misc_feature (90)..(98): Xaa can be any naturally occurring amino acid
  misc_feature (104)..(116): Xaa can be any naturally occurring amino acid
  misc_feature (119)..(126): Xaa can be any naturally occurring amino acid
LYFISIXXXXXXXXXXXXXXXXXRYLIXXXXXXXXXXXXXXXXXXXXLRHYYLIILYFSFSNLKQLKPSDFHCKINMSSHFFVMTCYPPXXXXXXXXXNLTLFXXXXXXXXXXXXXNIXXXXXXXXS

SEQ ID NO: 32202 - protein, 136 aa, Diabrotica virgifera
  misc_feature: Coding regions on vcDNA: vcDNA=SeqID_11899; Strand=-; Position=1-408
  misc_feature (13)..(18): Xaa can be any naturally occurring amino acid
  misc_feature (45)..(62): Xaa can be any naturally occurring amino acid
  misc_feature (72)..(106): Xaa can be any naturally occurring amino acid
  misc_feature (110)..(136): Xaa can be any naturally occurring amino acid
LITFYKTWTCLSXXXXXXLYVNKILVLSSSLIIFNMNNIKRFNYXXXXXXXXXXXXXXXXXXERRISVHHQXXXXXXXXXXXXXXXXXXXXXXXXXXXXXXXXXXXGYKXXXXXXXXXXXXXXXXXXXXXXXXXXX

SEQ ID NO: 32203 - protein, 198 aa, Diabrotica virgifera
  misc_feature: Coding regions on vcDNA: vcDNA=SeqID_11900; Strand=+; Position=67-663
  misc_feature: Homolog annotation: Hit_ID=NP_524318.1; Match level="QueryCoverage =97%, HitCoverage=97%, E-value=6e-53, Identity=54%"; Hit description =CG5242-PA [Drosophila melanogaster] gb|AAF54629.1| CG5242-PA [Drosophila melanogaster]
  misc_feature: Gene Ontology Annotation: Molecular function=molecular_function unknown; Cellular component=mitochondrial ribosome; Biological process=biological_process unknown
MTMNAILSNFSRLSLKAPTLARTICTNKPLAFKFTPVLLAEPLKKKKRLDPAIVKAREERKKRKLEKQIRRLEKNARKLKPIEECEPPFEVLDTMQTRKRNLAALSTETLERRALLQKKWCHYKREEHLRDMQMLDRMVYSQQRALDELRKESEELYQEAIQFDFHLMPFTSQGPVETPPIENYNSPDGDLSDISKKW

SEQ ID NO: 32204 - protein, 66 aa, Diabrotica virgifera; identical to SEQ ID NO: 26808
  misc_feature: Coding regions on vcDNA: vcDNA=SeqID_11901; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 32205 - protein, 317 aa, Diabrotica virgifera
  misc_feature: Coding regions on vcDNA: vcDNA=SeqID_11902; Strand=-; Position=127 -1080
  misc_feature (1)..(27): Xaa can be any naturally occurring amino acid
  misc_feature (29)..(55): Xaa can be any naturally occurring amino acid
  misc_feature (62)..(89): Xaa can be any naturally occurring amino acid
  misc_feature (93)..(296): Xaa can be any naturally occurring amino acid
  misc_feature (299)..(310): Xaa can be any naturally occurring amino acid
XXXXXXXXXXXXXXXXXXXXXXXXXXXPXXXXXXXXXXXXXXXXXXXXXXXXXXXLIGSFSXXXXXXXXXXXXXXXXXXXXXXXXXXXXTLHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXDSLTDTN

SEQ ID NO: 32206 - protein, 53 aa, Diabrotica virgifera
  misc_feature: Coding regions on vcDNA: vcDNA=SeqID_11903; Strand=-; Position=85-246
  misc_feature (6)..(19): Xaa can be any naturally occurring amino acid
  misc_feature (33)..(40): Xaa can be any naturally occurring amino acid
GPLLVXXXXXXXXXXXXXXPTWASPRGFKLQNXXXXXXXXNQTLKKKACSNQL

SEQ ID NO: 32207 - protein, 187 aa, Diabrotica virgifera
  misc_feature: Coding regions on vcDNA: vcDNA=SeqID_11904; Strand=-; Position=17-580
  misc_feature (22)..(187): Xaa can be any naturally occurring amino acid
LWSGREVILYRLHKASCFFIQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32208 - protein, 260 aa, Diabrotica virgifera
  misc_feature: Coding regions on vcDNA: vcDNA=SeqID_11905; Strand=-; Position=0-779
  misc_feature (1)..(258): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKG

SEQ ID NO: 32209 - protein, 159 aa, Diabrotica virgifera
  misc_feature: Coding regions on vcDNA: vcDNA=SeqID_11906; Strand=-; Position=68-548
  misc_feature: Homolog annotation: Hit_ID=NP_723091.1; Match level="QueryCoverage =99%, HitCoverage=37%, E-value=3e-39, Identity=56%"; Hit description =CG7269-PC, isoform C [Drosophila melanogaster] ref|NP_723090.1| CG7269-PB, isoform B [Drosophila
  misc_feature: Gene Ontology Annotation: Molecular function=ATP dependent RNA helicase activity; Cellular component=nucleus; Biological process =RNA localization
  misc_feature: Pfam annotation: Pfam_ID=Helicase_C; Match level="Score=12.3, E-value= 0.0022, Copies=1"; Pfam description=Helicase conserved C-terminal domain
  misc_feature (30)..(36): Xaa can be any naturally occurring amino acid
  misc_feature (59)..(59): Xaa can be any naturally occurring amino acid
VYFNVEDIFTEHVVQLHYVKVKESDMNHEXXXXXXXWEFYQLDCIVTSAQVCVIWDIFXSDISMPMIGRGRRTCQKYEGCWYEQFNIFQKRIVVARKFFGPGMCIDRVNIVFNYDMPEDSDTYLHRVARAGRFGTKGLAITFVSEEGDAKILNEVQERS

SEQ ID NO: 32210 - protein, 92 aa, Diabrotica virgifera
  misc_feature: Coding regions on vcDNA: vcDNA=SeqID_11907; Strand=-; Position=172-450
MPIIYTFHLTASASIDKYVLRKCTNNRDPFDSGHFYRQQLEDERVTNNCTSNPLRRHGKYTQVTIIRQVHESFESGLRVDNIVRNRLNRNNI

SEQ ID NO: 32211 - protein, 78 aa, Diabrotica virgifera
  misc_feature: Coding regions on vcDNA: vcDNA=SeqID_11908; Strand=+; Position=2-235
  misc_feature (1)..(41): Xaa can be any naturally occurring amino acid
  misc_feature (46)..(52): Xaa can be any naturally occurring amino acid
  misc_feature (59)..(59): Xaa can be any naturally occurring amino acid
  misc_feature (65)..(78): Xaa can be any naturally occurring amino acid
XXXXXXXXXXXXXXXXXXXXXXXXXXXXXXXXXXXXXXXXXGNEGXXXXXXXLFNSIRXLFLRYXXXXXXXXXXXXXX

SEQ ID NO: 32212 - protein, 203 aa, Diabrotica virgifera
  misc_feature: Coding regions on vcDNA: vcDNA=SeqID_11909; Strand=-; Position=1-609
  misc_feature (1)..(7): Xaa can be any naturally occurring amino acid
  misc_feature (18)..(25): Xaa can be any naturally occurring amino acid
  misc_feature (32)..(43): Xaa can be any naturally occurring amino acid
  misc_feature (46)..(185): Xaa can be any naturally occurring amino acid
  misc_feature (192)..(198): Xaa can be any naturally occurring amino acid
XXXXXXXSYFFIPPFTPXXXXXXXXYPTLPRXXXXXXXXXXXXRRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHPKKGGXXXXXXXQHQVK

SEQ ID NO: 32213 - protein, 73 aa, Diabrotica virgifera
  misc_feature: Coding regions on vcDNA: vcDNA=SeqID_11910; Strand=-; Position=2-220
  misc_feature (64)..(64): Xaa can be any naturally occurring amino acid
ITISFFLTYSKISKFSQILKTSTFPHTYFTYKYPLYPKNLTSINLPHPPKPPPPYPPPPISPPXPPPYPKPPP

SEQ ID NO: 32214 - protein, 86 aa, Diabrotica virgifera
  misc_feature: Coding regions on vcDNA: vcDNA=SeqID_11911; Strand=-; Position=3-257
  misc_feature (37)..(37): Xaa can be any naturally occurring amino acid
  misc_feature (41)..(41): Xaa can be any naturally occurring amino acid
PSTSLSFFSTSTPSPYALPYISPSAPPPFFPPCSSLXPLIXPSPSFLLFPSSFPFSPLYLFPLSFPFLFSEKPTLSPSLPPYPPPF

SEQ ID NO: 32215 - protein, 146 aa, Diabrotica virgifera
  misc_feature: Coding regions on vcDNA: vcDNA=SeqID_11912; Strand=+; Position=37-474
  misc_feature: Homolog annotation: Hit_ID=AAF87760.1; Match level="QueryCoverage =89%, HitCoverage=29%, E-value=3e-42, Identity=69%"; Hit description =cytochrome oxidase subunit I [Diabrotica virgifera zeae]
  misc_feature (10)..(16): Xaa can be any naturally occurring amino acid
  misc_feature (30)..(30): Xaa can be any naturally occurring amino acid
  misc_feature (38)..(54): Xaa can be any naturally occurring amino acid
  misc_feature (84)..(84): Xaa can be any naturally occurring amino acid
  misc_feature (100)..(107): Xaa can be any naturally occurring amino acid
  misc_feature (128)..(128): Xaa can be any naturally occurring amino acid
STISIEEFAXXXXXXXIGAVFAIIAGFIQXFPLFTGIXXXXXXXXXXXXXXXXXVNLTFFPQHFLGLIGIPRRYSDYPDVFILXNIVSSIGSLISLIGVXXXXXXXXEAFSFQRKRLRPLRITSSIEXLQFNPPAEHRYSELPILS

SEQ ID NO: 32216 - protein, 140 aa, Diabrotica virgifera
  misc_feature: Coding regions on vcDNA: vcDNA=SeqID_11913; Strand=+; Position=1-420
  misc_feature (75)..(94): Xaa can be any naturally occurring amino acid
  misc_feature (112)..(120): Xaa can be any naturally occurring amino acid
RLCVMDYYPSPYINNLQISKRYRIKILDCEINISINSRCNEHVIPNLNISNSIRNNLNFSITTILMIKYYSIIQXXXXXXXXXXXXXXXXXXXXIHIWIKDFHISYYVIIYXXXXXXXXXINFSLQYPFELFTFSNDDNI

SEQ ID NO: 32217 - protein, 105 aa, Diabrotica virgifera
  misc_feature: Coding regions on vcDNA: vcDNA=SeqID_11914; Strand=+; Position=3-320
  misc_feature (5)..(27): Xaa can be any naturally occurring amino acid
  misc_feature (35)..(42): Xaa can be any naturally occurring amino acid
  misc_feature (68)..(74): Xaa can be any naturally occurring amino acid
VKASXXXXXXXXXXXXXXXXXXXXXXXVFIPQISXXXXXXXXTQNIFKFLTQLKNNMALKKYYHKTSXXXXXXXTFQKNLITITKSHERIPYSIIKKTSNLGKKG

SEQ ID NO: 32218 - protein, 100 aa, Diabrotica virgifera
  misc_feature: Coding regions on vcDNA: vcDNA=SeqID_11915; Strand=-; Position=2-301
GLTSSYLIIILEILIGQYLIHPVCNFIRNNWSVGVGFSAKSNILSVLCFLPTAHGRIAICSLGEQLPPQPSTSTYHRYQLFLLPLLKGGICAVSSPDALK

SEQ ID NO: 32219 - protein, 249 aa, Diabrotica virgifera
  misc_feature: Coding regions on vcDNA: vcDNA=SeqID_11916; Strand=-; Position=2-748
  misc_feature (1)..(1): Xaa can be any naturally occurring amino acid
  misc_feature (6)..(190): Xaa can be any naturally occurring amino acid
  misc_feature (195)..(220): Xaa can be any naturally occurring amino acid
  misc_feature (222)..(232): Xaa can be any naturally occurring amino acid
  misc_feature (235)..(249): Xaa can be any naturally occurring amino acid
XIKAFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFRLXXXXXXXXXXXXXXXXXXXXXXXXXXMXXXXXXXXXXXEVXXXXXXXXXXXXXXX

SEQ ID NO: 32220 - protein, 72 aa, Diabrotica virgifera
  misc_feature: Coding regions on vcDNA: vcDNA=SeqID_11917; Strand=-; Position=259-477
VYQVPKREKQKSLLCSAKILCPINSSKCIQIFLKKSTAAKSILSGILHSKEIQHAGEFVHEKTSMLYGQLTK

SEQ ID NO: 32221 - protein, 111 aa, Diabrotica virgifera
  misc_feature: Coding regions on vcDNA: vcDNA=SeqID_11918; Strand=+; Position=4-339
  misc_feature (5)..(5): Xaa can be any naturally occurring amino acid
  misc_feature (8)..(9): Xaa can be any naturally occurring amino acid
  misc_feature (17)..(18): Xaa can be any naturally occurring amino acid
  misc_feature (21)..(21): Xaa can be any naturally occurring amino acid
  misc_feature (24)..(24): Xaa can be any naturally occurring amino acid
  misc_feature (26)..(26): Xaa can be any naturally occurring amino acid
  misc_feature (29)..(31): Xaa can be any naturally occurring amino acid
  misc_feature (34)..(34): Xaa can be any naturally occurring amino acid
SFKVXINXXLNILKPYXXELXRDXRXLLXXXRKXILQPINSGHYVHFGLRNCLQKLLSQYSGTESLDTVEILINIDGLPLSKSSSSQVYPILCSLYPKQGPHDIIATFTDS

SEQ ID NO: 32222 - protein, 56 aa, Diabrotica virgifera
  misc_feature: Coding regions on vcDNA: vcDNA=SeqID_11919; Strand=+; Position=119-289
  misc_feature (3)..(12): Xaa can be any naturally occurring amino acid
  misc_feature (43)..(43): Xaa can be any naturally occurring amino acid
  misc_feature (45)..(45): Xaa can be any naturally occurring amino acid
NNXXXXXXXXXXDIVVKLTFFHQEFLRRIGIPIAISDYPDVFXIXNIVSSIGLLIS

SEQ ID NO: 32223 - protein, 138 aa, Diabrotica virgifera
  misc_feature: Coding regions on vcDNA: vcDNA=SeqID_11920; Strand=+; Position=28-444
  misc_feature: Homolog annotation: Hit_ID=XP_318996.1; Match level="QueryCoverage =92%, HitCoverage=88%, E-value=4e-36, Identity=59%"; Hit description =ENSANGP00000014758 [Anopheles gambiae]
  misc_feature: Pfam annotation: Pfam_ID=Chitin_bind_4; Match level="Score=113.2, E -value=6.6e-31, Copies=1"; Pfam description=Insect cuticle protein
  misc_feature (20)..(26): Xaa can be any naturally occurring amino acid
MRVYIILFSVFCLSHCAPQXXXXXXXEQYQGQHIPIVRQEQEVNYDGTYEYNFETGNGIVQEEKGFLKNAGTKEEAQVAQGFSSYTSPEGVKIELRYIADENGFQPIGDHLPTPPPIPEAILRALSVLKQLGNLNNIR

SEQ ID NO: 32224 - protein, 125 aa, Diabrotica virgifera
  misc_feature: Coding regions on vcDNA: vcDNA=SeqID_11921; Strand=+; Position=2-379
  misc_feature (1)..(77): Xaa can be any naturally occurring amino acid
  misc_feature (80)..(109): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXFLXXXXXXXXXXXXXXXXXXXXXXXXXXXXXXILGKGITIKRCLQFNF

SEQ ID NO: 32225 - protein, 58 aa, Diabrotica virgifera
  misc_feature: Coding regions on vcDNA: vcDNA=SeqID_11922; Strand=+; Position=299-472
  misc_feature (19)..(19): Xaa can be any naturally occurring amino acid
  misc_feature (42)..(42): Xaa can be any naturally occurring amino acid
ILDIVTDRELNDKVVLELXLLTLDTELLISVFSIKEPIVYAXSRVYRMFYIGLSNDEE

SEQ ID NO: 32226 - protein, 149 aa, Diabrotica virgifera
  misc_feature: Coding regions on vcDNA: vcDNA=SeqID_11923; Strand=+; Position=177-621
  misc_feature: Homolog annotation: Hit_ID=XP_318614.1; Match level="QueryCoverage =91%, HitCoverage=14%, E-value=5e-41, Identity=63%"; Hit description =ENSANGP00000021005 [Anopheles gambiae]
  misc_feature: Gene Ontology Annotation: Cellular component=mitochondrion
  misc_feature: Pfam annotation: Pfam_ID=Formyl_trans_N; Match level="Score=-11.9, E -value=2.2e-06, Copies=1"; Pfam description=Formyl transferase
  misc_feature (73)..(73): Xaa can be any naturally occurring amino acid
  misc_feature (138)..(138): Xaa can be any naturally occurring amino acid
MPPNVTTVSTVSPLKVAIIGQSAFAVDVMHKLNQHGHIIVGVFTIVDKGKREDPLAKAAAENDIPVFKIKLWXRDGKPIPEVLEQYKSVNADLNVLPYCSQFIPMEVINYPRLKSICYHPSILSRQRGERSINWTLIXEGPKRKGFSSF

SEQ ID NO: 32227 - protein, 83 aa, Diabrotica virgifera
  misc_feature: Coding regions on vcDNA: vcDNA=SeqID_11924; Strand=+; Position=250-501
LFSYEILRTTIYSNMLIHNRTQCMQSLIVQDIRHYQNLRNDRNAEQVIRKLQNVPSGLIRTLAVTSCNKILLKSNARREAYYY

SEQ ID NO: 32228 - protein, 201 aa, Diabrotica virgifera
  misc_feature: Coding regions on vcDNA: vcDNA=SeqID_11925; Strand=+; Position=138-740
  misc_feature: Homolog annotation: Hit_ID=XP_320310.1; Match level="QueryCoverage =82%, HitCoverage=54%, E-value=3e-37, Identity=49%"; Hit description =ENSANGP00000016611 [Anopheles gambiae]
  misc_feature: Gene Ontology Annotation: Molecular function=molecular_function unknown; Cellular component=cytoplasm; Biological process=biological_ process unknown
  misc_feature: Pfam annotation: Pfam_ID=NIF3; Match level="Score=44.5, E-value=4.4e -13, Copies=1"; Pfam description=NIF3 (NGG1p interacting factor 3)
MLLSRLSSLNRYKNLNIKTYNNYQCYFVKYIQSKAMAVTINDAVRILKSIAPLNLAEGWDNVGLLVEPSENKTVRSLLLTIDLTEDVVEEAIENKCQLIVAYHPNIFKPLKSVNQEHWKQRIIIKCIKNDIAVFSPHTSWDSMRNGVNEWLSTAFEVEYSRPITVNANDSSGRTGIGRYITLQSAISLKTAIELVKDLIGL

SEQ ID NO: 32229 - protein, 53 aa, Diabrotica virgifera
  misc_feature: Coding regions on vcDNA: vcDNA=SeqID_11926; Strand=-; Position=2-160
HCQSTSISDSSESSSSSTSSSSSSLSSLTSSSSESDSSHSKLDVSSAIIADAW

SEQ ID NO: 32230 - protein, 55 aa, Diabrotica virgifera
  misc_feature: Coding regions on vcDNA: vcDNA=SeqID_11927; Strand=-; Position=59-226
KYFLNNIVIRETLKLFLIRVDIANKGQHLVAKMFYTNIRLSRKADGSPRTYKMAP

SEQ ID NO: 32231 - protein, 29 aa, Diabrotica virgifera
  misc_feature: Coding regions on vcDNA: vcDNA=SeqID_11928; Strand=-; Position=2-88
  misc_feature (8)..(9): Xaa can be any naturally occurring amino acid
  misc_feature (16)..(17): Xaa can be any naturally occurring amino acid
  misc_feature (26)..(26): Xaa can be any naturally occurring amino acid
NLYYRLTXXNKITLSXXGNYFLYQKXLDQ

SEQ ID NO: 32232 - protein, 180 aa, Diabrotica virgifera
  misc_feature: Coding regions on vcDNA: vcDNA=SeqID_11929; Strand=+; Position=27-764
  misc_feature: Homolog annotation: Hit_ID=AAF87759.1; Match level="QueryCoverage =100%, HitCoverage=59%, E-value=3e-69, Identity=61%"; Hit description= cytochrome oxidase subunit I [Diabrotica virgifera virgifera]
  misc_feature: Pfam annotation: Pfam_ID=COX1; Match level="Score=-91.6, E-value=4e -08, Copies=1"; Pfam description=Cytochrome C and Quinol oxidase polyp
  misc_feature (17)..(17): Xaa can be any naturally occurring amino acid
  misc_feature (44)..(44): Xaa can be any naturally occurring amino acid
  misc_feature (98)..(98): Xaa can be any naturally occurring amino acid
  misc_feature (133)..(133): Xaa can be any naturally occurring amino acid
NIAHGGPSVDLAIFRLXGAINFITTVINIRPIGITFDRIPLFVXAVVITAILLLLSLPVLAGAITILLTDRNLNTSFFDPAGIIYAIIAIGLLGFIVXAHHIFTVGMDVDTRAYFTSATIIIAVPTGIKVFRXLATYHGTTITYRLTGVVLANSSIDIVLHDTYYVVAIGAVFAIIAFIQ

SEQ ID NO: 32233 - protein, 115 aa, Diabrotica virgifera
  misc_feature: Coding regions on vcDNA: vcDNA=SeqID_11930; Strand=+; Position=449-793
  misc_feature: Homolog annotation: Hit_ID=XP_319017.1; Match level="QueryCoverage =77%, HitCoverage=60%, E-value=6e-29, Identity=65%"; Hit description =ENSANGP00000024019 [Anopheles gambiae]
  misc_feature: Gene Ontology Annotation: Molecular function=hydrogen:amino acid symporter activity; Cellular component=plasma membrane; Biological process=alanine transport
MDNDQMKLEPMGPKGRQNNQSAENGGDDFDPHMYRQNDRPTTNMETLIHLLKGAIGTGILAMPEGFKLAGMINGIVSTIVIGLLSTYCLRVLVQAQYELCKRKRVGLLTYPDSMR

SEQ ID NO: 32234 - protein, 73 aa, Diabrotica virgifera
  misc_feature: Coding regions on vcDNA: vcDNA=SeqID_11931; Strand=-; Position=278-499
SPITSIIILINFFHLQSPKSLNPHPKHIPQFISLLNNSSNISTKIYTQHKLSPLLPPSTLTFTSTSSTTPSTS

SEQ ID NO: 32235 - protein, 92 aa, Diabrotica virgifera
  misc_feature: Coding regions on vcDNA: vcDNA=SeqID_11932; Strand=-; Position=508-786
  misc_feature (16)..(16): Xaa can be any naturally occurring amino acid
YFLSLFSVGIFMQFTXFSGNKPQFYFKISLFDFSLRIYTSKIILKIQNIQHIFYSFQLQTHLQNYFQHRLSQKRIFKSVQSAQIQLGILRYL

SEQ ID NO: 32236 - protein, 187 aa, Diabrotica virgifera
  misc_feature: Coding regions on vcDNA: vcDNA=SeqID_11933; Strand=-; Position=346-909
  misc_feature (1)..(33): Xaa can be any naturally occurring amino acid
  misc_feature (36)..(170): Xaa can be any naturally occurring amino acid
  misc_feature (180)..(186): Xaa can be any naturally occurring amino acid
XXXXXXXXXXXXXXXXXXXXXXXXXXXXXXXXXPPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKVYFNNHFXXXXXXXI

SEQ ID NO: 32237 - protein, 83 aa, Diabrotica virgifera
  misc_feature: Coding regions on vcDNA: vcDNA=SeqID_11934; Strand=+; Position=154-405
YQCRTAYASISTLLLIMVLLVVIPDSLIAFSREILNRSHDRLSLCQSLVSVWKILDTPFSTQAAHQRNMKRETLNVKHETNKL

SEQ ID NO: 32238 - protein, 110 aa, Diabrotica virgifera
  misc_feature: Coding regions on vcDNA: vcDNA=SeqID_11935; Strand=-; Position=26-358
  misc_feature (3)..(11): Xaa can be any naturally occurring amino acid
  misc_feature (13)..(19): Xaa can be any naturally occurring amino acid
  misc_feature (36)..(46): Xaa can be any naturally occurring amino acid
  misc_feature (57)..(68): Xaa can be any naturally occurring amino acid
ISXXXXXXXXXFXXXXXXXLHKYLDIFNNSIFILQXXXXXXXXXXXKTIKILALINXXXXXXXXXXXXPQYTMYKYILFSEIHIQYSILIILYYHPQKYLELSKKKPRLL

SEQ ID NO: 32239 - protein, 167 aa, Diabrotica virgifera
  misc_feature: Coding regions on vcDNA: vcDNA=SeqID_11936; Strand=+; Position=53-553
  misc_feature: Homolog annotation: Hit_ID=NP_647852.1; Match level="QueryCoverage =84%, HitCoverage=34%, E-value=2e-21, Identity=35%"; Hit description =CG1135-PA [Drosophila melanogaster] gb|AAF47828.1| CG1135-PA [Drosophila melanogaster]
MNIIHDSDLLQSNEYTLSSHSHSHLGESADVTRRRSSNRSIKRKKFDDELVEYSLGMPGISNIKGGRARTQSAHLELGVASPSTPPVLPPQPSTSQVFIDHKRKQVSKNVLPSSKRGKKTGKLGGQYTAKDLGRWKPVDDLALIIGVQQTNDLRTDHLGTKYYCKCT

SEQ ID NO: 32240 - protein, 243 aa, Diabrotica virgifera
  misc_feature: Coding regions on vcDNA: vcDNA=SeqID_11937; Strand=+; Position=1-729
  misc_feature (1)..(15): Xaa can be any naturally occurring amino acid
  misc_feature (18)..(55): Xaa can be any naturally occurring amino acid
  misc_feature (58)..(225): Xaa can be any naturally occurring amino acid
  misc_feature (227)..(242): Xaa can be any naturally occurring amino acid
XXXXXXXXXXXXXXXYLXXXXXXXXXXXXXXXXXXXXXXXXXXXXXXXXXXXXXXRNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXXXXXXXXXXXXXXV

SEQ ID NO: 32241 - protein, 245 aa, Diabrotica virgifera
  misc_feature: Coding regions on vcDNA: vcDNA=SeqID_11938; Strand=-; Position=1-735
  misc_feature (21)..(29): Xaa can be any naturally occurring amino acid
  misc_feature (31)..(243): Xaa can be any naturally occurring amino acid
LMFPNRGQKNRGPFKLIRGQXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIG

SEQ ID NO: 32242 - protein, 85 aa, Diabrotica virgifera
  misc_feature: Coding regions on vcDNA: vcDNA=SeqID_11939; Strand=+; Position=515-769
  misc_feature (39)..(39): Xaa can be any naturally occurring amino acid
  misc_feature (81)..(81): Xaa can be any naturally occurring amino acid
FLAAILLRVLLYYTSISLCFSRVHVILIVHLYSGAPRIXLLGGGAPKFFCIVCERQVTFSLITMLLLFIYFFMGLGGGVLXPQNP

SEQ ID NO: 32243 - protein, 134 aa, Diabrotica virgifera
  misc_feature: Coding regions on vcDNA: vcDNA=SeqID_11940; Strand=-; Position=295-699
  misc_feature (2)..(10): Xaa can be any naturally occurring amino acid
  misc_feature (19)..(27): Xaa can be any naturally occurring amino acid
  misc_feature (35)..(58): Xaa can be any naturally occurring amino acid
  misc_feature (65)..(75): Xaa can be any naturally occurring amino acid
  misc_feature (78)..(99): Xaa can be any naturally occurring amino acid
  misc_feature (112)..(120): Xaa can be any naturally occurring amino acid
  misc_feature (122)..(128): Xaa can be any naturally occurring amino acid
LXXXXXXXXXKGSFCFIRXXXXXXXXXSNDYAALXXXXXXXXXXXXXXXXXXXXXXXXRVFNNQXXXXXXXXXXXPIXXXXXXXXXXXXXXXXXXXXXXKVYCSKTFITNKXXXXXXXXXPXXXXXXXIILVFI

SEQ ID NO: 32244 - protein, 74 aa, Diabrotica virgifera
  misc_feature: Coding regions on vcDNA: vcDNA=SeqID_11941; Strand=-; Position=59-283
  misc_feature (12)..(20): Xaa can be any naturally occurring amino acid
  misc_feature (38)..(45): Xaa can be any naturally occurring amino acid
IDAVSYYPERIXXXXXXXXXGIFYYTNTGLQVFIFQLXXXXXXXXPFETYKYMVMDLIPLIHGVHKHNCLFYKE

SEQ ID NO: 32245 - protein, 42 aa, Diabrotica virgifera
  misc_feature: Coding regions on vcDNA: vcDNA=SeqID_11942; Strand=+; Position=1-126
  misc_feature (3)..(3): Xaa can be any naturally occurring amino acid
  misc_feature (6)..(42): Xaa can be any naturally occurring amino acid
FYXLSXXXXXXXXXXXXXXXXXXXXXXXXXXXXXXXXXXXXX

SEQ ID NO: 32246 - protein, 57 aa, Diabrotica virgifera
  misc_feature: Coding regions on vcDNA: vcDNA=SeqID_11943; Strand=-; Position=0-170
  misc_feature (2)..(35): Xaa can be any naturally occurring amino acid
  misc_feature (39)..(56): Xaa can be any naturally occurring amino acid
NXXXXXXXXXXXXXXXXXXXXXXXXXXXXXXXXXXAFYXXXXXXXXXXXXXXXXXXP

SEQ ID NO: 32247 - protein, 104 aa, Diabrotica virgifera
  misc_feature: Coding regions on vcDNA: vcDNA=SeqID_11944; Strand=+; Position=434-748
  misc_feature (51)..(57): Xaa can be any naturally occurring amino acid
  misc_feature (94)..(94): Xaa can be any naturally occurring amino acid
TFQSLTLIVHICLIIQPFFLCLPLHLGHSGIQLVIPLNISEGGCLFIYLIXXXXXXXVSDFGFSYSSISAFVFTLLSPSLVTLWPSIILIIFLXNFRRLSSSFL

SEQ ID NO: 32248 - protein, 95 aa, Diabrotica virgifera
  misc_feature: Coding regions on vcDNA: vcDNA=SeqID_11945; Strand=-; Position=253-540
MINRSLKHFIYSGFWNILKISNFIDKMRIFHRSSLRQYVPYNLNQDSTKCLISKILFYNNTSRQNLTNIRTQRSEYTFQVLSVFCAQNPNFKLPN

SEQ ID NO: 32249 - protein, 93 aa, Diabrotica virgifera
  misc_feature: Coding regions on vcDNA: vcDNA=SeqID_11946; Strand=+; Position=229-510
  misc_feature (35)..(40): Xaa can be any naturally occurring amino acid
  misc_feature (73)..(79): Xaa can be any naturally occurring amino acid
MKCYSFLNISTFLKSHFNLSITNIFHDSIFFIIIXXXXXXGHDLSNNILFTFHFQIELKIKQFPIVQHAIIYXXXXXXXFPIHFLLKYKVRLL

SEQ ID NO: 32250 - protein, 196 aa, Diabrotica virgifera
  misc_feature: Coding regions on vcDNA: vcDNA=SeqID_11947; Strand=+; Position=192-779
  misc_feature (118)..(125): Xaa can be any naturally occurring amino acid
  misc_feature (167)..(167): Xaa can be any naturally occurring amino acid
SINTGAMGESFSRAVQPEELAVFKKLPTNTLLDNIEIPERPENRTPTDRKFIIVFAVAIIILFPFLIYTMVYSDFSRFKGYDQCGNVCGKQNKKYDQWSCTGADYTNFPYLQYETSDXXXXXXXXLLTSRKCVAQCESGHVKVGLYCYKDGSHSSFNSRYNSFNSRXQRDTYESVEEIEAGLSAFLTNMPGELYWP

SEQ ID NO: 32251 - protein, 49 aa, Diabrotica virgifera
  misc_feature: Coding regions on vcDNA: vcDNA=SeqID_11948; Strand=+; Position=3-152
  misc_feature (1)..(22): Xaa can be any naturally occurring amino acid
  misc_feature (24)..(31): Xaa can be any naturally occurring amino acid
XXXXXXXXXXXXXXXXXXXXXXRXXXXXXXXDRNQPWLTPDLNSDHVKF

SEQ ID NO: 32252 - protein, 92 aa, Diabrotica virgifera
  misc_feature: Coding regions on vcDNA: vcDNA=SeqID_11949; Strand=+; Position=259-537
  misc_feature: Homolog annotation: Hit_ID=XP_393415.1; Match level="QueryCoverage =78%, HitCoverage=10%, E-value=1e-10, Identity=51%"; Hit description =similar to ENSANGP00000012563 [Apis mellifera]
  misc_feature (32)..(32): Xaa can be any naturally occurring amino acid
IANFTTTKKLSSKVSTDVDKSNDKDDFEKTIXLTIHVKLLFLLLSVCTFENTYDDMNVIIMSFILPYFHRDSHINTRIKCSINIIIMIGMMA

SEQ ID NO: 32253 - protein, 58 aa, Diabrotica virgifera
  misc_feature: Coding regions on vcDNA: vcDNA=SeqID_11950; Strand=-; Position=0-173
SAATIYVACEEKKKHAIVLSLGTFGKRALRRNYGGSGALHILLKISRISRYLQPQTIS

SEQ ID NO: 32254 - protein, 260 aa, Diabrotica virgifera
  misc_feature: Coding regions on vcDNA: vcDNA=SeqID_11951; Strand=-; Position=0-779
  misc_feature (4)..(259): Xaa can be any naturally occurring amino acid
LKIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 32255 - protein, 114 aa, Diabrotica virgifera
  misc_feature: Coding regions on vcDNA: vcDNA=SeqID_11952; Strand=+; Position=302-643
  misc_feature: Homolog annotation: Hit_ID=XP_396019.1; Match level="QueryCoverage =95%, HitCoverage=11%, E-value=3e-27, Identity=51%"; Hit description =similar to SD10334p [Apis mellifera]
  misc_feature: Gene Ontology Annotation: Molecular function=protein binding; Cellular component=cellular_component unknown; Biological process =protein folding
  misc_feature: Pfam annotation: Pfam_ID=TPR_2; Match level="Score=71.3, E-value=2.7e- 18, Copies=3"; Pfam description=Tetratricopeptide repeat
MENEIQAEVFKEQGNTAFKNGDWDQAINLYSKAINLSKENTKIISVYYKNRAAAYLKQENYEAALQDCDKCLQIVPTDAKALFIRCQDLEALQRYEEAYKDATPIFKDDPTNKR

SEQ ID NO: 32256 - protein, 79 aa, Diabrotica virgifera
  misc_feature: Coding regions on vcDNA: vcDNA=SeqID_11953; Strand=-; Position=2-238
  misc_feature (1)..(11): Xaa can be any naturally occurring amino acid
  misc_feature (16)..(25): Xaa can be any naturally occurring amino acid
  misc_feature (35)..(43): Xaa can be any naturally occurring amino acid
  misc_feature (46)..(53): Xaa can be any naturally occurring amino acid
  misc_feature (61)..(61): Xaa can be any naturally occurring amino acid
  misc_feature (65)..(78): Xaa can be any naturally occurring amino acid
XXXXXXXXXXXVLFVXXXXXXXXXXTNLGSPRFKXXXXXXXXXRTXXXXXXXXPIINFNPXSRSXXXXXXXXXXXXXXV

SEQ ID NO: 32257 - protein, 242 aa, Diabrotica virgifera
  misc_feature: Coding regions on vcDNA: vcDNA=SeqID_11954; Strand=+; Position=155-880
  misc_feature: Homolog annotation: Hit_ID=CAA51933.1; Match level="QueryCoverage =54%, HitCoverage=95%, E-value=4e-20, Identity=34%"; Hit description =DNA binding protein [Onchocerca volvulus]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=44.5, E-value=3e- 10, Copies=2"; Pfam description=Zinc finger, C2H2 type
  misc_feature (212)..(212): Xaa can be any naturally occurring amino acid
MEVKQEYGEDARKAEIYSNNIDDDALLNTLKCEIKKEPSRESTDGTFDYLDLKEFPIKTEAKDESELWQFEEKQNNQKDSRIKAEIKDEFDEGDPGDIESQLSTSLDLEVCKNEYTSGISQMKLLEMEVMKRIPEDTVSSEETALKNSICAKDSPNKNNLNQHTKSWIGEPHECETCFKQFNETRKLKRHCLKVHIGERSHKCDICSKEFTXHSTLKMHMRVHTGEKPYKCEICSKQFSQEE

SEQ ID NO: 32258 - protein, 92 aa, Diabrotica virgifera
  misc_feature: Coding regions on vcDNA: vcDNA=SeqID_11955; Strand=-; Position=186-464
KRISASLYYSKASIWRLVGYSLGRNLSTSKYELVFFTEAFSLTAVSAITFLKYLNDLYVRQLHWSGFAPHHQPLKLGWNGINWNDLYAPRNI

SEQ ID NO: 32259 - protein, 48 aa, Diabrotica virgifera
  misc_feature: Coding regions on vcDNA: vcDNA=SeqID_11956; Strand=-; Position=159-305
  misc_feature (32)..(38): Xaa can be any naturally occurring amino acid
SLDSRSYKKSTDLLICDYITIQLCKLKVFLSXXXXXXXEENIMICLRE

SEQ ID NO: 32260 - protein, 47 aa, Diabrotica virgifera
  misc_feature: Coding regions on vcDNA: vcDNA=SeqID_11957; Strand=+; Position=205-348
  misc_feature (30)..(42): Xaa can be any naturally occurring amino acid
YSILSISNSLRSQIYFCINNPLIINYFYMXXXXXXXXXXXXXNLIKI

SEQ ID NO: 32261 - protein, 98 aa, Diabrotica virgifera
  misc_feature: Coding regions on vcDNA: vcDNA=SeqID_11958; Strand=+; Position=203-496
LGEYDTFSLSLWTHDRYLKPSTIIFVEFAPRSTEDASSYLDHSIHARGGMISNVLKYKTHFYTLLDISLNQAVSLDRLWRFSPLDTLLCITQEAYPYS

SEQ ID NO: 32262 - protein, 238 aa, Diabrotica virgifera
  misc_feature: Coding regions on vcDNA: vcDNA=SeqID_11959; Strand=+; Position=86-802
  misc_feature: Homolog annotation: Hit_ID=XP_393274.1; Match level="QueryCoverage =89%, HitCoverage=19%, E-value=5e-48, Identity=45%"; Hit description =similar to CG3568-PA [Apis mellifera]
  misc_feature (222)..(222): Xaa can be any naturally occurring amino acid
IIPESNETFALLIAKTTEDLSKVSLDNFITRSNNFSVKFPVDSGRCKSLKASVPPEILERNIYSVYCLLHENVLELYSKFILLKRKYGSKVEQNFYKDIGLYEFIDRLLKNRAVMFMGKLDKYVLLDGKKGQNDWVTIGSVNERPPLVLKNYISYDEIKLSALLSVSSYSYFVNQGDRKNMAKFSTDRTSIADEGIIVGVIGPRMKKNNVMEYQEIVATRTXNTKDNGYGTNVQNSVP

SEQ ID NO: 32263 - protein, 189 aa, Diabrotica virgifera
  misc_feature: Coding regions on vcDNA: vcDNA=SeqID_11960; Strand=+; Position=75-644
  misc_feature: Homolog annotation: Hit_ID=CAB41135.1; Match level="QueryCoverage =98%, HitCoverage=99%, E-value=8e-38, Identity=43%"; Hit description =rac GTP binding protein Arac8 [Arabidopsis thaliana] pir||T06679 GTP- binding protein Arac8 - Arabidopsis t
  misc_feature: Gene Ontology Annotation: Molecular function=ATP binding; Cellular component=cytosol; Biological process=signal transduction
  misc_feature: Pfam annotation: Pfam_ID=Ras; Match level="Score=152.2, E-value=1.2e -42, Copies=1"; Pfam description=Ras family
MMNPKNNTIRITVVGDGDTGKTCMLIVYKDKKFDDRYVPTVFDVYSMLIPINGVEYKVILSDTAGQEEFDKLRRLAYKDVDCFIVTYAVNEKTSFENVFLKWAPELKRFSPKAKIILAGTKMDLRRNHPSHITTEQGEELARDINAHGFIENSSKTMSFIDATFQMAISAVMYNSNYLKVKRESSCICL

SEQ ID NO: 32264 - protein, 77 aa, Diabrotica virgifera
  misc_feature: Coding regions on vcDNA: vcDNA=SeqID_11961; Strand=+; Position=240-470
  misc_feature: Homolog annotation: Hit_ID=XP_318845.1; Match level="QueryCoverage =94%, HitCoverage=19%, E-value=3e-15, Identity=54%"; Hit description =ENSANGP00000014460 [Anopheles gambiae]
  misc_feature (23)..(23): Xaa can be any naturally occurring amino acid
  misc_feature (39)..(39): Xaa can be any naturally occurring amino acid
MITTSIDKTITLDKGEPIPYPVXRHIPYPDTKHVPYPVXDLVPQPYPVDKPIFYSDIVHVRVPVPVPQPYPAVKIVH

SEQ ID NO: 32265 - protein, 40 aa, Diabrotica virgifera
  misc_feature: Coding regions on vcDNA: vcDNA=SeqID_11962; Strand=+; Position=3-122
LKRARELLQAWLPLLGNGVKRAWGLFANKVINCRLIPLRA

SEQ ID NO: 32266 - protein, 44 aa, Diabrotica virgifera
  misc_feature: Coding regions on vcDNA: vcDNA=SeqID_11963; Strand=-; Position=2-133
  misc_feature (3)..(13): Xaa can be any naturally occurring amino acid
  misc_feature (23)..(30): Xaa can be any naturally occurring amino acid
PFXXXXXXXXXXXTNLAHTGLNXXXXXXXXSNRLYNWCSSYIIN

SEQ ID NO: 32267 - protein, 230 aa, Diabrotica virgifera
  misc_feature: Coding regions on vcDNA: vcDNA=SeqID_11964; Strand=+; Position=1-693
  misc_feature (2)..(62): Xaa can be any naturally occurring amino acid
  misc_feature (64)..(130): Xaa can be any naturally occurring amino acid
  misc_feature (135)..(181): Xaa can be any naturally occurring amino acid
  misc_feature (196)..(226): Xaa can be any naturally occurring amino acid
FXXXXXXXXXXXXXXXXXXXXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXYFLNXXXXXXXXXXXXXXXXXXXXXXXXXXXXXXXXXXXXXXXXXXXXXXXHHLVYLLKIYRSTQXXXXXXXXXXXXXXXXXXXXXXXXXXXXXXXIAVF

SEQ ID NO: 32268 - protein, 91 aa, Diabrotica virgifera
  misc_feature: Coding regions on vcDNA: vcDNA=SeqID_11965; Strand=+; Position=114-389
KNFRNLPLEPRGADVQTFDFQAEIAPMENLRHNTFYSHEENLLCRVCCNLLTSLVKPYRNNQQPDHIDSSLGKICTVILYTTTEGGALGMI

SEQ ID NO: 32269 - protein, 104 aa, Diabrotica virgifera; identical to SEQ ID NO: 31825
  misc_feature: Coding regions on vcDNA: vcDNA=SeqID_11966; Strand=+; Position=400-711
  misc_feature (13)..(13): Xaa can be any naturally occurring amino acid
  misc_feature (16)..(22): Xaa can be any naturally occurring amino acid
  misc_feature (31)..(48): Xaa can be any naturally occurring amino acid
  misc_feature (52)..(65): Xaa can be any naturally occurring amino acid
  misc_feature (76)..(76): Xaa can be any naturally occurring amino acid
  misc_feature (86)..(95): Xaa can be any naturally occurring amino acid
  misc_feature (99)..(99): Xaa can be any naturally occurring amino acid

SEQ ID NO: 32270 - protein, 33 aa, Diabrotica virgifera
  misc_feature: Coding regions on vcDNA: vcDNA=SeqID_11967; Strand=+; Position=1-99
  misc_feature (2)..(2): Xaa can be any naturally occurring amino acid
  misc_feature (4)..(33): Xaa can be any naturally occurring amino acid
IXLXXXXXXXXXXXXXXXXXXXXXXXXXXXXXX

SEQ ID NO: 32271 - protein, 50 aa, Diabrotica virgifera
  misc_feature: Coding regions on vcDNA: vcDNA=SeqID_11968; Strand=-; Position=230-382
  misc_feature (14)..(20): Xaa can be any naturally occurring amino acid
DYFIKLCPWVYKYXXXXXXXSVRLSYGLISDHVKVRELNQNYMNIVVTSN

SEQ ID NO: 32272 - protein, 229 aa, Diabrotica virgifera
  misc_feature: Coding regions on vcDNA: vcDNA=SeqID_11969; Strand=+; Position=178-864
  misc_feature: Homolog annotation: Hit_ID=XP_415380.1; Match level="QueryCoverage =95%, HitCoverage=13%, E-value=8e-28, Identity=32%"; Hit description =PREDICTED: similar to RIKEN cDNA 4432404J10 [Gallus gallus]
  misc_feature (182)..(182): Xaa can be any naturally occurring amino acid
MKNDTVEDEDVDVYQLILKLRHETLLVRTEKRKIEDLNRILSEKTHEIIRDSWITTKQRLLLYQRESTIHNYQKVDHLLKSEFIDAKQRIGFQTTIKLGNLLQVLRSQPVQLAKWLIAGEQLDEAQTYSFFLENIIVGLYGCLLFSEDIKYMLSLLYEVAKLQLLNCEDPRRIIKQRTCSFXHLYFLFHEVLQSAKFFLSAAMEIPIVQMMSYTDYYLDLDPEKTIMRF

SEQ ID NO: 32273 - protein, 59 aa, Diabrotica virgifera
  misc_feature: Coding regions on vcDNA: vcDNA=SeqID_11970; Strand=-; Position=483-662
INSQSAPAFGSFDASVSCSTYNIQRYLKVFDMLYILEHYFVILVLIIPIYHMYMSVNII

SEQ ID NO: 32274 - protein, 113 aa, Diabrotica virgifera
  misc_feature: Coding regions on vcDNA: vcDNA=SeqID_11971; Strand=-; Position=76-417
  misc_feature (16)..(24): Xaa can be any naturally occurring amino acid
  misc_feature (45)..(52): Xaa can be any naturally occurring amino acid
VVLKNSVYFCKYDNEXXXXXXXXXLNYNCKLVKLVLQVDYIYFKXXXXXXXXLRNMKCVKNPAAGLLKYKIYLISIIGNLHIFLLHSNVQFCIKMRFSKFHALKIHNNFEVQI

SEQ ID NO: 32275 - protein, 78 aa, Diabrotica virgifera
  misc_feature: Coding regions on vcDNA: vcDNA=SeqID_11972; Strand=-; Position=2-235
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (60)..(76): Xaa can be any naturally occurring amino acid
FXXXXXXXXXXXNQPGSHRFKXXXXXXXXXEXXXXXXXXXXXXXXSNIEVAIFIIDLNSXXXXXXXXXXXXXXXXXCR

SEQ ID NO: 32276 - protein, 77 aa, Diabrotica virgifera
  misc_feature: Coding regions on vcDNA: vcDNA=SeqID_11973; Strand=-; Position=2-232
  misc_feature (1)..(11): Xaa can be any naturally occurring amino acid
  misc_feature (14)..(24): Xaa can be any naturally occurring amino acid
  misc_feature (34)..(41): Xaa can be any naturally occurring amino acid
  misc_feature (44)..(57): Xaa can be any naturally occurring amino acid
  misc_feature (63)..(76): Xaa can be any naturally occurring amino acid
XXXXXXXXXXXLFXXXXXXXXXXXTNLAHTGLNXXXXXXXXSNXXXXXXXXXXXXXXPTSRSXXXXXXXXXXXXXXV

SEQ ID NO: 32277 - protein, 45 aa, Diabrotica virgifera
  misc_feature: Coding regions on vcDNA: vcDNA=SeqID_11974; Strand=+; Position=1-135
  misc_feature (1)..(2): Xaa can be any naturally occurring amino acid
  misc_feature (24)..(30): Xaa can be any naturally occurring amino acid
  misc_feature (33)..(45): Xaa can be any naturally occurring amino acid
XXALTAPRPPRDEWENPLTFLSKXXXXXXXLIXXXXXXXXXXXXX

SEQ ID NO: 32278 - protein, 52 aa, Diabrotica virgifera
  misc_feature: Coding regions on vcDNA: vcDNA=SeqID_11975; Strand=-; Position=2-157
  misc_feature (1)..(8): Xaa can be any naturally occurring amino acid
  misc_feature (38)..(52): Xaa can be any naturally occurring amino acid
XXXXXXXXTIITLMQHRGRNLYDRFELYNKITLLSVRXXXXXXXXXXXXXXX

SEQ ID NO: 32279 - protein, 255 aa, Diabrotica virgifera
  misc_feature: Coding regions on vcDNA: vcDNA=SeqID_11976; Strand=+; Position=30-797
  misc_feature: Homolog annotation: Hit_ID=XP_309658.1; Match level="QueryCoverage =85%, HitCoverage=32%, E-value=9e-13, Identity=26%"; Hit description =ENSANGP00000019702 [Anopheles gambiae]
MRRLFIVFFVTIVSSQNYNYWSELVKNNLNTTTFSDSCSQQFSELFTNDLQDVWNLFDATAKFPWSGLATGSYFDWGNYDQCIKIRHEYTQDRILGKYCTHGLLIPSPKVNISNPDFQDFYKLRLCMPDACTAADYNELVQLINLNGLFIFQDRACHTKEDLDRYSWEDITMVVVLVIFACFMVVSTMYDVYLKLNKKKSIHPICVAFSVYTNGRKIIHTSKHNKEQIQIINEINTISMARVIAGHGMAGWNHFH

SEQ ID NO: 32280 - protein, 26 aa, Diabrotica virgifera
  misc_feature: Coding regions on vcDNA: vcDNA=SeqID_11977; Strand=-; Position=0-77
  misc_feature (2)..(2): Xaa can be any naturally occurring amino acid
FXPFLLPSLPPEGVPFSRPRGGRPEG

SEQ ID NO: 32281 - protein, 229 aa, Diabrotica virgifera
  misc_feature: Coding regions on vcDNA: vcDNA=SeqID_11978; Strand=-; Position=3-689
  misc_feature (25)..(38): Xaa can be any naturally occurring amino acid
  misc_feature (45)..(57): Xaa can be any naturally occurring amino acid
  misc_feature (59)..(138): Xaa can be any naturally occurring amino acid
  misc_feature (142)..(229): Xaa can be any naturally occurring amino acid
QIKDRNHPGSHRFKLRSCKIIKVEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXNKHXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32282 - protein, 83 aa, Diabrotica virgifera
  misc_feature: Coding regions on vcDNA: vcDNA=SeqID_11979; Strand=-; Position=317-568
  misc_feature (6)..(18): Xaa can be any naturally occurring amino acid
IFSRKXXXXXXXXXXXXXISHLTLILSLRSQTKQYTSYCYRGLKSYPFISFNVVRCYQMIIFLSSANPTIPLVRNYSILCCNP

SEQ ID NO: 32283 - protein, 212 aa, Diabrotica virgifera
  misc_feature: Coding regions on vcDNA: vcDNA=SeqID_11980; Strand=+; Position=137-772
  misc_feature: Homolog annotation: Hit_ID=XP_320908.1; Match level="QueryCoverage =100%, HitCoverage=53%, E-value=2e-88, Identity=74%"; Hit description= ENSANGP00000017532 [Anopheles gambiae]
  misc_feature: Gene Ontology Annotation: Cellular component=dynactin complex; Biological process=reproduction
  misc_feature: Pfam annotation: Pfam_ID=Actin; Match level="Score=49.4, E-value=1.1e- 11, Copies=1"; Pfam description=Actin
  misc_feature (43)..(60): Xaa can be any naturally occurring amino acid
  misc_feature (160)..(165): Xaa can be any naturally occurring amino acid
  misc_feature (187)..(187): Xaa can be any naturally occurring amino acid
MEAYDVIVNQPVVIDNGTGVIKAGFAGGQIPKCRFPNYVGRPXXXXXXXXXXXXXXXXXXKAEEHRGLLSIKYPMEHGIVTDWNDMEKIWSYIYSKDQLSTFSEEHPVLLTEAPLNPRPNREKAAEIMFETFNVPALFISMQAVLSLYSTGRTTGVVLDXXXXXXHSVPIYEGFALPHSIMRSDIAXRDISRYLRLLSKKEGIIFRTTAEFE

SEQ ID NO: 32284 - protein, 37 aa, Diabrotica virgifera
  misc_feature: Coding regions on vcDNA: vcDNA=SeqID_11981; Strand=-; Position=2-112
  misc_feature (4)..(25): Xaa can be any naturally occurring amino acid
  misc_feature (29)..(37): Xaa can be any naturally occurring amino acid
MNFXXXXXXXXXXXXXXXXXXXXXXKLLXXXXXXXXX

SEQ ID NO: 32285 - protein, 151 aa, Diabrotica virgifera
  misc_feature: Coding regions on vcDNA: vcDNA=SeqID_11982; Strand=+; Position=41-496
  misc_feature: Homolog annotation: Hit_ID=XP_393468.1; Match level="QueryCoverage =98%, HitCoverage=96%, E-value=8e-61, Identity=75%"; Hit description =similar to Proteasome subunit beta type 2 (Proteasome component C7 -I) (Macropain subunit C7-I)
  misc_feature: Gene Ontology Annotation: Molecular function=endopeptidase activity; Cellular component=26S proteasome; Biological process=sporulation (sensu Saccharomyces)
  misc_feature: Pfam annotation: Pfam_ID=Proteasome; Match level="Score=92.5, E-value= 1.1e-24, Copies=1"; Pfam description=Proteasome A-type and B-type
MECLLGIKFNDYVLVAADMTAAQSIIVMKTDENKLHKLSNKLVMAVSGESGDTTQFAEYIAKNIQLYKMRNTYELSPKEAAAFTRRNLADALRSRSAYHVNLLLAGYDDKEGPQLYYMDYLASIASVDYAAHGYGGFFSLSIMDRNYRQNL

SEQ ID NO: 32286 - protein, 88 aa, Diabrotica virgifera
  misc_feature: Coding regions on vcDNA: vcDNA=SeqID_11983; Strand=-; Position=2-265
  misc_feature (68)..(81): Xaa can be any naturally occurring amino acid
IIENVTRGYLMITEIRNKMYHSSLRCTLINISEKQKKIVRRYSRTYLRQTHISTIEYKKKNYKNTNKXXXXXXXXXXXXXXLVRTRLR

SEQ ID NO: 32287 - protein, 235 aa, Diabrotica virgifera
  misc_feature: Coding regions on vcDNA: vcDNA=SeqID_11984; Strand=+; Position=23-727
  misc_feature: Homolog annotation: Hit_ID=CAE56149.1; Match level="QueryCoverage =54%, HitCoverage=11%, E-value=7e-22, Identity=37%"; Hit description =Hypothetical protein CBG23762 [Caenorhabditis briggsae]
MNTAKHPVHWDDTETAFNSRIMTGVISNLKHRDPASFLEDCKAIFKRRLQNALKKNEAVKVNTVFGGEFVIAKGDQTINAYKYFTTPNAPIYRDTNLDKWFNGKVVEPIMRDLSEFQEQDSGWALKAIVNLGVNVNKYVPQRGSSYIELPFQIKRKQACINVKNEDEACFAWAVISALFPVEQDAQRDSKYPHYSQVLKLKGIQFPMTMRQIPNSERQNDISINVYILKTEKNMI

SEQ ID NO: 32288 - protein, 18 aa, Diabrotica virgifera
  misc_feature: Coding regions on vcDNA: vcDNA=SeqID_11985; Strand=-; Position=1-54
  misc_feature (1)..(18): Xaa can be any naturally occurring amino acid
XXXXXXXXXXXXXXXXXX

SEQ ID NO: 32289 - protein, 54 aa, Diabrotica virgifera
  misc_feature: Coding regions on vcDNA: vcDNA=SeqID_11986; Strand=-; Position=69-233
  misc_feature (38)..(48): Xaa can be any naturally occurring amino acid
SFEPKILHFHFRAISICLFKYTVKGIIKKNTIKLTIFXXXXXXXXXXXLFIHFC

SEQ ID NO: 32290 - protein, 49 aa, Diabrotica virgifera
  misc_feature: Coding regions on vcDNA: vcDNA=SeqID_11987; Strand=-; Position=1-147
  misc_feature (31)..(49): Xaa can be any naturally occurring amino acid
ILPCSLVTHREESLQVCIPILSPISIPSSCXXXXXXXXXXXXXXXXXXX

SEQ ID NO: 32291 - protein, 33 aa, Diabrotica virgifera
  misc_feature: Coding regions on vcDNA: vcDNA=SeqID_11988; Strand=+; Position=1-99
  misc_feature (3)..(16): Xaa can be any naturally occurring amino acid
  misc_feature (19)..(32): Xaa can be any naturally occurring amino acid
MAXXXXXXXXXXXXXXLFXXXXXXXXXXXXXXL

SEQ ID NO: 32292 - protein, 34 aa, Diabrotica virgifera
  misc_feature: Coding regions on vcDNA: vcDNA=SeqID_11989; Strand=-; Position=0-101
  misc_feature (1)..(8): Xaa can be any naturally occurring amino acid
  misc_feature (10)..(11): Xaa can be any naturally occurring amino acid
  misc_feature (13)..(33): Xaa can be any naturally occurring amino acid
XXXXXXXXKXXKXXXXXXXXXXXXXXXXXXXXXP

SEQ ID NO: 32293 - protein, 67 aa, Diabrotica virgifera
  misc_feature: Coding regions on vcDNA: vcDNA=SeqID_11990; Strand=-; Position=1-201
TQRNAQLRINKRYSILHTLKILTKTERQIFTPLSLNILQFYFTPLERRIYYILSKGPDGGEGPGIPA

SEQ ID NO: 32294 - protein, 294 aa, Diabrotica virgifera
  misc_feature: Coding regions on vcDNA: vcDNA=SeqID_11991; Strand=+; Position=1-882
  misc_feature (19)..(276): Xaa can be any naturally occurring amino acid
VWVVRFYIQKISNSCSSKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLDSKNPKLRQKQNGSLLT

SEQ ID NO: 32295 - protein, 72 aa, Diabrotica virgifera
  misc_feature: Coding regions on vcDNA: vcDNA=SeqID_11992; Strand=+; Position=405-620
YRYAIRNGLLPLFKAKNLNELPLKDKDILKNHITYYFVDDVTYLYKVTKPVINGYGKNYAVPYCSPVFYKHV

SEQ ID NO: 32296 - protein, 130 aa, Diabrotica virgifera
  misc_feature: Coding regions on vcDNA: vcDNA=SeqID_11993; Strand=-; Position=1-390
  misc_feature (4)..(19): Xaa can be any naturally occurring amino acid
  misc_feature (21)..(130): Xaa can be any naturally occurring amino acid
DQKXXXXXXXXXXXXXXXXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32297 - protein, 34 aa, Diabrotica virgifera; identical to SEQ ID NO: 27603
  misc_feature: Coding regions on vcDNA: vcDNA=SeqID_11994; Strand=-; Position=80-184

SEQ ID NO: 32298 - protein, 34 aa, Diabrotica virgifera
  misc_feature: Coding regions on vcDNA: vcDNA=SeqID_11995; Strand=-; Position=1-102
  misc_feature (11)..(30): Xaa can be any naturally occurring amino acid
  misc_feature (33)..(33): Xaa can be any naturally occurring amino acid
NYAVSLKVIYXXXXXXXXXXXXXXXXXXXXLNXF

SEQ ID NO: 32299 - protein, 100 aa, Diabrotica virgifera
  misc_feature: Coding regions on vcDNA: vcDNA=SeqID_11996; Strand=-; Position=1-300
  misc_feature (4)..(85): Xaa can be any naturally occurring amino acid
  misc_feature (90)..(100): Xaa can be any naturally occurring amino acid
IPPXXXXXXXXXXXXXXXXXXXXXXXXXXXXXXXXXXXXXXXXXXXXXXXXXXXXXXXXXXXXXXXXXXXXXXXXXXXXXXXXXXNPVGXXXXXXXXXXX

SEQ ID NO: 32300 - protein, 260 aa, Diabrotica virgifera; identical to SEQ ID NO: 28506
  misc_feature: Coding regions on vcDNA: vcDNA=SeqID_11997; Strand=-; Position=1-780
  misc_feature (1)..(260): Xaa can be any naturally occurring amino acid

SEQ ID NO: 32301 - protein, 251 aa, Diabrotica virgifera
  misc_feature: Coding regions on vcDNA: vcDNA=SeqID_11998; Strand=+; Position=1-753
  misc_feature (1)..(55): Xaa can be any naturally occurring amino acid
  misc_feature (59)..(195): Xaa can be any naturally occurring amino acid
  misc_feature (200)..(248): Xaa can be any naturally occurring amino acid
XXXXXXXXXXXXXXXXXXXXXXXXXXXXXXXXXXXXXXXXXXXXXXXXXXXXXXXMKSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAHRLXXXXXXXXXXXXXXXXXXXXXXXXXXXXXXXXXXXXXXXXXXXXXXXXXIFF

SEQ ID NO: 32302 - protein, 327 aa, Diabrotica virgifera
  misc_feature: Coding regions on vcDNA: vcDNA=SeqID_11999; Strand=+; Position=2-982
  misc_feature (2)..(262): Xaa can be any naturally occurring amino acid
  misc_feature (264)..(277): Xaa can be any naturally occurring amino acid
  misc_feature (284)..(284): Xaa can be any naturally occurring amino acid
  misc_feature (288)..(296): Xaa can be any naturally occurring amino acid
  misc_feature (299)..(299): Xaa can be any naturally occurring amino acid
  misc_feature (307)..(307): Xaa can be any naturally occurring amino acid
  misc_feature (315)..(315): Xaa can be any naturally occurring amino acid
  misc_feature (317)..(325): Xaa can be any naturally occurring amino acid
PXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXRPRWWIXVIIXXXXXXXXXVDXLNLHDLSXTGGSPGGXYXXXXXXXXXEG

SEQ ID NO: 32303 - protein, 312 aa, Diabrotica virgifera
  misc_feature: Coding regions on vcDNA: vcDNA=SeqID_12000; Strand=-; Position=1-939
  misc_feature (3)..(15): Xaa can be any naturally occurring amino acid
  misc_feature (27)..(35): Xaa can be any naturally occurring amino acid
  misc_feature (37)..(172): Xaa can be any naturally occurring amino acid
  misc_feature (176)..(236): Xaa can be any naturally occurring amino acid
  misc_feature (238)..(267): Xaa can be any naturally occurring amino acid
  misc_feature (269)..(288): Xaa can be any naturally occurring amino acid
  misc_feature (293)..(310): Xaa can be any naturally occurring amino acid
RTXXXXXXXXXXXXXIQHRGSQSYLSXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQKCXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXLXXXXXXXXXXXXXXXXXXXXKNEYXXXXXXXXXXXXXXXXXXFF

SEQ ID NO: 32304 - protein, 99 aa, Diabrotica virgifera
  misc_feature: Coding regions on vcDNA: vcDNA=SeqID_12001; Strand=+; Position=102-401
  misc_feature (7)..(22): Xaa can be any naturally occurring amino acid
  misc_feature (66)..(99): Xaa can be any naturally occurring amino acid
SFYRKHXXXXXXXXXXXXXXXXFLIFQVKTAKQIYKFYCQTQIINNFFGRKGYSFFDISNFLRDNXXXXXXXXXXXXXXXXXXXXXXXXXXXXXXXXXX

SEQ ID NO: 32305 - protein, 288 aa, Diabrotica virgifera
  misc_feature: Coding regions on vcDNA: vcDNA=SeqID_12002; Strand=+; Position=82-946
  misc_feature: Homolog annotation: Hit_ID=AAC72921.1; Match level="QueryCoverage =39%, HitCoverage=12%, E-value=1e-14, Identity=35%"; Hit description =putative endonuclease/reverse transcriptase [Lymantria dispar]
  misc_feature (216)..(216): Xaa can be any naturally occurring amino acid
  misc_feature (251)..(252): Xaa can be any naturally occurring amino acid
  misc_feature (267)..(267): Xaa can be any naturally occurring amino acid
MQHSNKTSLSINIDAQELYNNLMSAIKETASQLQLCKEKSFPSCIRQSPPWFDHECTSAKNNMKQSLKTAKSNNFRDPYKTNFLTSKKAYRIYFHNLYSQLANSRDSKTFWSVIRKFRKNHNTSFIDVDVWEQFYSNIYPPKLYHNARFFDARHPIFDAIITSDEIYRVLNNCPNRKAPGTDHISYEFFKNLPNNWILYLTGMFNRILETTITPHXKKGNRDDPANYRGIALLNCVEKIFTNILLNRLRDXXESNNSLPECQSGFRXSRGCIDNVFTPHFCCTTATTT

SEQ ID NO: 32306 - protein, 228 aa, Diabrotica virgifera
  misc_feature: Coding regions on vcDNA: vcDNA=SeqID_12003; Strand=+; Position=69-756
  misc_feature: Homolog annotation: Hit_ID=NP_704188.1; Match level="QueryCoverage =89%, HitCoverage=58%, E-value=7e-11, Identity=29%"; Hit description =hypothetical protein [Plasmodium falciparum 3D7] emb|CAD51004.1| hypothetical protein [Plasmodium
  misc_feature (26)..(26): Xaa can be any naturally occurring amino acid
  misc_feature (58)..(58): Xaa can be any naturally occurring amino acid
  misc_feature (103)..(103): Xaa can be any naturally occurring amino acid
  misc_feature (125)..(125): Xaa can be any naturally occurring amino acid
  misc_feature (143)..(143): Xaa can be any naturally occurring amino acid
  misc_feature (203)..(210): Xaa can be any naturally occurring amino acid
PQLCPHSPPIILIIPIFSTSSFILFXSFNLLSLLFQNFLFPSLLPNSFTRITLLTIEXINHHLINSPYYLFTSFSFHYFVQFNSTPHLFFIPLFPLKFLSLYXYTTALCFLSLTFSKKTFTSPTXSIHLISVLTFRSIIITIXIISIFFFLLWFYFIQYTFNIIFILISFLYQLDLTAIIIHYFISNFPYQHFVTRILSKLLXXXXXXXXSHNNYNSFSFTYYTLLII

SEQ ID NO: 32307 - protein, 243 aa, Diabrotica virgifera
  misc_feature: Coding regions on vcDNA: vcDNA=SeqID_12004; Strand=+; Position=127-858
  misc_feature: Homolog annotation: Hit_ID=EAA03925.2; Match level="QueryCoverage =94%, HitCoverage=74%, E-value=2e-82, Identity=63%"; Hit description =ENSANGP00000021479 [Anopheles gambiae str. PEST] ref|XP_565133.1| ENSANGP00000021479 [Anopheles gambiae st
  misc_feature: Gene Ontology Annotation: Molecular function=molecular_function unknown; Cellular component=spliceosome complex; Biological process =embryogenesis and morphogenesis
  misc_feature: Pfam annotation: Pfam_ID=zf-CCCH; Match level="Score=41.2, E-value=3e- 09, Copies=1"; Pfam description=Zinc finger C-x8-C-x5-C-x3-H type (an
  misc_feature (230)..(230): Xaa can be any naturally occurring amino acid
  misc_feature (239)..(239): Xaa can be any naturally occurring amino acid
MTTVPGENCNFVFKKRSIKNRGTRKRQASSSEEDPEENEQKEQIVKHSKRKIKSNPNIQSTSNIQNRERNREKESSSSSDEDFRVNYKSKKSAMAAGPSDQGATATVEIDTETDRDAQAIFEKRLEINKDLEGKEDDKIYRGLNNYAQYYKPKDTAAGNASSGLVRKGPIRAPANLRATVRWDYQPDICKDYKETGFCGFGDSCKFLHDRSDYKHGWQLEREWNEGSYSXDSDDDTRYXIHSG

SEQ ID NO: 32308 - protein, 279 aa, Diabrotica virgifera
  misc_feature: Coding regions on vcDNA: vcDNA=SeqID_12005; Strand=+; Position=3-839
  misc_feature: Homolog annotation: Hit_ID=XP_315285.1; Match level="QueryCoverage =100%, HitCoverage=31%, E-value=1e-56, Identity=41%"; Hit description= ENSANGP00000015293 [Anopheles gambiae]
  misc_feature: Gene Ontology Annotation: Molecular function=heat shock protein activity; Cellular component=cytoplasm; Biological process=response to stress
IPYPDHDIGTWVIKDIKPNSEGKPQKVKVKVRVNLHGIMSISSASLYEAKESVEPESPEEQQKEAQVNSNDQQNGGVQTNESGESMETTNEGTGANSGEGAVPEEGSDKKKKQSVKSIELPIESLTTGFSQVEINHFTEQEFKMIASDRQEKERADARNAFEEYVYELRNKVSSDGDFAPFMPENDRNTLVSQLDDMENWLYEDGEDCNKQVYIDKLQQLKSIGEPVQTRKIEYELRPVVIEDFAKSLQLCMKALELIRSKDQKYAHLTEEDYNKVEDA

SEQ ID NO: 32309 - protein, 66 aa, Diabrotica virgifera; identical to SEQ ID NO: 26808
  misc_feature: Coding regions on vcDNA: vcDNA=SeqID_12006; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 32310 - protein, 65 aa, Diabrotica virgifera
  misc_feature: Coding regions on vcDNA: vcDNA=SeqID_12007; Strand=-; Position=1-195
  misc_feature (2)..(12): Xaa can be any naturally occurring amino acid
  misc_feature (20)..(20): Xaa can be any naturally occurring amino acid
  misc_feature (22)..(29): Xaa can be any naturally occurring amino acid
  misc_feature (32)..(39): Xaa can be any naturally occurring amino acid
  misc_feature (56)..(56): Xaa can be any naturally occurring amino acid
FXXXXXXXXXXXNQLGLPRXKXXXXXXXXSTXXXXXXXXPIINLIQHRGRNLYYRXELSNKITLL

SEQ ID NO: 32311 - protein, 112 aa, Diabrotica virgifera
  misc_feature: Coding regions on vcDNA: vcDNA=SeqID_12008; Strand=-; Position=220-558
DITMYWKYNFKMFFDPYLDITYDHRVTSHALFYYADHISSTLSLPTCIILTSTWLMYLAFYINRLYPFIHLLIIIPSKYTFFHDTNIMHIFSSASRLGYIISVLGRHFYKIS

SEQ ID NO: 32312 - protein, 243 aa, Diabrotica virgifera
  misc_feature: Coding regions on vcDNA: vcDNA=SeqID_12009; Strand=+; Position=133-864
  misc_feature: Homolog annotation: Hit_ID=EAL25663.1; Match level="QueryCoverage =92%, HitCoverage=90%, E-value=1e-51, Identity=45%"; Hit description =GA17871-PA [Drosophila pseudoobscura]
  misc_feature: Gene Ontology Annotation: Molecular function=water transporter activity; Cellular component=integral to plasma membrane; Biological process=transport
  misc_feature: Pfam annotation: Pfam_ID=MIP; Match level="Score=186.7, E-value=4.8e -53, Copies=1"; Pfam description=Major intrinsic protein
MRIRRLVQIQDEMSVLERFIMFLSEFGGTACLVFIGCLGCLSANGTIISFGFGFAIMMGVQIFGHISGAHINPAVTVAAATLGIFPLINIPIYIFGQLLGAITGFGLVKLLINNSVLSISGLCSPGPTGVLSAFQLFLSEFILTLILILVCCAIWDSRNATKHDSLPLRLGLAVTGLAMAGGGLSGANMNPARSFGPALLNNTWDRHWVYWIAPLLAGFVGALVYRIIFSKDAKKNETYPEGT

SEQ ID NO: 32313 - protein, 45 aa, Diabrotica virgifera
  misc_feature: Coding regions on vcDNA: vcDNA=SeqID_12010; Strand=+; Position=2-139
  misc_feature (16)..(22): Xaa can be any naturally occurring amino acid
DVRETVLRDIVIVLIXXXXXXXVRWFHLCIRYVHFGNYNRNKDNF

SEQ ID NO: 32314 - protein, 34 aa, Diabrotica virgifera
  misc_feature: Coding regions on vcDNA: vcDNA=SeqID_12011; Strand=-; Position=1-102
  misc_feature (1)..(30): Xaa can be any naturally occurring amino acid
XXXXXXXXXXXXXXXXXXXXXXXXXXXXXXFKLI

SEQ ID NO: 32315 - protein, 122 aa, Diabrotica virgifera
  misc_feature: Coding regions on vcDNA: vcDNA=SeqID_12012; Strand=+; Position=3-371
  misc_feature (5)..(16): Xaa can be any naturally occurring amino acid
  misc_feature (25)..(37): Xaa can be any naturally occurring amino acid
  misc_feature (45)..(66): Xaa can be any naturally occurring amino acid
  misc_feature (70)..(82): Xaa can be any naturally occurring amino acid
  misc_feature (109)..(116): Xaa can be any naturally occurring amino acid
LFTPXXXXXXXXXXXXQYSLVKVTXXXXXXXXXXXXXQYFIFINXXXXXXXXXXXXXXXXXXXXXXPNLXXXXXXXXXXXXXILHTLFVMQCPSVLNISNFLGTKLNSXXXXXXXXYILLYH

SEQ ID NO: 32316 - protein, 27 aa, Diabrotica virgifera
  misc_feature: Coding regions on vcDNA: vcDNA=SeqID_12013; Strand=-; Position=2-82
  misc_feature (7)..(27): Xaa can be any naturally occurring amino acid
IIKKNWXXXXXXXXXXXXXXXXXXXXX

SEQ ID NO: 32317 - protein, 66 aa, Diabrotica virgifera; identical to SEQ ID NO: 26808
  misc_feature: Coding regions on vcDNA: vcDNA=SeqID_12014; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 32318 - protein, 93 aa, Diabrotica virgifera
  misc_feature: Coding regions on vcDNA: vcDNA=SeqID_12015; Strand=-; Position=54-335
SRSGGIGAAQIIWDTPGVINPHTPGYIKDQGGVLLIIKSIEIFGRAKGWGLFYFLPHVEKGDRVKGEYQGKARGFSSTTLVNNGPRNLIRGAQ

SEQ ID NO: 32319 - protein, 108 aa, Diabrotica virgifera
  misc_feature: Coding regions on vcDNA: vcDNA=SeqID_12016; Strand=+; Position=188-514
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid
NYAVIPKGIYSYXXXXXXXXXXXXXXXXXXXXXXXXXPXXXXXXXXXXXXXXXXXXXXXXSIGSSXXXXXXXLFXXXXXXXXXXXXXXXXXXXPSFQXXXXXXXXMLP

SEQ ID NO: 32320 - protein, 29 aa, Diabrotica virgifera
  misc_feature: Coding regions on vcDNA: vcDNA=SeqID_12017; Strand=-; Position=1-87
  misc_feature (2)..(14): Xaa can be any naturally occurring amino acid
  misc_feature (18)..(29): Xaa can be any naturally occurring amino acid
PXXXXXXXXXXXXXLKNXXXXXXXXXXXX

SEQ ID NO: 32321 - protein, 28 aa, Diabrotica virgifera
  misc_feature: Coding regions on vcDNA: vcDNA=SeqID_12018; Strand=-; Position=1-84
  misc_feature (6)..(6): Xaa can be any naturally occurring amino acid
  misc_feature (10)..(10): Xaa can be any naturally occurring amino acid
  misc_feature (13)..(26): Xaa can be any naturally occurring amino acid
KVIYSXIKKXGSXXXXXXXXXXXXXXYF

SEQ ID NO: 32322 - protein, 49 aa, Diabrotica virgifera
  misc_feature: Coding regions on vcDNA: vcDNA=SeqID_12019; Strand=+; Position=194-343
MERRCVIFRVYCMFLMKRAKYCRFIPDEERAYLLNISGFYSLMIITDET

SEQ ID NO: 32323 - protein, 280 aa, Diabrotica virgifera
  misc_feature: Coding regions on vcDNA: vcDNA=SeqID_12020; Strand=-; Position=0-839
  misc_feature (1)..(279): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 32324 - protein, 298 aa, Diabrotica virgifera
  misc_feature: Coding regions on vcDNA: vcDNA=SeqID_12021; Strand=-; Position=2-896
  misc_feature: Homolog annotation: Hit_ID=AAC47271.1; Match level="QueryCoverage =98%, HitCoverage=41%, E-value=1e-48, Identity=33%"; Hit description =protease, reverse transcriptase and RNase H pir||S68306 pol polyprotein, truncated - red flour beetle retr
  misc_feature (32)..(32): Xaa can be any naturally occurring amino acid
  misc_feature (34)..(34): Xaa can be any naturally occurring amino acid
  misc_feature (41)..(41): Xaa can be any naturally occurring amino acid
  misc_feature (163)..(170): Xaa can be any naturally occurring amino acid
INHTIPQYEAPATTETIFGRITGAKYFSKVDXRXSFWLIPXAHESRDYTAFMIDGVLYRFCVVPYGLQSSCSALVRALHNILNKYDDFILHYIDDILILSKDEHSHLKHIEILLKELDLAGLKINIKKCKFFQDSVTFLGYKIDNLGVSMDEERVNRIKEYPXXXXXXXXRGFLGLINYFKRLVPDLSQKIVPLNHLLKKGVKWYWGMEQQFAFDNIKNQFCQNLKIYHPDYSLPFTLRTDASMHKLSGVLLQYQNECEVPISFVSRLTRSYEQGYSVGELEFASIVFCVNKLRFYLL

SEQ ID NO: 32325 - protein, 76 aa, Diabrotica virgifera
  misc_feature: Coding regions on vcDNA: vcDNA=SeqID_12022; Strand=-; Position=3-230
  misc_feature (21)..(75): Xaa can be any naturally occurring amino acid
QIKNFPLVYAVKGKFFSFLLXXXXXXXXXXXXXXXXXXXXXXXXXXXXXXXXXXXXXXXXXXXXXXXXXXXXXXXF

SEQ ID NO: 32326 - protein, 66 aa, Diabrotica virgifera; identical to SEQ ID NO: 26808
  misc_feature: Coding regions on vcDNA: vcDNA=SeqID_12023; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 32327 - protein, 258 aa, Diabrotica virgifera
  misc_feature: Coding regions on vcDNA: vcDNA=SeqID_12024; Strand=-; Position=1-774
  misc_feature (7)..(7): Xaa can be any naturally occurring amino acid
  misc_feature (11)..(11): Xaa can be any naturally occurring amino acid
  misc_feature (14)..(29): Xaa can be any naturally occurring amino acid
  misc_feature (32)..(258): Xaa can be any naturally occurring amino acid
LVFKKIXAFNXKNXXXXXXXXXXXXXXXXPFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 32328 - protein, 78 aa, Diabrotica virgifera
  misc_feature: Coding regions on vcDNA: vcDNA=SeqID_12025; Strand=-; Position=292-528
YYTVSFTYSSLSIAVNYSANLKVVSEINFSSSKNLFLELSFCSNINFGEYSSEVLYKSFHTTISLYDAFRQSNIHNIK

SEQ ID NO: 32329 - protein, 199 aa, Diabrotica virgifera
  misc_feature: Coding regions on vcDNA: vcDNA=SeqID_12026; Strand=+; Position=209-805
  misc_feature (2)..(13): Xaa can be any naturally occurring amino acid
  misc_feature (20)..(41): Xaa can be any naturally occurring amino acid
  misc_feature (53)..(136): Xaa can be any naturally occurring amino acid
  misc_feature (138)..(179): Xaa can be any naturally occurring amino acid
  misc_feature (181)..(199): Xaa can be any naturally occurring amino acid
LXXXXXXXXXXXXKVIRVYXXXXXXXXXXXXXXXXXXXXXXVILLVLKIFRDXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXXXXXXXXXXXXXXXXXXXXXXXXXXEXXXXXXXXXXXXXXXXXXX

SEQ ID NO: 32330 - protein, 67 aa, Diabrotica virgifera
  misc_feature: Coding regions on vcDNA: vcDNA=SeqID_12027; Strand=-; Position=2-202
  misc_feature (4)..(14): Xaa can be any naturally occurring amino acid
  misc_feature (24)..(31): Xaa can be any naturally occurring amino acid
  misc_feature (34)..(47): Xaa can be any naturally occurring amino acid
  misc_feature (53)..(66): Xaa can be any naturally occurring amino acid
PFGXXXXXXXXXXXPTWAHTGLNXXXXXXXXSNXXXXXXXXXXXXXXPTSRSXXXXXXXXXXXXXXV

SEQ ID NO: 32331 - protein, 177 aa, Diabrotica virgifera
  misc_feature: Coding regions on vcDNA: vcDNA=SeqID_12028; Strand=+; Position=110-640
  misc_feature: Homolog annotation: Hit_ID=XP_392962.1; Match level="QueryCoverage =98%, HitCoverage=55%, E-value=3e-67, Identity=69%"; Hit description =similar to putative activated protein kinase C receptor [Apis mellifera]
  misc_feature: Gene Ontology Annotation: Molecular function=molecular_function unknown; Cellular component=actin filament; Biological process =signal transduction
  misc_feature: Pfam annotation: Pfam_ID=WD40; Match level="Score=49.8, E-value=8e -12, Copies=3"; Pfam description=WD domain, G-beta repeat
  misc_feature (19)..(19): Xaa can be any naturally occurring amino acid
  misc_feature (52)..(52): Xaa can be any naturally occurring amino acid
  misc_feature (59)..(59): Xaa can be any naturally occurring amino acid
  misc_feature (145)..(145): Xaa can be any naturally occurring amino acid
LVCKWTREDSRYGVPHKLXYGHSHFIADAVLSSDVTYALSGSWYKTLRLWDXVAGKTTXRFVDDAKDDVSVFFSVDYRQIVSEYRDNTIEVWNSLDECKYTIHDDGHSDWESCVRFSPNHANPIIESAGWDRMVKGWNLTNRRLXINHSVHTGYLKPDADSPDGSLCARVGQDCKPW

SEQ ID NO: 32332 - protein, 249 aa, Diabrotica virgifera
  misc_feature: Coding regions on vcDNA: vcDNA=SeqID_12029; Strand=+; Position=1-747
  misc_feature (3)..(240): Xaa can be any naturally occurring amino acid
IFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLTIHGKLQR

SEQ ID NO: 32333 - protein, 33 aa, Diabrotica virgifera
  misc_feature: Coding regions on vcDNA: vcDNA=SeqID_12030; Strand=-; Position=3-101
  misc_feature (9)..(16): Xaa can be any naturally occurring amino acid
  misc_feature (24)..(33): Xaa can be any naturally occurring amino acid
GHNTAGHSXXXXXXXXLIFSPKSXXXXXXXXXX

SEQ ID NO: 32334 - protein, 219 aa, Diabrotica virgifera
  misc_feature: Coding regions on vcDNA: vcDNA=SeqID_12031; Strand=+; Position=3-662
  misc_feature (10)..(56): Xaa can be any naturally occurring amino acid
  misc_feature (59)..(78): Xaa can be any naturally occurring amino acid
  misc_feature (87)..(118): Xaa can be any naturally occurring amino acid
  misc_feature (122)..(161): Xaa can be any naturally occurring amino acid
  misc_feature (176)..(182): Xaa can be any naturally occurring amino acid
  misc_feature (187)..(200): Xaa can be any naturally occurring amino acid
  misc_feature (209)..(219): Xaa can be any naturally occurring amino acid
YFKIPKYALXXXXXXXXXXXXXXXXXXXXXXXXXXXXXXXXXXXXXXXXXXXXXXXQFXXXXXXXXXXXXXXXXXXXXTEMLFAFTXXXXXXXXXXXXXXXXXXXXXXXXXXXXXXXXMSLXXXXXXXXXXXXXXXXXXXXXXXXXXXXXXXXXXXXXXXXYSNINLDYFNLVLMXXXXXXXCIFTXXXXXXXXXXXXXXPPVHSQHVXXXXXXXXXXX
